United States Patent 7,625,699 (GENETIC POLYMORPHISMS ASSOCIATED WITH CORONARY STENOSIS, METHODS OF DETECTION AND USES THEREOF) - sequence listing, part 9

SEQ ID NO: 12394 - DNA, 1184710 bp, Homo sapiens
  misc_feature (1)...(1184710): n = A,T,C or G, or insertion/deletion polymorphism (see Tables 1-2)
tgaataaataataccccctgacacaaacacaggcactgtcattttggaccttcacctagatgcgattgtaaagaatgaacttcaaattctgctagaaggaagggttgaattatgagctttcctttgcagttatttcttttctcatcaatggatatgaaaaatacaacatctgcgaagtggagacccatgatggtttttgacacataatagaaaccagcagtgaatcccttgtctcttcttttttattttttatttatttattttttccctcagacagggtcttgctctgtcacccaggctggagtgcaatggcacaatcttggctcactgtaacctctgcctcccggactcaagtgatcctcccaccttggcctcctgagtagctgggaacacaggcatgtgtcaccacgcccagctaatttttgtaatttttggagagatgggttttcaccacgttgcccaggctggtcccgaacttctggactcaaatgatccacgcgcctcagcctccgaaagtgttgggattacgggcgtgagccactgcacccggccccctcgtgttttcttaaacacatcttgatccttcatacctctggctaccttgactgtgtttcagcaccccctgtagcacattataacataatttctcccaattagtcatattttcttaagcatacacaccatgcatcataatttatttccctgttgcttaactcaggggctaatatgcaataggcactttagggatactttttaaatgaataaataaatatttgtgagtgagtagtggagaactctctggagcattggttttcaaagtgtacattccaagggcttgtaaaacacagaatgctggactccacccctgaatttccaaactagtagaactaggggcctgatctgcctgggaatttttcattgctgacaagtttccaggtgatactgatgctgccagtcttgggccacactgtaaacgtcattgtcatactaaattggcactgagatgattctctgtgtaaaaataaccccagccactaattttgggtaagggagacacctagaggggggttttaactgcttcttgttcagagaataaaaattggtgtctgaatgcccagttttgcttctcatgagggactgaagtactaaagacaattgggccaatttaactgagatggcctaaaagtcacccctggtttcatctccattgctagtgtggaagtcacgcttgtattaaacatattcacagaggacactgtattagggcagaacctaaaaagatgaaggagtattttttgtcttattcttagatgtgtgggctctgcctacatcaaggaaattcagaaggatatcacaccctgtgtgtcctccacaaaagatcttcagacacccacaggctcacacatgttcttcactgtgtctagtcctggtctggactattgtgagaagaccttgcatcgtagggagctacatgtgatgggcctctcagcatcacacatttttcaacacaaaagccaattaattcacccgctcaaaccaagtcttctaagcacctgccgtgctccagaccctgttctgagcacgcagcagtaaaaatacagaaatgagcttacattccagaggaagagacagacaacaagccaacagatgtaatcactcattaattattgctacaaaacaaattacctcaaaatataaagcaattgtttattttcaggtcacatacctgctgatcagctgagctgggcaaatttggctgggcaagcatctgtgggcccatgaggggctcatatttcctcctaggaccggcgggatagcccacaaatgctcttttcaaggcatcagtaggagcttttgcgagagtaagctaaaacacagagggtctcttgggacctgagcttataactggtaccccatcccttctgcttcatttcatttgtcacagaagttgcatggctaaacccaaggccaaggggcaaagggcacagatgcaggttggagtgaaggattgagatgacaacgcaagcaacaatgcgtagcagaaggtcaagtaacatagggggccaggaagaaacacgaagcagtgtttgtggcttaagagtgatcaggaatgctacttttggtcagcattctggtagccagggagacttgttgtaggacggtgcattgtcctaatcttgggtgtttttagcaggtgttcccattgtagggagtgagacattagcatgaaggtatgttgcagtgctgtgtgatacaggcttccctgcatgctgtccaagtgggtctctgttatccaggtccccagacacgcctaatcactgggttgttgcataagggctcctagctggattaatcccgctctatacaaatgcctcatcatagcagcacattgaaagcataacaaaatttgaatacattatctctgccggactatatgccagtcactccctccccccagcacacacacacccatgtgcttatatgcatacacacaggaacatgcacgcactcacacagccacatccacccactgtggaatgccttcatcaacatcagccaaggacaggaaacaaactcaacccttggcacccacaggaggcagctactggctgttggattattccctccgtgccaaagctaggctgatgcgtctggaaaaggggtgtgaacctcgaatgtgtctaaaggcagacacagcttcttgaggagcccacagatgctacagcagctggggcttggtcgggggatgatacggggtaggcggtggagtggggatacgtagggctcaactttagtatttatttgccacatcaatcaattaatcagccaaaaaacccttattagggaactgaataaaaagcaaagcaaaacgaagaatggatttcttcttcagaagccttttatcattggaatgaaataatttttcttctgtctttgttggacaaaatatgatctcttgttctttgttgaagtgcacgttctctgaaagtcgagaggaatagatgatagaggggaagagaaacatcaatatttacaacagtcctgggagtgttatcatgttatcattcgcattttattgatgacatactgagtcttagggtaccaaactgacttgcctcatatatgtggaatctgaagatctcagttcaggtctaatctttctgacaaatctttttccaccttagtaggcttggcatgttttgaacctcgtgggattacagaagtgagcctcaatgcctagggagactccagaagacaactcctctcattccttaaaagccaatctgtggggattgaggtgaggaaggagtgaagactggccctttgggcacacccacctggaatcaggcaaggtttactggagccactctgcctgccagcagaacagcccaggaaaaaagcctgggacctttgcaaatgcctgagcaggactttgcaggggacagagtcagcaggattttcaccaaacgacatccatcttaattggtagcatcagactcatgaggtcttctatggcctgggcatcacagactctcattactggtcgtactgccaatggcctccttttatatatagttgatgaatttgaggacaaaccagagaattgcccttggccaaaccaagctgtctcacccaagatttttcccctccttggggaaatactggggcaaaaagcacgtccagggaaaccaatctgcctgacactggcaattaaatgctccaggcttgaagggacatggcacttttgcacatggctcattggctagatgtacacacactgccccaccccagcaacaagggggccagtaaatgcaatcccaccatgatcccaaaaggggaaaaattggaaatatttggtcatcagcactaaggacaagggaatggggagaccacagaaggccagcagaactgtaaaactgacagcaccgaactgtccttagaacacagccttgaaaactccctcttctgagggactgcttcccttaactgagctgctgcagatggaaacctagctagatcctcatcttctgcagtctagtccctcactgtggtttatcacctcccaagctgtcctctgctctctttccctatctttgtgttgctaagccatggactcagtttagctggccctgaattacaagatggcaccttccctggaatggagaaaagtccggatatttcaggatgccttgatttgaagcctgtttgactccaaagttctctggtttactcccacctgtgggaaacgtgaggctagatctccacacacatggattccaaagtgtcatgatctgtgacgtcatctgtcggaccgtattgatcagaggctcagggacagatgaccctatttaggcaaggaaatgagtgggtgaagcagcaagattcacctttcccagtttcatctgggggttgttttgccaacattgccatctgttgggccagtgctggctacagcagccaagcttcagacatcactgcatctttatcaatgaccttgggaccacaggaggtgaccttctgaccaaacagcagccaatgaaggaatcttaaaaggcacatcactttatatttattcagtggttatgtcatcacttaatcctcaccacaaccttgtgagttcagtagaatttgtgttttcattttatctgtgaacaaatggaggcagagagtttgagtaatttacaagtaagtggcagatccgggggctgtgcctagacaatgtggctccagactccttgcccctccctgccttctgctgcatcttgattgagtctagccatctatttctttaacacacactaattgctgtctccatgttccaggccctgtgccagatgctagaaatacatccccatccactggatcttggcatggtccattgctcagtgtcctgctatgttacgtgttacataatgcatttattccggtatttagcccatggaaaataatgctgaaagacattgtatgcatgtttctacaacaaaactatgtaacttatgtttcttttattgctttggctatcaggaagctcttatccaaatcagagcaaatacattagaatttgggcttgtcatttcagtttgctgaacttttccttctggcccagattttctattttggttcataaattctattgcacaaatgtcctttattgtaaaacaccttaaattctttctaagggaaggctgcatggaaatgatacagtaaggtcttccctgcattttcttagattcctattagggaaggcagacctagatgtccctcttaccctcagtcccaaagccccccatttataaaatcccttaagcagtgactactgctgttctgagtacctggaggtagttcagagcttctgaaaggtaacatccatatacaaaaagaagttccttccgatccagatcccagctttggtgccagatgcacatttgaggagtaggtggctagtcagactctcacctgagcagttaataaaatctattgccccttaatggaattttttctgcargctcgaattgatctgtcatctttgtgatttgtgagatggcagggaagcaccaaacaccatcatgacttgggccacagtggggggaaaaaaggaaaaaagaaaaaaaaaatccactgccaagccttgccaggcgtagaaagggctggaactgctggggccattttatctgatttattggaaatagagtggatcttattaacattttaataaagagaatctttttgcactaggctggaagtggccgccagtcccccgtgcaattccattctctggaaaagtggaatcagctggcattgcccagcgtgatttgtgaggctgagccccaacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcctaggcaccccccacacacaggctcccactctggcgtgcgtgygtgtgtgtgtgtgtgtgtgtgtgtgtgtgtgtgtgtgtgtacgttcgttaacgggaggaggagagagctcccagtccttttttgctagcaggggcgacattctcgcccacatcaagtggggtaactttggttccctcctccggaggctcggtgcattggagaaagactcagttagaggcgactccaacgagccgcggttttccccagcccaacgcccagcggccgaagcgctgctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccccgccagggcgcaggccccagccccccgcacccctattgtccagccagctggagctccggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgcccwgcgctgctcaggggcctgtggtttcggagagcaccccgatccagtcccccatcgcctctctggcaggcgttgggacttggagtgagctggcagcctgcaagtgggtggataagagccagggcagggcagggccgggcagagtaaggagggaaagagacagggagtgcctcagggtgctaggaatgagtgttgagttcctggccggggtagaggctcaggtgagagtttgcgggtgaaaggcaggggaagggagttgggttcccaggtagggactgtctgggatggggagactggtgcagacttctaagggagaccactgttagagcaatgttgggtttagactttggaaatgggctaacatctcagaaatgcagtgatgggtgatagtaccaggggagattcaagtgcccggctgctgagcccgctcccaagctcctgacttctttcttggatatacagtcccgattaaggactgcccagttatagctccttttctaccaggcttttctggttgattatcttgkggtccctacagccttgagtcttgccatggatcccaagcctggctgtgaaccagttttccagatgtcctgtaccctagagaccccaaggctgtatgtgtgtacatataccccaatttagcaaggcggtttggagcatgcctcagacagaaaggattcagacagatccttcctgccatctgctagtggtaccaaccygggcaagttgtttaacctctttgagcttccaagttctccattgtaaaataatctgctgccttcctaggactgctgagtggataggattgcattcaacaggatgtcctatgcaatgcatgccagtctgggagctgtcggtgtctgagagcacttaccattgccttgtccaggacttcacagtcctctttctttcttggcaggtttcaacctcagttcatattccagggcttgcccaaagttatgcctcctttaaagcaagacagaccacgtgacagggccccaggatcgatttttatgcactaagggctctgcgcacggttctttttgcaaatgaactggtgtgtctcctcacccagggccaggctggcacaggtgggttctgaaggctcactctatttatttagatgaaggaagcagagattttgctgtgaattgaaatgattgccctgagaggcttatttctattttcaattgttatgcatatcagagcaaatgtccacattaggatagtaattgatatcctggtagcaatagtacctcacagagaaatcattttgatgcaatccagttaaccagcaagaagttcacgtgcagaactctgtgtgccatagaaaaaagtggggaaagtcttcgaggccttgagtcgacgagcaaaaacacaactttcctgaggcagagagaaaacagaagggaaaaacaatgtaataaaacaaattagtcactcggccctggtggtgttcaggcaagcctgtatgtttttttccaccacagttgtaaagcatcgggtctggctttggaagccatcaatctctgtaagcttattggcttggttgttgttttaggcattttggtaggaggtgaggaattctaagcaacaatgactggaagctggcaccgttgaacagtcacctctcctatcccctggggtgttttgggaaagtctgtcccagaagtggcttctggaatttgcctatgataagtaatgactgtgaaacaaatcaagaaagaaatgagcaagaaattccatggtaaatgtgattcccctccctatttgggtagcacttacaactaaccaaaagttctaacaatgagtgagtaatcccccaagaattaggaatttagggaggggttcaggcttggaggacagtcgcttgggagtgactgaaaatgttccatggaattctgagatttcgctataaagtggggagttctctctaggggtcagagtcttgattttcaggattttcaatgagaatcagtgtcttatagtgctcctgcaaatttgtgtgttatgttttaagagcagtgtttatttgcagaactttttggatgaggaaaaggacacagggttgaagagggtgctgccccctccccccctagggtcaatacatgacagcctgtaagatttccagagcactagggaaatggaatatgtagtgaaaggagtcagtgatagagttcacctgtctgaatatttttttttagcaagtcccaaaacaggtttaataaactgcaaagctgagtatgtaatctggaatttgtgtaattccacagtctatactaaaagccccaacagtcatcttagctgatcgctcctactctgcctccctcccttctccccttttctatctttagcccttgggttttccgttaagtaaaatctgtttacttccagaagtatcctctatgtgttatagtgaaattgcccaacaaaccaacatactcaataactgcattatctaaaagcatcagcacttggatgtgtaaactgagcctcaatctgaagttcaatgtttaggttaaagtgtagctaggttcttgaaaacatccttatttccttccaaaaatacaattgcttggggagtctagttaatttatatttagtggaatgtaggaaaaggacaaactatggatttaatttacacctgaatgacagtcatatcatctacgtagccaacagtgtttctgtgtgcgcgtctgagtgagtgtgtacatctctgcattttgatcttgtaatacctgttgaaaaatttctccagaagagggctccatccacagcattacaaaattctgaatctacagctcattttaaagaacttcaatgcagcaactccatcaaaacaaaactattctccttattccacattaattgccacaatcacccccaaatgagaaatcctgccatttttcactgtatttatttctgygtctctctctttcttgctttccttcttttgctctcttgctttctcgctagctttcttcttgctttctttcttttcccctattgtagttggttctgttctaattcattctttgactctgtatcccctctgagtattggagcagggaaaatttcaaagatgtttgtagacggtgcaatacgcaatgtgaggaagttctgaaatttcctggcatttgactttggttggacttgatttcattctttaggtagccaaaaggcaggaacagttctgcctgtggaaggagataaccttcccccttacataaccacccagaagggtgactcctgagctaggtccactcactttccatcactcattgaaaaggagaaggaaatatccccctgtcatccaattacaataatcagctggacagaatcaaaccaagtgaccagtggttttggcattgtttctatttagctgtcagccaggtacccatgcacctgtgagaatctgaccctcctgaaggatgctgccaatataattccccacagcccgcttcttctgcagccacctgggatcccaggcctggctcctcaggtatgaacaggctgcacagacaatgaatggctgggctgtaggakctcttgctcctgcagtaggcactcagcagtggccttattctagagttagggtggaaagtcatctttctctgctgagagaggcagcttgggggaaggcaggagaggagaagaaaggacatttctaacttgaagtgctgactgagccagggtctgtggaggtgaatgtgtcaccctctggcttagcaagttgaacctcgagacatctgcttggtggtaatggaactcatctatcccaaacctgcaactctggcttctgggcagaggttgccaagtagcagccacaggctaaatttagccatggatgcagtttgtttggctcaaatgttttgcaaattgtacattaataaaaaagaaatccaggtttctagcatttctgaaaaagtcaggtcaggcaaccctagatccacacttcaacatggccgtacttgacagggctgagtcactactgccctctttaggcaggacgtgcctccgtagcttgccataatcgtcaccactctctactacccagccttctgtgctcactaattttgcctgcttgcccctagggctttttgagtttggracctctgctttcacaaatgttgaggtttgatcaaattgatgcagtttatttctcagtgatggactatttggaaagggagggactggccttttctccttccctgtgattgaattccattgatgtgtgctttggaacagcatgaccaaggggactgcagcccctccctgagcacattactggcagtacttttggacaggcacccagagagacatagcacccagatcattgcttcaggtgtaagagtcatgcagagaagtgacacgctgcagctctgagtcagtacragccctggcacaccagtgtgttggtacaaaatgtcatcacgcaccagcagycaagggactctgaaaccctgggatcatatagaggcctgcataccctctctgtcagcagtcctcaaccattttggtaccagggaccggtttcgtggaagacaatttttccacggactagaattggggggatggttttgggatgattcaagcacattacatttattatgcatttaatttctgtattgttacattgtaatatataatgaaataattctacaactcactataatttagaattactgggagccctgagcttgtttttctgccactagatggtcccatctgggggtgatgggagacactgacagatcatcaggcattagactctcataaggagaaggcgacctagatcccatgcacgcacacagttcacacaggattccaactcctatgaaaatccagtgccacggctgatctgacaggaggcagagcccaggcggtaatgcgagtgctggggrgccattataaatacagatgaagcttttgcttgctcacgggccactcacctcctgctgtgtggcctgatttctaacaggccatggactggtactggcctgtggcctggaggttgggaacccctgctctacgtagtgttctaccaagagcatggctgtccttggagaacagtgacasctgrgcatcrtcattccatgagtgttgctccctcacggtatagwcataaccagaacgtcacaataacttactctacttagacttgccaaggcctccgggwacactgctctaatattcagcacctttgtaacttcaggataaagctgaatctgcagctctgtcacctactttttttctttgagacggagtcttgctttgtcacccaagccggagtgcggtggcgcgatgtcggctcactgcaacctccacctccagggtttaagcaattctgtgcctcagcctcccaagtagctgggattacaggtgcccgccaccaggcctggctaacttttttatttttagtagagacggggtttcactgtcttggccaggctggtcttgaactcctgacctcgtgatccacctgcctcggcctccccaagtgctgggataaacagacgtgagccactgcgcctggccaagtacccttatccataggacactgtcacatcctagcaccgtcctggagcttgtgtgawgtttttatatctgttttaacagttaacacccacggccgttctacatacagtgttaatgctacaattaatgctctctggctctgtaaatactagactaatctgtctgcctcatcccataccagcaggtgagcctcagatgattcttgttttccatagctacagaccccaaagatcagagtaaatataactccatatacacatatgaaaaaaagtgattgtttttcctctgccagttgccaacagaagtcaaattctagaaaactaacattaacaacaggcacgttttgacttgtcatgtctcatttcaaagacaccaatgagcatcacccratctgctgcagaggcacaaagaccctgtgtctcctagctgaacgcagcccgggctggggcggagggcagcagctgctcagccatcaacagccctgccacatgcctgggcagggcccggaaatgagctcagcctctggaggagcctggggaatggaaggaaggaatgtggcagcttccatccttgccttacggggccttcaggccaatgtctctttccctcaaggtgtcagggaaccgctttcttgtgttgtgtgctgcaggaagaaggtggtggctgcagacacctgaagcttgagcttctgtgattgtctccctgtggactgattgctgtagggcctgcggaaagttgctggacactgccagcggaaccgaggctgactcagactgcccggagtatccctcctcaactgccatcagccgtcgggcatctgggatcatctcactcaggggttgcaaattatggcccgtgagccaatttctccctgcagtctggttttataaatagttttattggattatagccacacctattcatttatgtaattgtttatggctgcttttgtgctataacaacagagttgagactgtctggcccctgaagctgaaagtatttactatttagtccctaaaagaaaaagtttcctgactctttatctaacttaaagttacagccaaagaggcttctgggcgtcttctcaaataagrggggcctgagaagttcagccgttggggacttttcctcctaggccccaagcacttgagcaacttgacttcagggagattcacctgagaccaaatggttccaataaatatctatgatctctatggaggatctactatgttccaagcaccacttgtgtgtkcaggatacagttgctcataaggcagactgagtctctgctctcctggggctcacagcttggcaggaaggatcaatagcaattaatgaataatttaagatggagacaactgtgatgagggaagaaagcccagctgtgtgaggtcatgccgttctaaatattttgcctaggtgttctttgtctttctcctccactagactataagctctgttgtggtccacattgtggcttgatttgttcatttctatactcccagggcttagaacagygcctggcacatagtactcagcaaacatgaatgaacaaatgaatgaatgaatataagaaagacatcagaggcagatgaaggatctgggcggcttccctgacaacctgatgcttcagcccaaatctggaggagcagtagggcttacagacaaagacacagtagagggtgtgggtggggaaaggcattccaggaagaaggcacagtctgggtgaagcctctattcaggggaaacaccacacagccaaggcagtgatgtgaagtgtggctgggaggtgccagagccaatggggccatgtcagccactgcaagaatattggtgtttttctcagagcaagtggcagccattgagggtactgagggaaaggtacagagtgatgtgatcagatttgcattctggctacaagtagcaaatgggttggagctgggtaagaatggaaaggaaaggccagtctagggctgagatcatgggaagctggattcaggaacgacggtgcagagatggggcaggtgattgaagtagactgatatggtttgggtctctgtccccacccaaatctcatgtcatattgtaatccctaatgttggaggtgaagcccagtgggaggtgattagatcagagggcggatttctccttgctttaatcgtgatagtgagttctcacaagacatggttatgtgaaagtgtatagcacttccccctttgcgccccctctctctcctgcttgctgtgtgaagacgtgcctccttcgccttccccttctgccacgattgtaagtttcctgaggcctttgcagccatacttcctctacagcatgcagaagcaagccaattagacctcctgtctttataaattacccagtcccaggcagttctttatagcaatgcaagaatggactaaatcctattcagataatccaagagacatttaggtggataacttgacaggctttgatggtggctgggtatggagatggcagggccagagagaggtgaaggaggcctgcttgagttctgactcttccaattggcaggaagagtcaaacaaggagaccaggtgtttgacattgtaaacagggtcggtctgagggcttctctatgtgggagtgtaattcaggctgcagaacgttcctgggagaggcacctaaggcctgcattacagtattgccagcagatccagtccatgcctgcatctaggatgggcaccgtgggggcctggaaatgcccttgaataaagtgaccgacgtgcagcctgtacaattaaccaatctctgagacttttcatgcacaagatatttgagagaaacattgccaagccctttaatcgtttcttgaacattcaatcagcagcactggaaatatgtcttacatgaagcaaataatgatcttctaccctcagcaatcgctttgccaatgctaacaagcctctgcttcagcatgttgggtgtagccttggtgacttctgtttgtggtgtagtaggagaatattcaactgggtgccaggcagtggtatattggtaaatgtttaacaactgggccactctaaagaaacacccaaaccagaaagcaaaacccaaaccaagayacaaccaagtaatttgtagctcttgccaatttctgtgatgtaaatactcccgtcatgggcaatttgaatctrccaacctgagagtttcctaaaaacttaacaaggggctcttgctacctgatactaactggctccagcacaccatggacctggatcctrtttctagctcaccccctcactcgtggtatgaccttcagcaagcagcttgaatgttttcatctgtaaaatggaccaggttacttggaggttcaagtgrgtaaaaagatgttagaatgcagggaagtccaatttgctgcaaagatgcatgcagattatctaaatcattatcacttacaaggaaacaggacctttggccaggatcctacagctgtctaattgggccctgtaaaaatactttgattcagccactgaatgaagtttgatgtgtgagaaacagagggtgtacctctgcttcctgcagttctgcatgtttttgcagtaagaaagattattgcgttctgtggcagtattgattccgaacgtgtctatcttgtttttctgctttcccttcttttcttccttttctcaacaaagatatttagtgagtgctgtatgccaggcactcacctaggtactttatcctcagaagctgaggtctgtacagttactgtgccttttttttttttttttttttgagacggagtctggctctgtcacccaggctggagggcagtggcgcgatctcggctcactgcaagctccgcctcccggrttcacgccgttctcctgcctcagcctcctgagtagctggggctacaggcgcccgccacagcgcccggctaattttttttttttttgtatttttagtagagacgggttttcaccgtgttagccaggatggtctcgatctmctgacctcgtgatccgccagcctcagcctcccaaagtgctgggattataggcgtgagccacagcgcccggcctatcgtgccctttcaacagatgaagaaactggtgagtttaaggaactgacccaagatcacagaataayaagtggtgagctgggatttgcacctgggtctgtgcgtgggcgagtccacctggggcccgtgtcttcastcagcgagtatttattgagcatttagggaattcagaggtaaacgagatgaactgaatccctgtctcatggagcttacagttttgtgggaacagcagataaaaacaagtaagtacttgaaataattacaaatgtggtaattgttacaataggaagcagtagaggctgaaatccattgaagggagaagaggctgctgtgccttcctttgctcctttgcttcctttcatctgccttgcctccctctttctgctgtctttctttctttcttcccttaaatgttacctaccaactatgaagaacgctgcaaacctgggaacccagaggtgaacacgacagtccaggccttcactaggaaatgtgctggagcagaattagagcctggggctggcctggacccagagctgctggtgccttggactgcttagggactgctgagcagacctcctagccctttagaagtgagcttgaatccctgcccagccatttacacactgtgttgcctcagataattgacttcatttccctccttttctgttttcccctgtattaaaacaactgaaaaggaatatctatgcttgccctgcaggatttttgtgagaattaaataagtgtatgttaatgatgtcatcctatgcttaagaaatgttggttgtattacttttcaccctatgctccaaggaattttatgktctgaaggtgtcatggggtcttggctttcaggatgtgactcacttaaggggggaaatgactgtgcatgtcataatgcgtggacattaaaaaaaataaagtttgctccccagggaggatttgccaattcccatattagtaggtcccccaagattgttcccctygggattcatgcctcataaaatcatttgatctggtgggatctcatcttcttaatgtgtctgcccatcatctgttcctgggaggctttattagggcagtgtgtgcgtgtgtgcgtktgtgtgcatgcacgcaccagtgccatgagtacttgtttaaagtacctccatgtaaccacaattcactgtagttgctatgcactagttacccatgttatctggaatccttcctgcaacccttagaggcgactcttattcccaattttatatacgatgagaagaagttttgagtggtggagtcatttgctcaaggccacacagtcactgagaactgggaccagggtttggacccatgcgtctttattcctgtgcatatttattttcctctatgttgcactagtatataaaagttgcctttcccactcccctcattatataaaaattctttcctttgtctattttgttctctacctcccttaaagtcaagatagctgcctgggatgactacttttttgagttcctagtctctcaaagtgggtctgggccctggacttcctgtctgggctactgattgcaaccttcagaacagggtcagcccrgggtcatttgtgttctttgtctccatgtccttgcttttgaccagggccaaacaacccacctgcactgcatggttcccccagcaagaacatcccagtgagaatggcccacagatgcctgggcgtgacycacctgcagcttcaaccatgcaggtaaatttgcctgctgctgkgtcgtgtggctggatggaattcttccctagggatgctaagaaaccctgttgcctaagtcagtgcttcctgcaagctactctttgtaattctttccccaaacaaaaagaaaacaagaaatatacagtctgtagctatatagagacacctggatctatattgtgtggcaattggattgaatgtaacttgaagtttatttttgtcttaccagactagtgttttttcctgttaatttaagtgctttagtgagggttgccattgattgagcaaacatgtgttgagtgcttattatgtacccagctccattttccgtactagccanagagcagcgagagcatggcctttgccctccaatcctgttctggtggacagacactctctcccttgacagggtcctcaccactgtgtgcaccgtcccgccacctggtggccgtgcctatctgtgcattccctatttggttaactcattcacttaacaaatatttactgggggaagacaatatctcaagcacaattctcagcattgagggaggcagcagtgattaagaaagacaagattgcctgcccccgtggagtttgtgttctsatagcagagaaagacaggaaacaagaaaaataaataaatatggtagttttgcgtagtgatagtgctatagaaaaacgttcaaatggggtagagtgatagacagtgttgttctgagcttgtccaccacnccctcttgggacagaggattctttgttctgatggaatggcctttctatagcatagagatgaaatgtgctaccgtttgtgaaaggaagttagtaatacatacatggcatttttgtcttcactgataaagtgttgttggtcaacttttgtcaactctctactttttgtttgtgttgaaattttactgttgggaatttacgaatatggcaactaatgatttaaaccaggggtaggtatcctttttctgtaatgagscatctagtaaatagctggtttctcttgaaactgttcaattctatccgtgtagcattaaagcagccacagccgatatgtaaatgaatgggcagggtaataaaatgttatttacaaacacaagcagagctagattggtccttcaggctgccatttgccaaccactaatctaaaccagtagctgccttaccagttggtcaaacttgtttaagacagggatagggcagaggccagcgaggggaaccaggcattctctttggcctcagttgccatgaaaatcatggtacttctttagggtcacatatcactagattatttgcattaacttttatcaaggtaaagatgctaatagtcaactatggaacataattctcagastagatctaacataggaataatttagctttgtaatatttatctggactacaatttttaaggcacttttgctacccaaaagtatcttggggttaaacacgctcttggattgaattcctctaaataaatagagacacagaattgggttcagggggttaagttggtaaatgatctcaaggtccataagtgagcgagtggggagagtgagaccaagaagaaggaaagccagcaagccaacagtgaatgtgtcattgaggtggtcacagtcatgggaaactggcttcttgctgctgggtctctacaaaagcactgtgtaaagctcatttccgaatggtccctccacagaataggtggctgagggtgtattcactcgcccttatcttctgctggtcaggggtgacccctgccgtcattaacttctctgtgcttccctgctgagcctttgctgtcatggggagcagtcatgactttggaagcatcatagcagaaaaaatggaaaggtatggcaagttgttggactgtcaggatatgccctgggtagggtatgaatatatgtgatttctcttgccaccattacatgttactggaaacttcctcagtagagctaatggtaacagaaagaattatggtagtggtaatttttaaaaccttctgaatttggttaagcaccctcctgcagatattctctttcccactagatggtaccagtrtgccaaagccctagaatgctaccttagggcctcgtctttgacatgtgatatattctcattacttttcaacaatgaatgaataagccagttgaggtcaaaggaatcaactatggatgttttagggacaggagatgggagaaaagtggaggctgtctaaacagttaccctcattcacgcattcagtcatttatcaacaaatattattcagcactgactgagtgctcaacacttttctaggcactgggaatacagaaatgagtaagacaggccaagtccctgctctggtgagcttatgtactggctgggagagagmcaataaaaaaatgaacaggtaggtatgtgatgtctgcaggagggtgatgagtgccatgaagaatgagaaagcaggcgagggggtagatagcgacaggcagaggtcatggcgcttgccttcgctgttggctgtagggtgagagattattttcatctgcttcccaaacccagttcttccattcaccaactccttatgacacccctatgcggtttatttttgaaatgaaactaacagctcatggagggcaaaaaaaaaaaaaaaaaaaaagtggtgcttggcaaatgtgtgttcactagtcggggcccactgcagcctaacacctaactcattggactgcttgttggctgatttaatttgtctggaatatttctgaattactattgttgttgacacacaatagagttgcatttaactcagaggttagactataaggtcagggttttaggcaaacacagttgtcattagccttgaactcttttaagttgcccattaaagtacagtaggcgtggtttagtctatgcatccccgtattgtaatcaatagggaacaatgtataatgcacgcagtaatgtacagggcataataaagaatatatgcaagatataattttatagcatttaattgcagtatttacattgktctttttctctctctctttggtgggagagctggctttccattagttaaatgtrcatatgatgagacttgactatattcatttaagccacattcctaatcatacaatctccaccagactgtgcattacgtaaggcaagacctgttttctctgttgtgttctgtttatctttggattcccactaccagtcagatgctttggggtgggggaattgaggaataataatagtagaagtggcagtaatagtagctgatatcagtgtggtgctgattttgaaccaggcctggtgtgagtgcttcagatgcattaatcagcacatgtaatcctcatagtgactctataaaatatcttctatggttttaatcccatttcataggtggggaaacttcaggagaacttagtaaaagaacctaataaagctttaggactctagggctgagattcaaactcaagacaattccagacacacaagaccacatgttgtatgattctatgaaatggaacaaactgtccagaaaagtcaaatccagagacagaaagcagattagaagatgtctagggctgggggcaggaggaaatggggagttactgctaatgggtatagaattgctttggggaagatgtaaatgctctggagctagatagtggtggtgattacgttagctctctgtaaataaaccccaaacctgggaatcatatatcttaaccggctaagcttyatagtatgttacacatgtctaaataaaactggtattgaataggaaaacaagcaaaccttgggcaggtcagcctcagggctcctgtttgttcatgagcacacaccacctgtcttacagttgttcaccacctgctggtgatactctacttgctttacttatattaacactgcgactcctcaaaagatccccattgtccaccctactgagatcagaaagcggaagcagaacgatgttgagaaacttggggctggcaagtggtagtttcaggattaagacccaggctgtttgggtctaattccttctggctacactggttcttacatgtgtttcattcattaaaagcaacctgtgttatttggaactgcaggtcaccttggcctattggaaataaagcaagggttcttcacgtttgttttgctgatttgtaaagtgaattaagaaccatcttttgcctcactggttattattctcatagtascctaccctggtgtagagttctggctgcaaagctctcagagactgaagaaaaggagatggtttagtgttactgactttttttaagacagggtctttctctgttgcccaggctggattgcagtggtgcaatcatagctaactgcagccttgaccacctgagctcaagcaaccctcttgcctcagttctggaaatagctaagtgggactacaggtgtggaccaccaggcccagttaattaaaaaaaaaaaaaamytttaagacaaggtcttgttatgttgcccatgctggtctcgaactcctggcttcaagtgatcctccaggagtagctggcattacaggcttggctgacttttaaaagtagtaagtggtttaggatggggggtggtatggaggtcgggtggggagaaagaggagagaaatctaattgatatgctaattgtcattgtactcaagttgatagcagattgctgaaggatttaggatttacccaaattaacatgaatgtttggcaccctttggctggtgcggctgaagaattcaatagcctagtaatgagaagtcaatctaaggtctaaggctgggaaaggagctcccacttcttacattsagtgctcatcactctgcaaatcaaggccccccgaactcctcccacccctgccttctgcrtctccctctgtgcyctccatcacccccctacggagttcctttgattctcaggtcccttaaccatggaacgtactcctgtctgccctcactcgtgggttgatgatttctatcctttgtcatgttgaaaatgctgagtgacaaagccattagccatgcacagtgaaacaaggaaagcagcctagagctggtccccagaccaggcccagtgcacgagtttgggtgctggaaggggagsctttatggaggcaaagctgaggggctgtacgtgtcttcayaggtctccagtctgtaaaagcaaccacgctttgggctggggcagaagtcaggacttgaactggctctggctgggacccaggctcccaggtagccagctcccaggtgacaggagtccgctgggctccctctgattcttaaagccttyccaggtagcaacaggagatcacgcaaagccacgtaagtgtctgattcagtcctccctggtcagttttccagcawagcgttttgcaaaatgtgttctgaagagatactggttccatgggaggttaatatgggttctggggaaaaaaaattaggggaatcaaaaaattacttgtataaactaatattttggaaaactctggagttagagaagtggaccagattgggttttgttttttcacaaatgaaagtctctgagattgtagtgtgtttcagtttcagagggctcttcccaaacccctgaggttaaggaaactcttgtacacagtgggtctcgggcactaactcacagatcacacttctgaaaacaagctsctaggatgccatatctcagagtacgggcttcgacggggcccttcacmcagctccaggaccaactgggagcctgttaggactgcaaatcctgtcctctggacctagagaatgaaagcctctgggggcaggctcagaaatctgtgtttccagattccaytgggttttcaactccatccagaataattcttctggtgtcactgtgaatatttgctgatccttctgacgtctatccgtggtgcttgtttctgaagtgtagtctaaaccgttggctctcaactgttggggtgaggggggttgtgaccctcgggacagtttgcaatatctacagacatgcttgtttttcacaacctggggaggggagtgggcatctagtgggcagagctcagggatgctgttcaacatcctacaatgaacagcacagctcccaccacaaaaggttatcctgacccaaatacagtagtgctgaggtggaaaactctgatccaaatgcatagcttcatactcacccagcacacacagggatttttatccttatcttatcctgttattactaggaggctggaatctgaagctggggctgtgaaaagatacctcacagcaagccgctattcatgtataatttttcaaaaggtaaaaccaagactcttgggtaaatacgcacttcaactcattaatttatgaagaaaccagtaagatgccatggttattccaaagggcatttaagaagctaaggtattygtaaggaatttagcaaagaaatgtgaagacgagattgctgagttagataaaaagtggttaatgttcatcatgcctaaacttttggggsttatctgttctattagataaaaagtatttgcatctctactggacaaaagttgaccacttaagtggtgacttcacaaagtctgggatcttcaagagyaaacaatgagatgaactaagagcatgctcctaaacaacttcaggttgtccctgactgataaccaaaggaygtgccatcaaccatttgggccttgtttgcaagctttgaataatttttctggtgctttaaacacattattgttagtattttgagayggagtctcgctctttcacccaggctgaagtgcagtggcgtgatctcggctcactgcaacctccatctccagagttcaagcrattctcgtgcctcagyctcccaagtagccaggattgcaggtrcctgccatcaggcccagctaatttttttttgtatttttcattgagatggggtttgaccatgttggccaggctgatttcaaactcctgacctcaagtgatctgctcgcctcgacctcccaaagtgctaggattacagacatgagtcaccgcgccyggcctaagcacatgacttttaatttactggtgctgcatggtctgtgaaaagtgggtcaaagaaatgggaagtgatgggaggagaggtcacaggaggccaaggttgtaatatggttagaagccatttcttacctgtcttctatgaagtgtgggttgtgagcgatgctttcattcaamcctatgaggtgcatcttgtcatcatccccatctacaratgagaaaactgagtcagaggaagagttaggtatgtcagtagcaggcatgggcaaaggaaggagaaagyaatgatcaagatgayagagggagaattgcaattaagccagagagaggaaggatgatgttataagctcgagggaagcctgagtccagatctgaagcagatatactcacagcacgttcagggggtaatgaagaggctgttatgggtgactatgaatgtgaaggcaacgtgagattggatcagagttagaaagatgacagttgttaatagcatcagtgttattttagccaaaggactttactattgctgtagtgcagtgcctcgcagtacaccatgacagttaagagcccaggcctcgagggaaggttacagtttgaagcccagctctgccactgtagggctgtgtgaccatgggcaagttgcttaacctctgtgcctcagttaccagatctatgaaatgtcggcagtgaaacctagctgatatgactgggatggggattccagagaaccttgtaaacacttggtccagcaaataatatggcctcagaaaatagaagctggatgtgtttaygtacatgaggaaatggacagataggacttaacagaccatggttgtgagtgacttggctgtaagtgtcacagtctcagtttgagtttcctcaaaagcggatgctgtgaggaggatttgagtgcaataaattctcttgggaggtggtccaaggggaagtgtagaggagtgggaaagtgaggcaaggaaggaaaaggaaacagacgaggggtctgttactcaggcaggtactgctytgggtgtctggagcttaactcccctgggaacctttgagartcagtgtggaatacctgcttccaagccatcccacctgaggggcatgggagctccagattttatgccacaaatctggttggcattgattcaaagctgccccagggggcactgattttgagactactggactactccagcctcagagaaagcagtcagtgaagaggtgtagatatttgcagttggaagttgagccagccctgtaatggaaaagccagaagagacaggagcttggggttgggtggtgagctgtctgtcagtgtctaatgtggtaagtatctgatatggtttggctgtgtccctgcccaaatctcatcttgaattatagctcccatagtccccatgtgtcatgggagggaccctgtcgggggtaactgaagcttaggggcaggttttccctgtgccgttttcatggtagtgaataagtctcacgagatctgagggtttcataaggggcagttcccctgcacaygctctcttgcctgctgccatgtgagacatgcctttactcctccttcgtcttccactgtgattgtgaggcctcctcagccatgtggaactgtgtgtccattaaaactctttttctttataaattacccagtcttgggtatttcatcatagcagtttgaaaatggactaatacagtatccaaaggcataaaaatagtcatgcactttggggaagtaatayacatctgagaagttaaacagaggtaaatacaggaaaataygtacaaaatacattatattaaatgatatatgaatattgtatatgttttatgcattgtatgtgaaatagtaataatagccaacgcttaggaagtagttgccacaygcctgactctcctaaatgctctgcaaataggytagatttccagmaaatgaaaacaggttaggcagctcaatagaatattacataaycattaaagaggatggttataaagatgatgataatggcatggaaaaatcatatgaatgagaattgaatactaaacaggagattgtgtgtgcagtaggattcctacaaagcaaaacaagcctctaaataaagaaaaagaagggtggaatctgaaaggaatttatcaaaatcctaactgcaattttgttcatgcrttgggattcagagttgttttttcccctctggtttacaagtctccattgatacacttgcgttacatctataatgaaaaatacaagaaacttgaaaaagtacaagaagaaaaaaccttctaaaaaataggtggtaagacccagtgaaagttttaaagaagggaataacataatggaaaatrtatttcagaaaaattaatctgggggcagtgtggaagatggaytgaatcaggaaacacccaaggtgagaagtccagcttgaaagcttgtatgagttactgggagtatggaaaagaaagagccaattttagatgsttgatcatgaatgagatgatggrgaagaaagagaaaagtgccagaaatgattccaacattttaaascattttgaatggaagaaaataagcaatggaactaatataaatatagttagagagtgagcgcgcaccggctttctttacatttgttgcttgtttaaacctaacagcaatcctatatgctatgcttttaatattcctattttacaaatgacataatagaagattagagaaataaagccacttatccaaggtcacacagggtccaaactcagattattgtgaaatgaactggctagatagaaggatrgatgatggatggaaggatgaatgcatagatggaggatggatggatggatgatggatggatacattgataactatatgaaggggaaggaatctggtgaattgtaatgttatagtggaaaatagggcatttcaagaaggaagtggcagatagtcttaggcagtgaagaaggaagggaacagagaaagcactagattcaacaaaaagaaccagtcactggtcctctttgagaaggtccttccagttaaataatggaaagtgggcttaagcagcatgggggactgaagggccaggacatgttggggaacctgtgaaatggctagtcagagcatggcatgtatgagcttaaaaccagatctgaacctaaggaagagatccaacaataggaaggagaggggatgtaagagagaaaaatgatggggaagggagaggagggtaagaagacatggaaaaatggaaaggaaagaaattactggttaagaacaaggacaccagactgcctgggtttgagtctcaactccgctgccctgtaaccttgagcaaaccccataactgtctctgcttccgacccctcatctgttgaatgggaaaagagtaataagcyctatatcctggggttcytgagaggaggaattgaagcatgtaacatgcttaagacagtgcccggtgtgctgtaagttgaaactgtgtagggatcctgttgccttagtcatcacaacaaggaccatttcctgggcaacaacccaaagctatagattaagaaactgaggctcagtcacttaaagaatgttctctgagaaagtacacttggagcctcaacattgctctacctgcaagtagttacctctcctgtcttccagggagaaatagattttgtgtaaaataggatgcatggctttgttagtggaaactaaccttcagcaattgtaataaatgaggtacgtgaggttgcatttttttctcctttttgaaaaaagagttaataaacagaggctgttcaataaagcagagttagaaggagtttaggaagcactggagagtggctgaggagcaaggtagtgaggacttggaggacctggagaaggcagatgagatccatcagatcccagaaagctccatcaactcagtgccctttctctattccagaaagtcttatgctcatatcattgatgcttggagaagcctgcacaccacagacttggcatgagaagtcctaaaagcctcattaacccaaccacttaggctttctgagtgcaacccctaccctattctatttgggctcagggtttgctgggccccaaaatgtcccgctgttgggatgaggagattcagttaatacctttctttggttggctctcctcccacatccccctacctctctagccttggtttccagaaaactgtatctgtgctcagcctgctccctcctgcccttggtgatcatgaaacctgccaaagaagcattctctctgaggctgagccactggagaagttgcacatccaggattgattttgcatagtgtagaaatcaatcyggtgaacctggcagcataggtatcctctaagtttggttgtmagcccagtggggcagggcagtaaayagtttaaattggaaagttaaaacaataaacaggagagacaggtgaagttggggtttgaaatttgctgggctagaatgggttttctctttctgtgttaatcttatctggcagctaatctttacctgtcatgtggtttttgggggagaaaacggtaccctctttagactgcttcyttttctgggaggagaaccctgagaaagactatcagtttgaagttgtccctcctgggatagaaatttatctaattttagtgggtggcaagactatgaacaaccatcattatctgtgctccaataattattaatttaatgacattttaacaaataagaaataacttttattgagcactgtctacatatcaggcacccagctaagtrctttcacatgtgatgtctaattaaagcttctgaatatgattaacttcattttatagctgaggagtctacagcctatagggcacacacacatataccatcttcattgatcttcacccaaccatcagaagcctgggaaagacattttgcagttaagaaaagtgaatctcagggacttgtcttcttcagcaaacaattggcagaaccacggtttgaatccaggtcttctgactccatattactttgattttattgggagagtatatgggtggcgtatcttcttaaattcctctggccaggtcctgagaaaagcatttactgtgcattgtctcaacacttgtaataaccctattagggaggtggtgtttttccactttacagtgaggagactgaggcttagagagggtaggtacgccattggaacaaagccactcaggcagttgtaggaagtacagctggggcttataccttcccattctaccctccaggttttccctgctataagcatttcttacagcagtgccttcaataggagaaacaatgacaagtgatttttccagtgggacagcaagaaggtgattgtggtcttggaccttgggatttaggacgggctattgacattaacagttggataggctgctaggtcagtccagggaaaagcaggagggaagataagacatgactgagaattcaggaagggccagcrccatccaatcagaacaagttggagcttttcgtcttctttaagcctactagtttcacttctcattttgaaagaaacaacttgctcggccaacctattgttgctgcctttctctgcctaccacagctatgaaagcaaagttattggaacatgtgaacgtcactagcatccgaggcaagatttaggttctgaaaagaggtcatcagattgtagagttggatctccatttccctggagagtcttgtgcttcagaaaatcattattggtttgtcatcctagcctgtcatggtggaacccctgggctctgaaagattacaggaaaatagctggtccttggcagttctcagaaggttctgtttctcacctgggccaggattgtgcctgtggtttttgttcatgacaagatgagaagagcttggttaaataaggaacgacctctcgttatatatcttctatcctgattgattgcatcagaaaagccattcatctggtttgaagatagacaggtggttgctgtcactgcaccagcagcttttgaagtttgctcrgtgatatgattacagcccatacttaagcttctgctccaggaagtgagattgacctttgatcctactcctcatttaaaaattacagatcttggaaaatgaaccaatctagaaagatattggaagctgctgctgctgctgctgctgctgctgctgaggttggctgtcaaaccaacttaactggcctgcattacctagaattgtttttttttttttttttctggttaaaaccaatgacctttaaagcctttttatttttcctctgacaatctctagtggacctmtggtcttttgtgagttctgatgggaatcccagaatctttctgtaactgtgggttccaatgagagaggcacatttaacaaagaccagaagaaaatcaaaactgttgctcaaactgacagtgtatgttcttcatcccactccttcattagctcattcattcattgattcrttcattcatgtgctggctctttgtagaagttgggggtaaacaggcgaccaaaaggtagtccgtgaccccaggatgttgtaattcagaagggtaaacagacaaggcagtcaacattgtccattcagtgtgaatgagcttgggagtacaaccactttggaaacccattttgttaatttacctttgatagatacttattgaacggtttttccaagygtctgtgaagaagacatggtggtggtagggggtgggtggatggtttctgaggacctgataatgtttctccttgattttagtgccagttacgtggcaactcatggaaaacattgagctgaatacttgggcttttgcacctttttgtagtgccttagtgtattttacacaaaaaaataaataaaagtatgctcagcctcaggtgygttggaaatacagaggagagaccagcccaactttggaggagaacagagagagggacccaggaaggccttctggggaatatatttgacttgggccctgaaggagcaacagaaattaggcactgagtaaaatgggactggatgtacctgcacaaagccagcagcagaagaaaagacatggagtggagggagctggcagttcatgcttgggggaagctgagagttgcttgtggggctggaggccaaggtgcagggctgcaggggtaggagggagcagccagggagggggtggattggttaagaaacacgatgtgcatgtcatgttgagaaacttggatttcaccctggaggcgcaggaactaggggggatttttcagcagcagtgacagacgctctyaaatctgggttttccwatgatcagcatgcttgtgcctgcaccggggcgcaggatgggagacagatgccttttgcagtagttccggagaagaagactgaagaccacattcaaggccctgagagagaagagaaggggacagataccacagagatcatgagatatagcacaacagataagacttgctaattaactgtacggggttrcrgggagggacagggagaaatcaggtttcttccagcccagcttctggttggaatcactcaggcagagacacatgggcctgagagaggattccccttatgacataaagcckcaaaaattctcattagtcattgcaaaaacatctatttccggcctacactgcaccagccagtgggggaggtcctgagagatagagaaaggatgaattcttgcccttagagagtcrcctagagattctggggagacagcaggtccgagtctctctgcctgaaacctctggacagtgtctttggctgacacttacatggtggtcttggtttcttattcaaggtcggtttcccaactctcatagcatcagctttagggcatccccaaatctcttgcagaagagatggttctttccccttgagttgttttgagccaagcatataacattgtgtgaatgtttgaaaacttctcttggttctcagaatgcaattctgacagtgctgaaggctgccaattaaatgaagatttagataaaggctgtgtgggaggtggaatgcaatattcttaaacctaataatggcttccttctgtctttttgaagctctcaaataatcctgattgactgactctctgctttgggcattcccattttctggacaatttaataccatttaaaatgtttgacaacttttatttgggggcagacatccttaggggatggggccgtgggcaaagatacaaatgctgtaccatcaaaggaaccatggatttaaataaggatttttttttttttcatattcagaagaggtgggtacagaaaggatgagggcagcttctcaggttatagtattaaccacgtgaagcagctaacaaaggtrtgtgcctggccttgtgctaaaggctttcctcgtatcagttctttcatccctcccaacactactgaggtagatggagtgactagatccattatacaggcaaagtagctgaggcccacagccatagcaaataaactgtggagctggtggtcccagatttcatgcttttagtcattctcttggctctggggtacaggtaagcttccagaactggaggatggagtccaaaagaaactcaagataatttccctgcctttcccattgtatcaggggattcatctgttcatacattcattcattttcccaacacatttactgaatgcccgcaagcaccaggaaaatagcaatgggcacaaccaggttcctatcttcatggagctattgctttattggcagaggcaaacagtaaagaaaattcattagtaatcagtgttgcaatcaatgagccggtcaatcaagcaccataaaagggtaaagtgtgacgaaggtgctccttgtgataggggttgggggtgaggggaggtgtcctggagaggagacatttcaactgagatctctctgaagtagatgagatggccatgtggatctcaaaaggaaagtgtatgccaggaagagcaaaaagcaagtgcaaagtcctaaagcaggaaatagtgaggctaccgcagtgtcgggtccaagagtaggagatgagatcagggaggcagattaggctgcagggagggtgtgcgtgtgatgctgagagtgatgggaaaccactggtggggttgggggagggcaaggcagtgacatcatttgtttttatgtgcagcagaggaagccaaagcaattcagaagaagcctacagaagcttacctcctccacaggctatttttttcttgtttacatttgttaattttacatatatattaactcagtcctcacaaccaccaaatgaaataggcattgcccttattatcattctttcccattttaacaatggggaaactgaagcttagagtaggcaaggtcgcccagataggaagcaatgccttcgggtcatggctcactactcaagtgcctgaaatttcagctagcctttagtgggcacctgctatgtgccaggatctgtatgaggtttggcaccacctagacagccccttgaaccagtggcatgtctcaggacagtgtgagagacagaaacttcagctgagagttaccgtgcaaggcagaaaatgctggtctagcaaaaggaactctgatttcgatttggaagtacagagaawgagcatctgccttggacagagttatcagtgaaaagatgacatatgagctgagactgaaaatcatgttgaagatagtcaaacaaaagctggcagtgtgggagtgggggcttcaagcagagaatcagtggttcaaaggcacagggtagaaggagaatggcagctggctcagtgtggctggagaaagaggctggagtgcacctggttgcatttgaatggtgtgcgtgtgtgtgtgtgtgtgtgtgtgttaatgatggtgatgagatgaggggctagagaggaagacaggttggcacctggtagcattttttaaaaagcaagtaaaccttattttttagagcaggtttaagttcacagcaaaatttggtggaaggtacagaagtttcccaagtacctcctatccccacaaatgcacagccttgtcccactatcaacatcccacatcagaatggtacatttgttacagtcaatgactctacattgacacatcattatcactcaaagttcacagtttacatgagggttcactcttggtgctgtacggtgtatggtggatacatgacaaatgtgtaaattcatgtatccaccattatgatatcacacagaatagttgtacagccctaaaatacttgctctgcctatttgcctacccactcccttctccctaacccctggcaatccaccgatctttcttctatttccatagctttgcctttcccagaatgtcatatggttggaataatatagtatgtagccttttcaaattagcttccttcacttggtaacatgcattgaagtttcctccatgttttcttatggtttggtagctcttttttttttttttttttagcattgaataatatttcattgtctggatgtatcacagtttatccattgacctacttaaggatatcttggttgcttctaagttttggtgattacaaataaagctgctataaacatttgtgtttcctcatatagatcttgtatatatacagtagttccccagttttcatggggaataagttcccagacacccaatggatgcctgaaactatggattgtaccaagccctacatacattatgtttttttcctgtacatacctgtgataaagtttaatttataaatgaggcacagtaagagatgaacaacaattgctccataaaatggaacaattatgacaatatgttgtaataaaagttacatgcatgtgggctgtctctctcaaaatctgttgtagcgcactcacccttctcttttaatctgtcagtctgataaccaagatggttactgagtgactaatggatgatgggtaagatagacaggatggatacactgaagaaaatgataattcacattcccggcaggatggagtgggatgacagaagatttcatcatgcaactcagaacagcatgtaatttaaaacttatgaattatttttggaatttttctatttaatattttcagactgtgattgaccacagttgagtaaaactgtagaaagcaaaccttggagaaagagagactactgtattttgtacatttcatgtacacagtttgctagatttatatgtaaatattccaatttggggagggtaatgtaaattgtattgtgttttaaattcctgatttcattcattcattgctggtacataggaaagtgattggcttttttacattaacctcgtatcttgtaatcttggcataattacttattcttggagtttgtcaatttttttggatttcttacatagataatcattttatctgcaaactaagttttgtttcttactttccaatcactatacctttgttttcttttcttatcttactgcattagctaggacttccaggacgatgttgaaaarcaatggtaagagggcacatccttgccttgctactgatcttatcaggaaagctagtttcctaccatgaagtgtgatgttagttgyaggctttttgtagttgttctttattaagttgaagaagtttctgtctgttactagtttgttgagagttattatgagtattgattttgccaagtgctttttctgcatctattgatatgtgcatgtgatatctattgatatgtgcatatgagcctcctggtcatcatcccaggcttagctcacaaaagttgtgagcagggaggccaccaggaatgtggggcaggtattatgcttcccattttacagaaagtaatgccagaagaaaacagtgcacagttactgctggttcccaatagttgatttgactcctttaaagatttagctgtccsatttatgtgctggataacatcaattgattcttaaatgttcaacaagccttgcatacctgtgataaatcccatcatggttacattttaatatacttacttttcttcatacctgtctcaagagagaaagtagctcagtggttaagactggagtcaggctgcctgggtataaattgcacctccrttgcttattagctgtatgaacttgggcaagatatttaatctctctgtgcctcagttttcacatctgtaaaattatgtcamatagtactgatctccaagggtggttgcgtgggttaaattatacctaaagaacttagcaccccactcagcacatggtggctgccatgatggtttgccgtgacctctcttcatttgaatgtgtgcccagtgtcttgtttctctctgtattctcagtgcctggtacaaagtcgatagattttaaaagcccatagaagaaaacatacatttttccctgtttgtgggtatgtatggaagattctgtaactttgactagacacttgatattcagataaaatagccctaaagaaggttctcaagggggtggattttctcagactattgtgagcatagttcctaaagctgactctatgtcttgtgctgactctaatcccctcctggccatcatcccaggcttagctcacaaaagctgtgagcagggaggccaccagggatgtggggcaggtaatatgcttcccattatacagaaagtaatgccagaagaaaacagtgcacagttgctgctggttcccaatagttgatttgactcctttaaagatttagcacctgagttagaatccggatggcagaacttctctmytggaacctagtcccactattcctctctcccttcattcaacactgggtttagaatgcttgccagcagcattgtggaaattacctcaaaggtagaaacacgtaactcataagcacacaygaataggtataggtcataatcctggaaagacggccttgccattgagaggggaatagcaggagcaaggctacggaagcacgggactctggttgagtctaggcactgtctgcatgtacttggcacattccttaaaaatggcagcaagcagtccattctcaaatggaaattggwacaaaaaataacgtaaaaccataaataacagaaaagaatatatactcaaacatgtataatccatatgcatgaacataactcccctattgggaatttctcataaagaatccccccaaaatataataccaygtccacaagaaccmacccacaggccaggtactgtgcgaggcactggaatacaatgggggtaacatggactaggagactcatgaaaacgtcatgacaamcacctgggaaattctgaacgttaaatagtagggaagggtttctccaccatggcatggtggccactttgggcaggaagattgtggtgaggctatcctgtgcatggcaggatgtccagaagcatccctggcctctacccactagaggccattggaagccccatcctcactgtgaaatccaaaaatgtctccagacattgtcaagtgtctcctggagggaaaggggggaaagtgactccccattgagaaccactgctttaggggaatacttaagaagttgaggcatatctgctcactggaaaatggaaatgagctaatttggaggcttaaaacagcagcactgggaaaatgacataaattttaaaaagcagaaagtaatactgcatttattctgtggtttggctgaggttttgggtttcagrggaagctgctgagaaaagagagggagggaaaatgtgacccagaaatcacgggaaccagggaatctcaacaaattgagtatcttggtttgtgtaagattaggaacctggagataaatatgggtcaggcagatgcaagtaaaatgatcacacgtggggagcatggaaattgggtcttaaaagtgagttaagtcaagggtggtatttaaaatatgtcatatgtaaatatgacagagaaaccaccaatcaaaacagccatctgctgaaaccacccactatgggcgttcctgtgcctgccggggcgtgcggggaaacccaagagggagcaccagttggtgaacgtcagtcaatccacaaaccatctaacagaggcacagggattaaattcagagcaagacctggcaaaacagaaacagcccgaggccagagatgaagtgaaagaaagatgacaacctagggcccaggagggaagcttccagaaggttgagttatatttaagccctttcactgtatacctgggaccaaagaccctagagcagcttcagacataaattatgtatatacatgaacaaagacagaaagggagcaaagaaaaatgaaaacagcttgatttgtagggctttcagcatggcgggtggttttctttcccccctcgttttatttagacgtctgctgctgctgcttcaattttgttccggcaatacaagtaaaatatatgtggatgttaacaaagatgtaaagagccttttgaagtatataactgattataatttaacattcattaagtttcttttwtcaaaaaaaaaaaactattaagttcattgaagaagtcataaaaacaaaccaaacacccaccaccytctcccctcctggggacatggcagtggccacttcaaagtgggtcaggtctccgtgaaggaaaggggctcttgagagagtgatggtggcccaggggccggtgtgatgtttcatgctggagggatacagctgtccgtttcctttgcctcttttcatcctgatggagcaaacggctcattgtttacgctgacctagtgaggttggcttcaagctctcccctcaccatgttgtaatgagatagtcctgaggacacacgctctgtccattgaaacagattagctctgatcacagcttaattatgtgaagtacagccaaaccctatttatgcttttcctagggatggggtggaacagataggaacgggtaattgacagacattaagaaatagacttaaatattgyttgtcctgctttagtacgcacgatattaatgagatgttattgtgagtgctgagtaaagaggttgctgccggctggttctcatgccaggcagccagcagaccttcttcccaagcagggaattagcgcaggtgttcccttggtgaaagcctggctatcagcatcaacaccttctagaagatccgtgcctcttggtttatttcagggagcctgtgcaactccaaaaggatggatgctggatgcatatggaggttccatgccttaaggctagcttacaaatgtatgaactcgtctgtcttttattccatcagaaatgaatgtacattgtaggaaccagacttagcagagaacacggagtattgggggaaacctcaattagggaataaagagctagtacacacacagatgtgtgtcacatcagactatgtaatggacacaatttaggaacaactaaggtatgtcctgtaattaggggacttgttaaatctgcactgtctaatatagtagccactagttacatgtgactgtttacatttcatttaatcaaattaaagaaaattgaaaattcagtgtcttgatcacaggagaggaattttaagggytcctttgtcacaggcggctagtggttctcatgtgcagatgtaggacatccccgccatcacagagggatttgctggacaccactgagtcaaataaatggtagtatgyccatagaatggagtattctccatattctcaatgaagtaaatgcagatattctggcatagaaaggtcacccttgtgtattgccaggtaaacaagttacaaaactttatgatattaatttcacttaaaaaacagatgcaacacacaggcacatactttttggataagagtgcaaaaaacacagaaaggatgcacaccaaattgtcggcattagttaccttgaggaggcgggggtagatgtttactttttattttcttcacatgtgtattgtctgaacatatttcaatgagcatgtgttactgttgtaattaaaaagagatttatgtgatgaaaactgatgaaaatgattgagaaacatgaacagagggttttctctttgcctctttagagactggttaatggtgctacctgagtgagattgaccagatggmttgttgggagaagaagggagctggtttggagtaaatccatscccaccactatcaggtcttgcccaggcataccctgcttttcctgaatgtcctgaatgttgttgtaggacaacaaatgcrctttataattattcataggacctctcactrctaatctttgagtcgataacagcttctgctatagaagggggcagatcactgggcttaaatgtcaaatagcgcctgagaggcttaaacaaccaccagtatgtgtccctytgggagggcttctctgccatttagaagatcaatgagaagatgtcctccaggccagtgtgaggtggtagaggtgtgtgcttgcgtgggcatgcctgtgtgtctggtacccttacccactgaaacagcaaaggacatgccttctcccatatgacaaatcggtacattgatgatttcgagttaaaaacattggataaattgcagtttcagaaagggctagctgacttgtctcttcctacatgtagcaggccagaaagattcctctctgggaggggcatcctccccctgccagggcaagaaaatagcccttatcgccagagactgcggattgcaggctgcagtgggcttgaataaatacccttactgaagtggcccttagcctccactaggttttttgtttgtttgtttgtttgttttgagagggagtttcgctgttgttgccctggctggagtgcaatggcgcgatctcggctcaccgcaacctctgcctcctaggttcaagcgattctcttgcctcagcctctggagtagctgggattacaggcatgcagcaccacgcccggctaattttgtatttttagtatagwtgggtttctccatgttgttcaggctggtcttgaactcccgacctcagataatccacacgcctcggcytcccaaaatgctgggattacaggcatgagccaccatgcccagccaccgccactcattttacacagtcccctgtatgtctcctagtgactsccctagaaattcactgaccctagccagatcccatttgtcctgtctttgtcagatttatcattctttgtctaaaaagttcaaaagcatcttgctttggccgcttcttcagacatcactctyttgtgaagatcccttgtacctggaaaactattaagatccgtatgctttyttcctgttgatctggttgtctgattcgtgtccatttggtttctaggtccagccaaagagcccacataagaaccaaggtggggttgggggtgatctctgrtcccctttgtgatcctcttctaggagatttacctctctgctagcttacatactatgtgaatatagcgtgggctttcttcttgctcttcagaaagtcttctctaccctccctcctcctaccatggcgcattctgcagcatgacaggcattccactctgaggtgtgagccatgtgggctctcaggactcttctggctccacttctgcctttgtagctgtggaccacgaggcagtgactttgaaattcagtcttattctgyggaaatattacttactcgtccctacctcatagggtggtttttcgaagtcagtgagacaaggacagtgaagggttgaggcagtgctcagcacatagtaagygctaaataaatgttagcttttgttgaaattaatcttacttttcactaaattgtgctgcaaagcaacgtgccattgcctgttcttcacatggctgtgtctctcctcctcagatggatggagtaggagggttgttggaagacaaaagcatcctgcttcactcttgtctctccaggctcctgacagtgayttgcactagctgattagtaaattcatggcagtgcctggtgcctgagagagcgagggttgggtgcagcttggctacagctctgaacacagcagtgggggctcagttgcttggaaaagctgccagccagtgagcccagcacagtcagagtcctgtcaatgcagtaggtgggtaaaataagacaccagtgtgcctttgaagcatgactttctgagggagaaggctgggagcctttacatttgatgactgggagaaaggacccaagtttttcctgtgtgtttccttaaaacagccttattctctagatgtgatttgttttctgttttattttcaaagagaagaaaatcttgttaatacttgcttattaactaacaatttcactttactggtttggtatgtaaaactgagggttttcttctacccagtggcagtttttgatatgaaacagtaacaacaacatcaacgtaacttgtatttttgaatatatttgatacagatattggttaaaagcattttgtacatatatattcttacatatttgtgggtatgtatgaatacatgtatatatgcatatatatgtgtgtgtgtaattgattctcattattcatgaattctgtctttgtgaatttgcctactcagtaaaatgtatctgtagctcccaaatcagtggtcatggtagtgttgtggtcacttgcagacatatacagagctgtgacaaatttgartcatatgatgtatatgcttccaggtgcattcaaactaggtgagactgccttcttgttttagctttcatactacaaacaaatatccttttcatgaaccatttaatgccacatttgccacaattttatgctatttcttggcaattttgctgtcaaaatggccccaagtggastgcagagtgctctctagtgtctctaagtgcaagaaggctgtgatgtgtctgactgagaaaatgcatgtgttagataagctttgttycagcatgagttacagtgctgctggctgtgataaattttaagtaaggcrtctttaaaccgaggcgcacgtaaaacaaggttatatattgactagttgactgaactgtgaccagaggctcacaggaacctaaccstgcatttctactaggagcaatggttcaatatatgttaagtattcatggtgacttcatagaacataagtaccataaataagagaatcaattgtatgcagacactccttgatttatgatgagattttatcctgataaaccatcctacatcaaaaaggcggctgcatgcctacctcaaacatcacaggtactctgcttcaccttcctcaactatgtcatgcctcaactctgcttggactctgcccaactccagacagggacaatgtgacagtagccagctcctctctgaactgacaccctgtaaattggacctactgaacagcaatagtttagcctaacctactttataygtgcttagagcacttgcgttagcctacaggagggcaaaatcattgaatacaaagcccattttataatgaagtgttgactgtctcatataagagtattgtaccacatatttctggaccaggaaaagatcaaaattcaaaatctgaaaaatggtttcaatggagtaagtatttcttttgtaccmttgtaaagttgaaaaactgttgtctagtcattctaagtcagggaatatctgtgtataaatcgtgtaaaatcctcccagaacctttatgagagggtgtggactgtgattcttaagttaatggcatccctctctgcctayaacgatctcacgtctgtttttttgccaaaaaatatagctgctggggaacctgttcagggaagttgggatgtgtttatccttaggygtttattcatctttccaagctcctgcaatcaaccagaaacacaggggaatggaaggcttagtgtttgttgtaccaattatgccacaggcagtatcttgtgtattttaagtaacagcactgctttggtaaggcagttgatcctactttcaaaggcaaggtacctgaatcatggacaatgaggccaccatcagccctccctctccaatcaatggatgaccatacactgtgcttgttccttccacatggagacccatacttgaatacttggtgggtaccttgagctaacctctcactttgtgtggaataggcagtgggctataaggggaaagcacacactttgaagccagactcacttgcattggaatctgggatgtctgacataacaacaactactactatttttttggccatttactataacctagtcgtaggttaaccatacaacaaccatggtaactgaggcacgaagaacatctttcttatttgtggtgcatatcacaatgtaaaggtagtcctgttgatacacccatttttagaaatgttaaatggtgtgctcaaggtcacacagatggaagctggtgaatccagaatttaaaagtagaacatttaatcccagagccagcctgccttcccaccatccaaacgatgctatgccacatcttgaagaatcagaaccaccttgtcaagatgcgtgacaattacaacagagaaatgatgtaaaatgcagtgtgtagtttctgcccctgagatgagttcaggaatgggtccagttcctgttcttaaacacgctttgccctactgcttgcaagccaactcggagccttctgatgtttctctccaaactgacaaaggaatcagctgttccttctagagggggaatactttgacttgggtctttagaagttatctgatgccagcttattcacatcgcctcacctcctagcagctggagcaggaatgcagcagyagggtattgaaatttaagaggttggccttgagtcactgacttagctgggtatcccataaagcagagagcttatacatttctatcgtattagggagacaattccagagagtgagagtgaaggaagaggggattgaggcaggtaaggaggggaggcttgckaaggcgcgtactgagctggccatccccaagtgcaactgattgagaggtttgtagagctttgtccctgagaagcctgcctcaccaggatgtggtgtggggagatgaaataattcctccactcattcccatctgctattggccatatgttggctcaaggggcgttcctttccttgcaccgtaggattgtgcatgtatgatggggctcctctaccgagttaagaaggaagcccttggcaagggcggagaggctctcagttcagagaggagttgtctgatgtcacgttgcccctatctgaagttggacagagcccaggcagagctgagatgtgaygtgagtgaggaaggcgaagcagtgcacccatgatgtttggtgcagtcttgaaagcgcagtcactrtggagccgccccccgcctctccccttctgagccsccacagctcacgcttgctttctatgtcctgagcttttctgtacctctgtcttgctatgtcaggcattcatggctgtgctgttagggagccttttcaatcttctcatgctccagtttcaaagctgtctcaaaatgagataagttaaagcctaatacagttttttagaaacacctgtatttgtcrcgctgacctaatattaacacaggttctcgtctctacttgaatgttacgcatctatcgcgacaccattaccaggactgcgctctgaatctttagagattatctgtgtgcctgatgtcatgaataccaagtagatgatgtaggatggctataccctgccagggagacctgcctggggtaccagtgagtttacaaagacttgcaggaggcagcatacagaccatgggcttgtagctttccagttcaactacaccaccaaaccctggcacctaagactttggttgttccccgtgtcctatgagccctgatcacaaggtgagcaatgccttctaggctgggaaggcagagttggcaagaactgccaaccccagggatggcatcaggcccgctgataattaaagggtgcctaggacatattgcctaagctgttattggttctagaggactcgacttcattccatgaggggtaaaataagtagatagggaggcattcagagcctgaactggtaaaggggggacagttataatattaccccaaagctacagctcagggaaaaccattagggcaatgtttttttgttgttgttgtttcttccttaagaagggatctgtgctatgtactttagcatcacctgagatggtgtgaacaatgataagagtttgaggccctgtcttttatctacagattcagcattccttggggtaaggtctgggagtctgtgttttggcaagagttctgagtgattctgatgtacactaaagtttgggaatgactgtcgtaggagtgttcagtaacttgggcctcctggaatgctctaagttgtgtcacagcccagctgagtacctgggacagaacagggaaaagcaaggagtgacgatgtcagagaggggctgtgagmccctggctttggagccagacctgtaccttcctggacttcagcaagttccagaatttctgtgcatgtgagtttacccctgtgtaaagtgaagatgacaacagggctggctgttattctagggggctgccccggtgtacctggcacagtgcagtcctgctgattttcatattgctctcattgccatccacatccgagggagtaaattagcgggatccacaagccacggatgagccttgaaccagagaagccacaaactagcatttaggacttcctgaggctcaggtatgagcaatgctgcccaagtgcatggcatgaaacccactacagaccatcggaaacctcttgaggacaccattcctctctggtagcctttgggscatcattgaacattgggtcagcatgttagatacgatgaagttccagatccaaggacaagccctttagatgcctagtatatggctctgccctggcatttaacgcccaggagattatattaccctatcaagcttatagaaaatggacgcaggtacaatatatcttatctactgccacattgataaagtctacagagaaaatagtgggtcttttaggacttacccattgagccttttattttaagtgacacattctagtacggacttaattgtaattctgataacattacttgtaatactgtctccagtccttggaattaatttgactggaaaaaatccagaaggacttaaatgtttctcattaaaagcattatagataacttattagacattgtgactaattgtagtatggcccaatgtaaagccatcccaattaagatgctgtttcttctcttgtgattagttggcaaaccttttccatacaactgtgccctctagaatgtagatcaattaagcatatataattggacggaaccatttgctccccagttatcaccctctccagtgagatataccccagccgggttggtaggcttgtgaagacaaatgtcctgatctcactttagggagttgacaaatggatctctataaggcagcttatgtgctaaatatttctcctggccccattggcagagatgtagtctgttttcccagtacagagaatttcttgcagcytgtacattttccctttaaaagataaagagaaaccattatgcagtttwtattcctgacctgcctcaaggagcagatacggactggaaagcagcccctgttggataattgctgcttgtctcagagtttgagattctgyckgggtttcttgagtcacygagcatatggggcttcaggttggactgcccactccagtgcctgagaatttactgggaagttttaataaagtagagcagaaattttccagctgcatccgaaatatttgatgtcatgctgaattgcaaatccctagtcggaacatttgaacatcatctagagggatcaggaaataacccaaaggtttggtaggcgacttagaacaatggctgctcttaagagggaacaatttagagcgatttctttcctcttccttctctccaccttccccactgatttctccttcacgcacctatgggtgtgaaatgagaaaaaaatatcacttgaaaccaaatcaaaagctacagcaattctggaattaataaaagctcacrtgtagaaggaagtgtgggtttatgggtagggtgaccatgcactacccaggtttgctttacctgaaggcagcggggcacacgtactgaggactattgggtagaaggacagatggggctataattaggggatgagcttccaacagattctcggaatgagctaggcatttgcaatgttcagagtatatagactggcacgtaatttggggtagtcgggtatgaaacttatagacacatccatggatttccctttaataaatcgtctcttctagtagtcatttgtcatcaacgagcaattcagtaaaagttggaattgagcataatgttgcatatcatttcagaacatctggccctaatatgtagtaacagctgtttagtacctgagatataaacaaaacatttttcccatggctgtcactgttcctcctcctggaggtgcagtatcaccraggcttctctgtatttcctatcatgggtaatagtaacaatatcaataacacartgatgattatcatgtattgtttaactatgtgtcatacactatgtcaagcacttttcatatatgatcttggtaaatcctcatgccagcctttcgtgggtattagatggcgaggggaaagtcatcaagccagagactgactactttgaaaattgaatayaagtctgtccartgctacagctaacattctttaagtactaaaataaattgcttgtaaataaagtaaatgaaaaaagaacacaactgtgtaagtcacaaatgaagaaggcaacaaaagggaacccagaagggttttttattttttggtgtggtcttcctttgtttgggatgtaagacactgattttcctgctatattatagtatgtacactgttasgaggtggcagtgcagtaccttggtcatgtaagccaatcaacaagacttgttcttttcctgatgttcaagggagtaattccttaagcaaaatcacatttatacacatgtcttttcaaatttttaaccaaatatttcaaaatcagttgtttaagaaaacsattacacctataccttcaatatcaaagcagatcaatttttaaaacaaatttactaacstagtcttcagatacataggtttgtttttctcactaatcctttgtggtcactgaaagagcataggccaccccagtcttttgccsagatagtgatgaaaatgctgatcttcgtgaatccaactgaaattttaacttcgtgcccaagctgttctagaactcaatttatcagatccagatttggtattctaaagactagagtgttttactttctgggtgttctttgggcttcttttctattcatgaccctttggattataaaagaagagaaacaccatggggcagatatgtccaagaataaagaaaagagaaagttgcrsacctgagaagtgccccctgctggccagcatcatttctctgtgtctcactacagaaggaggtctttgtttatgaattctgccctccccctcttgccctgasactatcacctgctttggaaagaatggcatcatttccagaatgcccctaggggcattagcttctgttctacactctctctcttgcttttcaatatggaagttaacaacgcagtctttgaagctgggccgattggatttcaaattctaactcagtaacttcccaactgtgagtttgagcaaggtatayctcttaaggctcagtgttttmatctgtaaaacaggaataaaatagaaataataacaataactatctcatggggttattataagagtcaactgatataatgtatgcacaccattgagcagtgtgtcttcctcattattactccttgatagatagctagaattactgagcatccgacttagaagtctaattctctattttgattttattcctaaactcccatgtatgcaccaccaccttaaactcggtacatctatctaggccgtgatgacccctctactggcagctttagtccctccctaatcactgtatttctatcattgatattaatattcttgaaatcacccggattcgaaaygtccagtatcattcttggctcttccctccactcttctctgatcctttcgcaccatatcatcccctactgcttccccacacctctatctaggtgatcagtcaccaactcctattatttcctcctccatctgccttgtaaatcttaattccattctcctcactgattcactgttctccatagaattccttgtgactttcttggaggtggggatctcatgtttcctttaagaaaggaaatatatatgtgtacacacacacacacacacacacacacacacacatacacacacacacacaaaatatatatatttggagacagagcctcactgtgttgcccaggctggagtgcagtgrcatgatcatgactcactgccacctctacctcctgggctcaaatcttccttctgcctcagcctcctgagcagctgggaccgcaggattkcgtgccaccatgtatggctaatttttataaagttttcttttttttttttttttttttttttgtagagatgatggggtcttcctgtgttgcccaggctggtctcgaactcctgggctcaagcaatctttccaccttggccttacagaatgctgggattataggcatcagtcactgtgcccagccccaggaaacatgttttatttcttgtgcccccatcagtgttcgacgaagccccgggtaggaatttggtagatgcaggtgtttgattaatttccccttccttttgtttctcttctcagccgtgtgtctctttcctctgtcattcattcaaccattcattcattcattcaataaacacttactgaggttcacactcagtcaaggaactgagaacactaatgccattactagttctctctagaaactcactagcaggaaataaaagtatccccaaggagaaagccttgggaattaaaattttttgcacaacaaacgtttattgagcactgactgtggcactttgctttttagtgatgaacaagatggacacaaccccagccctggtggagcttaaaacctcacaggtattagatgagcatgagataaataattctacgagccatgaaagtcatgaaagggagaatgcaacagcacaacaaaaaggttttcatttctgagatggcgagagcctccctaaagaaatcatatttaaacctatgttgagaaatcgagtatagtttagttaaacctgtatatgttgagggcaggaggcagagtgttcacattagagtgggcagagaatgattgctccacaactttacaggcatgggttcttgacatatgcatacaagctcatccatgtggaagtgttagcaacagaggcaactgtatgggcagcaactccaggtcctcaaaaactgagaaaactaaaattctatccaggtccggcaatgtgtgctttctgcatctttagtatgtgagttggtttagtttgttaattaagcctatggaacaaaagtgttctttctcctccagactttcaaaggatgtactctagggctcgaagaaggggaacagagctgattatgttggtcctsttgtttgtgtttttcttcccatttaagaacgtacatttgaaggtgcagtcttgaaattcttgatatggatggcagayacttgtaatgagagaggaattagcagaaaatcacacctcatttcaataaatcttcaccccttaaggcagcctggtgcccttcctgcattggcctatggaagtcaccatctggactgggaggattgatgacttcagtttcacccctttctaaatagtgtttatgaagatccctttcttcaggtcagactagagattgtacctacaaataatattgtaattggaccacttagttttcatctttgatttgaggtatttgaaatgaatgtgagattaaagcaaatgaaggggcatgagaagtgttagcaatyctccagacagggaaaatttcttttcattctgtctccatgatatcaaactgaaatcctcagttaaccacagcaggggcaagtgcctgagttgaaaatgtcttcatccttgtattcttaattcatcacctgagaagtccttggatcaggtacgtgaaaccagaagagagatctccctggggatttcatagatggtggatatttaaatatgcaaaacattattgagaaatatgagatgtgtcagccatctcctgtgctaacattttttccaagtcaattactttgtggatgtttgaggtgggggcacactggaaagaaagaaagaaagacaggaggaactaaattatttataattatggtatgtgttggcgggacgggggctgccttctgagacacaaatggatgacaaagaataagttatctctttatagatagaatgtggcaataattgcattgtctctggattcaaaaagtcataatctattaatttgatggatatcaaaaagctataatctgtcaatcaggtgtcagaagaaagagtctctcaaagctttgaagcatggcatttagaatacccctggatacctttatttctattctaatattaataggaaggaaggatacaaacatttttggcatagttagggaatggatatcattttagctgtcttaataattttgcaacttaaaaatcgtattggataagggtgccgtattgaaaaaaatgtgtaaaagacacactacagtgaattagagggagataatttcatcctaagatttctctgacattasgcattgtggcatcgctttcttggtttaaatgtgaaatagaacctgagattatttttcataaatttatctagcccatctattatttctctatattatatggctgtatacttgaaacataccaatggggactgaagaaaatgcttaagtctataaatggaatgtcaaactgatggaaggaggaaattggagatgtcacacacagtaaaaacacagcttttccaggacccagtaagcttgccattaccaaggaattaaggtattctcctctggtaggaaaagaatttgactccttggcccagcacagtttcaaagctgcatgaagtcacgtttgcctcattacaattcctttggttaaagatgcttttctaagtacttcagaaaatgtatgcaaaaatattttttggtgcggaggccaccaaaccygctggactcacgttcctgcttttggcaagcaaagcaaaagaaccttctgggttcccttyctgcctttcctactgagatcaagctgaaggtggaatttttctatatatccagtycagcctttgtgacctctgcctttaacacaaacaccttgtttaaaaagtagacttgagggagggcacttgagttcagaagccaaaagaaatgggtattgctctttccgcsstaagcagttctgaacctagaccatatccttgggagaccagagcagstgtaagcagcaaactgcctcttttctgcctccctgtgaacctgcttccctggagggtatgctcaaactcaattccctgttttattgttcaaaggacagggaagaaaggagggagaaaagattgattaagcccccagtctgtgcctggcaacattctaggtgctttgtatctgaaaatctattttattttcacartgatctcatccatgtccatggattcaactttatctacctgaccaccaataattcatatatttggtctttcggtttagtcatcttggtgctccagagctgtatacccactgcctacttgacattcttcttacatgtctcaaaggcaccttggattccacgttttccaatttagtgtgtgatcttccctcctaaactcaaggctttctagtgttccctacctcattctgtggcaccattctccatccagtttttcccctttctcacagtcaattaaaattctgttgattttgtctgctaaatatctcagcaagaatccatccagttctctccctctccattgccagtatcctaatctgagctaccatcatttctttttttttttttttttttttgccttgaatatcaatctggccccccagatggtcataccacaatcactcttaccttcttccaatctttctcttctccccaaccagaatgattctttgaaagcttcagtatgatgcatatgacgatgtcattcatttgatcaaaatccttcagtggcctgccgttggttttttttatgaaatataaaacaaaacctcggacatgagctataagaccttgcatgagatgcactttctgagaccagcccctccattctcctttcatgccactctacactttcaactccagccaccccrgtccttgttaagttgctgagactatcatgcacaaaggtatttacacagttttgttttgggtttctttgttttttgttttgttttgttttgttttgtttttttcaacggagtctcactctgtcaccaggctagartgcagtggcgcaagctcagctcactgcaacctccgcctcccaggttcaagcgattctcctgcctcagcctctcaagtagctgggactacaggcacctgccaccacagccagctaatttttgtatttttagtagagacggggtttcgccatgttggccaggatgatcttgatctcttgacctcatgatccaccctccttggcctcccaaagtggtggaattataggagtgagccactgcgcctggcctacacagtttttatgcatattgctctctgtacggagaaaggtaatgcagactcattcatcctttgtatttcaggtctattgcyacttctttgggaaacatcacccctcagtctagatctgatacccctcttattccctcttctgttttatacctcttcttcctagcccaggtgtttacaattcccatttatttatggggaatatgtgattattgtattttccctactgagattcaaagctatacaaaggaaaggactcttctgccttttttttttttttttttggkttttaactcattatgaaatccccactgctgagcacaatgctgaacacctttgaagtaattaataaataacgactaaattactgctgtgtagataaggcagwtaggattaggttctttcaacagtgaggaaatcagagctcattctaacttaagggtttagaagtatcagaggcaggactctgacccgggtctccagactcacaaaacacaatacactataaggtstacaatagcactgacagatattttttaaaggttcctctcatctcactatactaacacaaatgttttcarttctacaatctacatttccccctccaatttttctcctcttttttgactgccttgatggtttcagtggstcctggttaagcctgtctttaagtttctaatcaaactaatccaagtgaatttggcttctgaccttgctctcacatatttgccatctctaaatgattgatgtctgcttgatccctgttggaaaagcgtctgaagatatgatccagaaaatctatagttgcaaatctagcataattttaatgaatcgtggtcagaatagtaagaagcattgcacagaaggcttgcataaaaaatatgcatcttctgtcatcttcaccctctacaytggcctcccaagtccccatggaaggtatctagtacgggaamctttcttttcctgtaagaatgttgtggccaaacatgctgtgtattggatggatggatgggaggatgatttatattttcatctcggtatagttcataggtctaggatcagaaataaactagaataaatataaatattgctttwcttaaygttggtttaaaatgcaaatgcatggcatacagaaaaaactttttttttttttttagctctgaaagctcaatttttactacatgatttccctagtagaagtactttttgcagggtataagaattttctgtttgcttatctgttttcagtctagaatgttcacttcttaagggcaaggaataggttatgtttaccttcttatctctggagacttgtataatcctagctggtcctaagtactcaaaagttttcttgaatgaaacaaagccttctccggatgaggaagcttgtcagaagcttgagtgactggtaaggagggtgaatctctgctgctgatttaytaagaaatatttggatctttccttgaagctaagggtatatacctacttctgtgcaaaacaggtggcatggctggcccttgaagagtacacagtttaaggagacagtaatgggtacagttatcttcttaaagatctgggccactttgttcctgaaaaagtgtgggaagtttctctcttaggcagtctatctcttagagcccagtactcacagcaaaatatttataaaagaaaacaactctttcatcatccctgacatagcctgccctcagcctagaaagaaaaggccaataattgggactgtgtggttccaggagataggacagaaggatagggccaattcaacaggtaagaaagacagcacactcaagggagcagactccagttgatcaccgctgtgggcagctgaggcacactcctcccaagacagctatagaaagtgcctcagaaatgtctgtctctaggacacggttcccattatccatgggtcaaagcttgccygaggaacgccagctcctttgcattcccaaactttgcaagcatgwgtcatmctgcaggttctcttgggtattccattgtaaggagtctgagaagctccaaggaagaatgcagaaatacggggtatagctgaggccaggtgctgtctgatcatatacctgggaagctgttgttgatcacgtacctgggaagctgtctgatcacmtacctgggaacctggttgttatatccatggctggggagcagggtagcagggagcaagaactgtccaacataatctagtttacctrtggactttcaaaggtttgcaaagatttacctcctactaaaatggcttgtgagcatggaaggcttaaacattagcagagcaggtagaaaaataasgcctggtaagatgccaaatggtggaaaccgaggcagaagatagtcctctggacaaggtcagcataatctagtacatatgaactcactcacgctcctgcatcagactcccctggttttggaatctgtctctgttgcttcccagtggaacctgagaacattgtttaatcagccttggttatgtattcgtcgtcagataaatagggacgttaataccaacctcatactgtttagattttggatcatttacaatgagaatgtgttcatctgttacctgtgtaactgaacataataatactatgtttgaacagatttcaaaaatgggtttggatctgattttaaaacatttgaaacrgatgtggaacaagtttttaaagaaggaaccctatctcataagattgtcaggatcattaaacatcacgagtatgagcccacaggaaaccttcagtayatcgtgatcttcttgacggtggtgaagaaggacaaggaagaccaccaccataacacacgggtcttctttggaatggaggttccaggatctatggggaatttgcttgtccctatccactctcatccctccactggggaagagagagttggtgccagtcttccagcgtaggtcattgttggctcagcatctgggaagaatctgggcctgcaggaaggactcctggacagtgccatgagcagctgataaagaccaagagaggggaatgtggggcctggtctaatgagagttactgccataactggcatttactgagcacatcctayatgtgactctgttctaagtactttctgcatgtcgtgtgttagacatcaagagtcgaggcaccctcattcacattctacacatcatgaaactgagacttgtagaggttaggtagtttggccctcatcacagtgccaggaggtgcgggtgtaagatttgaacccaggaagtgtgattcttgtagcaattgctgtgtggttgagatstggtctgggaagtggggctaacacagaagtgtggataggacagattatttctgcgctccaaagttatgaatatatatactccaaaatatgcttcagtgactgagtgagacataaatgggttactctgtcagtgatcattatattactccccatccctgcatgcatgttagaaaggcacacacaagctggaataatatgaatgacatttaatagactayttacaaaaatgttggaagatctggggaaaactaacgaaggaactttccgtacttgaggcctatcaatagcaggaagttattactacctctaggcctgaaagggcaaggagaagggggccaatggaaccaggagatagaaggctggtggagargaccgcctaacctgggtggtggccataaagcgagggagctggagagaaaaagacaccttaaactcacttgctcagtagctcccatgagccaaatctagtggaaagccagagaagaaagtgagaagagaagggagcccataaagaagacaggactgcctacaaaggccagtgtctcagagcacaaatgaggatgcagatgagagcaggtctgttctggcatggcaaaggggcttgcccagcactatcascaatctgcaaaaagatattcttgggaagactctggtgtctgaaagattaaagggaaaatgcatccacgtgataaaatattattcagccagaagaaggaatgaagtactcttacatgcaataacagggatgaaccttgaaaacctgatgccggtggcaacgaccccataccgtgtggttccatttagatgaaatgtccagaataggcaattccatggacacagacagtagattcgtgattgccaggggcgtggaggaggagggaatgggaagtggctgctactgggtacaggatttccatttggggaggtggaaacgttgtgaagctagatagtggtgatggttgcacagcattgatagtgttccagatgtcattaatggccaattttatgttatgtttgttttctgacaattaaataagcaaatacataaatgagaaagaatttttctctcataatgtttgtttgcctcttactcattttctgagctagtcaccaaaacgtatctgacactttcttgcttaacctggcgggagtggtagcggatgytcctggtgcccccgttgcattccctcacctttctgccagctcagcttccagtagccagcgcctgcctgtgtttctctgcctgagggctctctccggctgccaaagcccgtgtccacgcacagcagtaccagagaattaccaggtcccaggagcagcactcgggtgaggactgacatgcgtcaatgtgtaaacaccaacttccctgcactccaggtggggtccagagctcagtgcgtcttgctggctcccagaggccccagcccggttgagctccagttgcctgcagcagttcccaggcttagtgcacttgactgtgctgccacctctcctttcatttcccctcttccctcctggtttctccttcaccttccaaatcaggtggggctctcaagcccttggctcaggatttataataactacggagtaataatagataacatgtattgaatttttattgttaaaatgtgtatgagaagacactggcttgtgttcattttgcctctcttgttcccaatgataagactgccttcacgcatcaggcaaataactataattggttcctggacattagcataaacagaatcccctagggaaagtgctaaaagtgcagattcccaggccccacccatcaacatgctgattccatctgtctaggtgtgagccttggaatctgcatttatcaagcttttctggttcttctaatgcagaatagagtagaaagttttcattgaaaaacactggacactggcatgatgagaaacagaggagaggccacctattggaggcaggcactggcatctggtcagtatttcaacaaatgtggtccctcaagttctgcagggagaaatactccattacatgtatacatttactttctcttaaactgatgggatccatatccaagtatgaaagttaatttcggtatttaataatcattaagtaaagagagagtgaaatatctacactatgtaattacataaaacatgcttctggcartatttgccccctaggaaattcaaataggaagtctccaaggagcaaggttgtattcttggaggtggacacaaagtaattgagctttgctaatggagataattaattaggaaacggatgtgcttgcttctgagaaaaatattggaaagatcttytgagaaggcctagccctctgctcttgtaattttccgaagtctgtgccaccctgaggactggtgcttcccctgagccatgacccagccacagttaggaattaagggagcagaaaacacacagccattgcccacagttcaggctggtcctaagaatgcctgggccctaggaacacactatctccaggaagcagctctgaattagacctcgggttcaagttccagcccccacttatcagctttctgaacttagccaagttattcagtttccatggagcttagtgttctcagcttaaaactaggggttgtaatagcagaaacagtcatcagtatccagtgaaacaatgctctgcaggaaaataagtcgtagatcagaagatgtcgccctggtgtggtcttactaaaccttccctgtctcagcccggggtcttgtttattgcatctgggttacctgtttgcccctttctgtccaggtttgatctgcaggaacctagccttctggtctaacctttctagcttgtctgcttatcaccccaacctccccgctttctggttccagatgctagcctgttcttgccttgtatatctgacttgctgagctcactcttggtgctgcaaagtggccatgccatgaatcttccatagcccgatgcaatgtcaccccagtgacacggaaggatggccgtatggtgagagactgcattcagaccactgagccttctcttccctaattatatcatgccagaaacagctagaccaaggagtcaagcacacaaatatagttggaccagaaggaccagcagctctcaaggggtaagagaataaggaatcatgtgagcattcatggattgaggaatgcatccattattcaagcaagttgatagagataattaattaggaaatggttgtcttactgtcctattcaccaagctatccacaccatctagctcagtccatactttcttaatgagggagaaaatgagactcaagccaagaaggcaaagacttgatgtggatgatattttttctatttttgctttctggtgatggtagacattatattacatattattaggttaaggtaccgatggttttgttttctgtgttgataaaaattgtgcgctttttattcttttacagaactaataaaaacatgacacattaacctttgacttgtctagtctcctcttttattaaatctgctctaagcagttggatggggagtgccttttcgcctgtctacsccttcccaaggactatttatattgaggcaaccaaatgatcmaggaagaattcrtgaatagccatgatcaaagtaaccagacagggagttagaggttcaatcgtatttggggaaaatggtccaatgatggggaaagggcccaggttttgacacctgaagacatccctggatttcaggaatttgaggcagatccctagagctcagatcyaggattcagaacgaaacggtgactgtgagagtaaaccatggtgtctgacataagggtttccttgattaccctttaagggcccctatgaatgtctctgggtcatcagtcccttagataacatcatgtgtctacagctgggatagcaagtaggttttgttttgtgggtcaactcacatgaagaggatgcctagrtgtctgcggtgagcaagattctagagctcatcaggaaagtatgctgtagtcaattagtgatgtctgccatgtgcacgggtagagaagttatgtcatgcataccacagactcaccatctcagcttaatagaccatgaagtcaggatctggggagctaccttaatgtatgaggactgtttccaaaatatttctgaaaactattgatactagatcctacctggagtctctactggttccatagcatggaactgtttacaattgcttttgatcctttttccaaatgattgagtgctttggcataaacaggtcaggtacagaaagcacggcatttgagaattatcctctgcaaacatgacttgcaggcatagcctgagcccactcagagcccatacccaagttgtgctttcttaaggccacagcctccttctgagagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggcctttctgggagamatgatccaatgaggggaaaaaatacttcagttttgttgagagatgatcttaatctgtttgagctgctatataaaaaaataccatagactaggtggcttaaaaacaatgaatgctcatttcacagttctggaggctgggatgttcaagatcaaagcgccaacagatttagtgtctggtgaggtcccgctttcctcatccatggtgccatctagccgtgtcctcacttggcagaatggatgagggatctggatggagcctcttttataagggtactaatcccattcataatggctcatcctcatgacctaatcacctcccaaaggccctgcctcctaacactatcaccttgggggttagacatttaacatatggatgttggggggaataaatctttagcctgtagcaaagataatgagatcaggtgtaggtgattaagtgacatctggagaaagaattattagctgctaagaaagatgtgtttgtgcctgtgtgtgtgcacttgcacatgtgtggatgtgtgtgtgtgcatgtgctctgtgtgtgtgctttgtacacaaggcagagtttgcagtctgtgagggggccagcaggtgttcaaccccgcctggctcaggcagctttcgcttcagttggcttttatctcttcctatgtgccctcagccctgtgtcccagggagaggtttaaccaagtctagaatgttccactctgcttagatgccacttcagaggtcttaaaacagaacctttgttttaagcagagacagtcctctttttgatacgtggttttcaggtgctccctttaggaatggccgccacccacatatcatggttcctctagtggttaaatcatgatgaataggcacagagagctgataattaaggtaggaaagagtaccatatttctcttctgcattatccctagtgaattacaattttttctcccaactgcaagtagaaatgataatcacccttagctccacttccacacccttctcagaaatttgggtaatgcatcctcatcttaattatcaaaatacagggttatcatttgcagagaacatgtgttttgtgtttgtggggtctggagagagtgatcatacaatttctaattcaaagcagaatacycttgaaagtaaatcaggactttcctgttgaaactagaacaggaagtcaccttagcagtggtagatctttgaattcgtctcctcctggttctgcggagagccatgagagactagaacacaatcaccagttaggatcaatacacttataaatgcagagggtcttagcatccatttgggtgccagcttcccttgtgtgattggttactggtgtcaacggagattgtatgggagaggaactaaagaatgcaggctcggcttttcccagaggcagcagtgcgatgcatgggtcacagaatatgccagagaacaacgaggccagtcgctcactgactrtggaagatgagtccattatttaatcactctggccttcggyttttcagctctaaaaatgagaatattcctttcctcartgattattgttatgattcccggagataacgtgcatgaaagattttagtgcaggcctttcttccttccgttgacaacccagaatgttgcttgatgcacaggggaaatagagtgatcaagaagagcctttataaatgagagttgatgttgagtaatcattttgggtattatcaatacccatggccataacacccccaccatgtggaacaacacagggaacacgacttcttactcaagctacaacaggagaattcttccttggatctctcttacacagacaacattgtctgtttttcatcaaaatgctagaaatgagagctcaacatttgtaagctcttgcttcgttcaataaagattgtgtatgggaaatccactgcttctctcccttcgtagatgtaggaatctgcctcagacattgtacaaatgggcagagaggggaatggaactgagtcttacccattacgtttaggatttcagggctgcaggtcatctgtttacctaagatggagaggccaagtcctctctcatggtagctttgaagctggtgtcagggaaaggtcagtgcctgtgaacagtgatggaaggtgtgtaaaggaggaggcagggtttagcacaaggggtaactaaatcttaacttctgggatactgggtggtggtggggttactatttccaatttatagcaagatgtaagtgatatcagctggaggacaactttactggtctatgtgggtgtattagtcggttctcaagctgctaataaagacatacctgaggcagggtagttaataaaggcaagtggtttaatggacttacagttccacatggctggggaggcctcacaatcatggcagaaggtgaaggaggagcaaagtcacatcttgcatggtgacaggcaagagagagcatgtgcaggggaactcccatgtataaaaccatcagatgtcgtgagacttattcactatcacaagaacagcatgggaaaaccctgcccccgagattcagttacctcccacccacttcctcccatgacatgtggggattattacaattcaagatgaaatgtggctggggacacagagccaagccatatcagtgggatagatatcatttggaatatggttgccttccattctgatctcattctatcaaagttggtagatcctaacatggtgacccagcragagtctcttttcaaactggctgtcctcgggggtaggagcagagccagggcaaaccgtcagggatgstaagtaaggagcttcaaggggatccaaggcacctccttggactcagacatgcttgggaccgcgttcgtaggacaacttttactgtccattgccacaatgaaacatggcagtgacagatgtaggccctcagtgatcacagatctatatggcagcaatggttcaagtgcagaaatgacaacagtgtttgtgattttacctttttgtgaagctgggttactggggtttctgtcctggaatctctaaacaagtaaccacagggtagttgcttggctcttgcctcaagtgaaccagccaagagatctcgtccaacactggtatagcctggcagcaactgctacttccaggctgtgtctcgaatgccctgctgggctccatgtgtatctgggaacatggtttctgatctacaaatctaagcccctaaatacacaaaagcgctaaggcaaaccatatgccttaggctcacttttaaacctctctgagcttcagcttcctcagctgtaaaaagaagccatgatcacaggcatgtttatgcactaaatcaaataatgaagctcacaagttcagccctggtcatcaccattcaagactctgaagtctatcaaagcagaattcatgttctctggttgcattttccatcaatggagactcagaaatatttattgaataaaacatcaactatgacaacatattttacagtgtaatagtgaaaacatcattcatctgatgacatgcttcttttgaaccattttgggatggttctgatattgtttgtaacaagaaataaagatccgaggatgatcaagtgagcattcaattattcttaccttcatttaaaaaatatattttcaatattaaggaatttgttgttattgttatttacaaagcaataaaataaggtaagaaaaatggagaggcctgggttggtgatttggtcaccaggcagattgagaatggaaagaaaagggaacagggtaaccatgtgaccaatttgcttcttggaaaagggaccaaataggacccagagaggggcttggtcaggcttcctggtcactgccagtgctgagacattaaagatccaggccccacggagaaccagggcacctggactttgatcttgccataatggyatgcctccatttaagaactaggtcagctgtctttcacaccagctgtgttcttcatgcttagggcaataacatgtataaagtaatgggtatttttctagtagggttaacacacttactcaggtttattcttctaacttgcctgcatccaaacatttttttttttttttcaagataaaaccagcctgtcaaactgtgcagttgacattacttggtaggatgcagaaaatatctgaattagaaatgggcccatacaggttccagtgggaatggctttctcagcaggtatgaatcactgctattaaaaatgtattccgtaggtaarttgttagttatcatattcatccactcttacagaaagccaatgttatcatttgggtccattattaagactatcattatcatagtcagtttagtaacctccttttacataacattggattttttgtgggttttcaagtctcttccaaactgaatctcacaatctaggtttatttttgaggccaccttgcctgaaggctcgaggatgacaggagtgacttccgtcactgccatatttcttctacacttgaagattgttttctgggatgttgctgcaaatggcaaatgtgtttgatgccctaatgtttaacataaatcaggatcatggatgtgcatagccccctcccgtttctgtaaagtattgtaaagggactcctgtcctcagagtgccaggcctcacatttacattctggacaaactgggctgtctgcttgaaagggcagataccacaggttggagcaaacatagcttctgaagaagatgtaatgcatttctgtcccagtaagttgtgcctgattaagatcttctcatagctgggggcagtggctcacgcctataatcccagcacttttggaggccaaggtgggctgatcacttgaggtcaggagttcgacaccagcctgaccaacatggtgaaacgccatctctactaaaaaaaaaaaaaaaaaaaaaaaaaaaaaaaaaaaattagccaggcatggtgttgcatgcctgtaatctcagctacttgggaggctgaggcaggaaaattgcttgaacctgggaggcagaggttgcagtgagccaagattgtgctattgcactccagcctgggcaacaagaaactctgtctcaaaaaaaaaaaaaaaaaaaaaatcttctcatgaccccgggtgggtggctggggtggggttggtggagggaaataaatatgaagaagaatggtgagacaaccagtgggcatatactgtgtagactaccagaaagctttggaaatgtgtcaaccstaaagcattgctatttttaaatatttagttgtattttaatatttagctataaatgaagaacttggcttggacacaaaaataacaaaaaattaatatctaagagtcatgttctctgtggaataatcttagggctggtctgtctttacacatttattgatgatccagaagaggaagcacacaagtttgtagattagcctaagctattctggatagaaaatacacagggccctagcacagcctcgtgggcagaagagttcatctcgtgagaatgagcaaagagacacttaagaaaaaaatctgatgcccaaagcctttcatataggtgaccattgtacacacagtaatgaagcagaactactgtgctctggaagccactatgcccaccgttgttcatgaataaaagaaacatggtagatatccttatgcatgtgtgcacatgcagcacacctggcctggcacaacctgctcacacctctgggagtcacctgggtgttggctgaygcagcctggcctcggctgagctgactgtcaaccccgcaactgcctgtcccatcatggaccagaagcagagccagggatgaggatgaacgctctagttgcctgtggcagataaagaatcagtcatctagctgggaaggtaaaggttgagaggaaagccagccaatgtctataaagacacataggaaatgggagaatagagccagtgagggacatgcagagaaacacctagattttggattcatttacacattcagcaaatatttattgggcatctatggtgtaccaggcgctgcactggactcagaratawaacaatcagccaaatgaacaagtctggaccttcagggaccctcgtggaggtgttacctacaagtgaggaaaggaagaccaaagtgtttgttagttagttactatgcatcaggtactgtgcacctcagaggccacctgcagtcagtctccctatatgccaatggctgccagcatcttcctgctttggggaattctcagcagccagtagcagcttgcatagcctgagcatgtggcaggtgggacttgatgcaaaatccatacccaggaaaaatcttcaagctataggggtgaaagttggtgaatgggtgtcccagcctccctgccctttggtgggacaattctgaggcctgtgccattaacttcggcagtaccttactcattaatgcaccctttactgacattttctccttctctgtctcacttactacttggggagattgtcttccaaataaactacctgtatccaggtccttcttatagatccactctggggaaaggcaagcaaagaaaatacattataagcctgttgtactattagggatggtgacttccagaagctgactgtgataacctttcctcgggcttcagaagaggctaatggagagttgaagggagaaatcaggaaagatggtctsccctcaatattctgacatgggttaataaggaggcactggttcttaaattgggatctcgatgatgctggactagcagcagcaatatcacctgagaacttgctggaaatgcaaaccctcaggctttaccgagacctcatgaatcagaaaagctgccagcaacctgtattttcacaaggcattcaggagattctgatatatgctgacagttaggaaacactcatgtaaagcatgtctatcttcccttcaattatgtttttcataatctgcaaatagttctgtcacttttaggggatatggctggacaatgaattatctgtggcttcattagaaaagtacatgaattatattgtggacagcaaagttatactgaagtgctgaagggaagtcaaatgcttaggagtgtaagctgcaggaagaaataggcagagaagctgggatagtttacccagcatggtaacttctatgttattaggctcaaatgttcacactctgcctttgaaataagtcattagaaactatattagtctgttctcaccctgcttagtaaagacatacccgaggctgggaaatttataaaggaaagaggattaattgactcacagttctgtatggtagcggaggcttcacaatcatggtggaaggcgaaagaggagcaaagtcatgttttgcatggctgcaggcaagagagcatgtgtagggaaactctcctttataaaaccatcagatctcatgagatgtattcactaccatgagaatgacatgggaaagagccacccccatgattaatttacctctctcttgttccttccatgacatgtgagaattatgggagctacaattcaagatgagatttgaatgggagcccagccagaccacatcagaaaccttctgagaggatgccttgaataggtgatatggcagtgtggtccttagcaatcagaggagagagaacgtgggttctctgtgaatgaaatttatattcctagtttccgtggagctgtgtgcatgaaaaacctaggttctcagtagctgggaggagacctgcacaggcattggtttttagtatatgtggtaggcagcttctaagtgaccccggtgatcctcacttcctggtcttcacrgcctcaggtaatcctcttcccttgaggaactggcttctagccaatagagtacctcaacattgagggaggtgtcttctgtgatcgttttacaaaagattttgccttccaccttgttagattctctctcttgctggctttgataaagcaagttgtcattgttgaggagggccatgtagcaaggagctgggggtggcctcctaccaagacctcaccagaaactaggagtctcagtataatagcctcaaaggaaatgaatctgccagttatcatgccatggactttgagatgagaccccagacctggatgatcctttgaagccttttgaagcaccttgaagcagagaagatagctaaggcatgccctgtttcctgacccagttaacccatggttgaataagtacckctttattttaagcttcttagtttgtggcaagataactaacacayacatgaaagtctaggcttgggtatcatcaaaggacctgctagcagaattcttgtacatgaaaacacagttgtgcaggacatatctgtgcacctctttgctgaaagcaacatcctcaggaagaccacttcccagcttgcgacctaaacatttagstctaaacacttgagctctaaacatttagttactcgctctcccctgtattaatgtatgctgcataaaggacccccattttcctacattaaaccctgtataagaacctccaagtagacacttatgcaaacatgccaagatgcaggaccacatccaaatgataagttgctgtcagtgaatcattaatgagcactgctgtgcaccctgccacatgttaaaaggtaaaattacattctgatgtttatttgagctattgcctattgccacttgaggcatatttcatggaatgataggagtagagcaaggtatttattttgcattattgacccaaggtgctatcagagtcatgaggtccccattaaaattccagtgaactcttagattctgccattcctagaaaatcttataacattcttggttcaaacttctcatctgtgatttaatgggatacactaaggtacagtgaaggcctggattaaaatgatgtcatttatttgctgcgtacatggtcctgggcaagtaattgaaacaaactctgaacttcaatgtccacatctggattaaaataaaaataaaacatatacttaaacactatgatcataaaaaattcagtgcctggcacttagtaggtactcaataattctgtctccccagttaatttattcacttgcatatagagctatttatgcagaaaagtttatgtgacaactaccagatatggatacttttatagaagagtatccataggaaatggctcagccttctgtcctgcaataaaaagtaatgtttgactccaagtacatgagattgaacagagttatttgagctacttttgataaaatgtgacaggcagactttggtatttcaccaccccaacatttttttatggactgctcactatcactrcaacattcagcacttttttctgtgtcaatgtgatagacaatattcatattcttcttgggtaattgcctttttagctgaatcaatggcttgcaggcatgagaaggaggctgttttatctcaactttatttatcttatgattatactaagactataaaactgaatctcccctccttcccttcctcccaggcccattcccaatcatcttctaaaacctctgttaatactcagcttttttggtgaattttcccactgccatgcttcatgttaccaaaatatttcccttttctgacaacattccaaatataaataaggacctactgaatgaatgaaccaccagtatgattcacccaatcactcattcaaaaaatattctttgaggatttactgtgggcagaccctggagatataagagggagggaggaggatgactatgcctacttgtaaagtggacagctgtggtctcttctagaaaggaggagtgcctataaaggaggcgccttgggtattcttactgagcataacagatggaactgaggagtcaaggagggaagccttctctgattatatgaccatggagctaagatttgaaggaaaacacataatggtgcatgtgtgtggggagggtggagacaggaggcagtggaggagctaagtatcccaaggtggaggaggcagcgtgggcaaagtcctgtcggcyggaggaagggcatgttcttggtaccagaagcagctcagtggaaaggatcctgaagcggaggctggtgggccgagtccagaccctgggggccttgtcaacctagctgctttgtgcctggggcaatgaggaggctgtgaagcatcaacagggagatacagtatttagagtatctcaaagtctccctctgtgtggtgtttggatctttctgaatcctcagatgtaatataaattatttgaaagcaaataccaatttgcttctaattctggatctcttactcaggacttggttgcccagaggaggtttaataaattctttttaactctacttcccaccaatttttctcccttckatctgttcctatatctctaccattcatggcagggttagcacgtggctccaatggtgagcaggaaggacttcacctcttgtctgtcccttagctttggtgtgtgctgctcctaacgtagctttggagttggagttaagaaccatctcatggcattgttgggttaggtattctctgggtccactcaagcttcctatcagttttttagggacagaaagctactgtgctgacctcagtcaaagcccctatctgaattcttgaaagagacatgattgttaggtcactaattgattctccatagtgttagaacagcaggagatttgaacacaagggcatggtgctataccatgcagcctggtagagttgagctgaataacttttaggtttgtaagacagcacatttaatttttaacagattatgtacaagatattgagtgacattaaacacagagttaaatcaaccataacccatttaaagcagccttgcagataaatgtctcaaatctactagcctgccaaatgtattccttatctacacacatttatcaatttttcyacaacactaagcctttctaatgtttctctgacagttactttctctcccaagcctgaaattcgggtgacatctactttctgtaaactagatgtgcttgaccagggaaagcccctagatttgtgttaatcttttggggccactgacccttctgggactctgatgaaatctttagtttgctgtctaagtaaaaaaagaggtgatataaacatacacagatttctttttgcataattctattgtgttgcttttgaaattgattttattcacgttatatattattcaaatacatctttactaaaaagtgtcactcactctatatattttatatataaatgaaagattactttctaacaaaaattagaaaaaacacagtcaatgtaagttaatcagaaagtaaaccttaattgtattcaaaagtaaaactcaatgggaacaccgttgttttgtaagagtaagaaattttggtagtcacaaggtctttgacatggcaacatgaatgacagctttgcagttaagttctgcacctttggttttgatggcagcaaatatgtaaaaaaaagtcattgattcaggtgatagaaacaaaatcagaatgcccatagctcatgttgcaacgaaggctgtaacaggaaagcaggccctacatgactcttatcatttcatttatgtcccatgatttcttcaactcagttagktcaactgtggtggtttcagtgggatgctatctatgtatgttaattatctattgttgcattagaaattttccccaaatttagtggcttacaagcaagtattattacagaaacattgcaatgaggtacttgtagttcagagtctttcacgatactgttgtcaagatgttggttgaaataggagtcatctgcaggcttgactggggctggaagatctgctttcaaagtggcaccctcacatggctggtggtaataggcctcagttccttaccacaataggctctgcataggactcttaaggtatttacacaaaatggcaagtggctttctcctgtgtgaaatatcccagagagaaaaccaaggaaggaaccagaacaccagttatgtcccaattttggatgtcatatattgttacttttaccatgctatatctattagaaatgcatactgagtccaggtccacactcagagggaagggaattaaactctatgtcctgaagggagaaagatcaaataatttgtggatatatttcaaaaccaccacactatgtcatcaaagaaggcgttgtatattcatgattcagttttaaggtggtttgggtaaagttaatagcacagttgatccatattcccaggtactggtgatttccatctgaagagaacaagatgaggctttgtcactctcaccccagactatcctccaacatcctttaatcacctttaagggggccaaggcatttcttttttttttttttttttttttttttttttgagacagagtctcactctgtcactggggctggagtgcagtggcgtgatctcgactcactgcaacctytgcctccgggttcaagcaattcttctgcctcagcctcctgagtagctgggattacaggtgcccgccactatgcccagctaattttttgtgtttttagtagagacgggatttcaccatgtagaccaggctggtctcaaactcctgacctcatgatccacctgcctcggcctcctaaagtgctgggattacaggcgtgagccaccgcacctggctgggccgaggcatgtgtgtgtgtgtgtgtgtgtgtgtgtgtgtgtgtaagttttttcatgaattcaaaacatagccaaatggttttgaatatatagaatttatatttgcactgctgataatagcttgtaataaagctgtggaactatactgtttattgttgccccaacatgacagtgctggtgaggaggaaacaaagactggaggatgtaatctaccccatagatgagctccttgaggatatggctgcatgttaatgttccagcgcagtgattggcacataggggctataaagaartatctgttgaatggatgaatgaatgaatgaatgaatgagtggagactcatggaatttaacttggacaggcaggttctaactgttgctgtaggcctaggaataccatgttcaaagtatggaagattggagcattggtaagaatgagctcttgaattctaaggyagtgctatctctagtctctttagtgttttctgccaggttggaagagtctttgcatgtcaagcatatgtttgccttcaaaaacaaaggtgaaagctggttgggattgcttgcttttagtgaagaccaaggcaaagaactctatctcctgggtactctctgtagatggtgggaaaaaggaagagaatgtatcaggtagcttttgctctgtgacagacaactacaaaaccttggtagtatattaacaagcagtgctcactgcccatgcatatgggctcagccatcagttaggtggctctgctgatcttagctgagcttgttcacgtatttgaggtrggctttgctccgtgactttcccatattgtagcagtgtagcttgggcatgtttttagagcattggaggaggcatgagagacaagctcaattctacaggtgattttcaagcctgttcagcaagcaatctactggccaaacatcccatggctgagcccattgtcaaagagggagggcactgaatagctccatggcacaggggggcgtgaagaatcggaacattttttacaatctattacaggaagccaaagaaatagctagtttttctctgtttaagaagggttcacacacattgcctttaaaaggacagatagtaaatattttagactttggggccacgtacaggccctgttctatattctttttttacttcttttccttttcttattatcctttttcttttaataatcctttaaaaatgtaaaaaaacagagatattcttagcttccaggctgtataaaaatagaccgcatgccacatttggcccgtgagccgtagtttgttcatccctagtttaagaagaaaaaacatcttcatactaataataatatacaatattctgttggcaaaagacattttgatacctgtcatttaattgatcttcatagaagcctgattgttgaaggtggatatttctaatagctcccctttcatatggggagagatgggaacttatgtgatgaaactgggattcaggctgtagtagggccagggagggtcactgatgattacctgaggttgccctgccaaggacagctgcttgtgtcctctgcctctgagaactaagcttccaggaggaccaccggtagtagggagtgcattcagctccatcctcctgagaacatacactctgcaagtggagagaagccatctcattatgttaatttcaacccagcccagactgagaggaggctgatttcaagggcaaagaaggtgaggcagccgattcccaggtcccatttcccttgctccacttcattaacrtggccacccttaatgcgtgtcataactctgccttccagcaagatttcctctccactaagaaccttttagaaatggtatttaagagaatgtgcataaaacaagtcttcatggtgattatgacatttctsctgaaccaaaatgtaatcagtacacacattttgcatccttacacttaatccacaaacatagcttttactgttttaccttctcccacccacaatccaaacagtgccacagaacaaacgtaacaggatattaagataatctcttttgtctatgccaaatgtcatttagctgttgagagaggaatgtcccatctagkttttacaaacaataaataatacagcttatgaaggtccacatgggtgacactgatgcaatgtttcaacagttttccgaaaaaggaaaataaaatgagtcatccaattagttggctgggcatttgcctgcaagttgccagagagctttgttgatttatcccaacttggctaagattggcttactctagaagttcgcctgttacagaagtttggtctttactagggtgacacaaagtatattttatggatattagttcatcaggatgctgagaagggttatagcatcaaagacaaatatggctgaacatattggggatcatttaggttaaagaaatttaaatgaatttttcctgcgggacttctcaraggctttaatctgtgaatgtgcatactgaatttccaagaagggtttagaatgtgcagcagtttccaaatctacttgacctgggaacccttttgttcacagggcatcccatgagagaacactttaaagaacagacgatgagaatcagtaccatgcgtaaaacgtgaccaacgttctatgcagaggagatttttgaaagtatccccaccagtgaagagttaccgtgtatgtgtataatgtacataagtggacattagcttgtattttcaaataataaagtcaaactttattattaaggaagatacaagaattagggctagtaagtgtgtgtgtgtgtgtgtgtgtgtctgtgtgtctttctatgtgtaaatgtccatccccagggattaagaagtctggatttgggttaaacttaatcatttctaagaatctgaggttttcagtcctgtcctagaatttcaaaaacagtcagagaaagcaactgtgagaagatcacagcttctcatcctgttttgagtctcaccctcctctttgccctcacraaggatttcagtgattatgttcctgacaggatgcattttaattgttttctggtatgacttcccaatacatcaagttgtgttttctatatagccgctatcccaaatgattactattcagaacactaatctgatctctaaatctacaaagaaaaggccatgtaatttgcttctctttacagtgcattacgtgcaccattgtaagtgctgggaaccccccccctcccaccccgccccgggcatctccaaactgctgtcctgtggatagccccagttgcatgtgctcaaaagcaaacttcttatctcctccatgagtcagttcctcttcctgtttttttctctcattgcagctaatgacattaccatcccctcaatgtccaaagttagaaacttctgagtaattttttatttctttctcttcctcaccttctactaatattagctgttaaatcctgttgatgctacctctgaaatatttctcaaatccacatctcctttcaaccttgggcatggccctagttcaaggtcctatttttcttagatggaccacggggtccttttgccatgatctctttttccatccaacttataatttttctacaactttgacttccatcctgattactaagacttttaacatttctgtgtgctccttcttctctgggtgtttgacatgcattgtcattctgtcttctgattgcaagtgatagaaacctactccagactagctttcagggaaaagaaaggaggtgtttagtagattgcacaactggcaaacctggagttgatttagctttcatgaaggctagaccttagacttgtcatcaggaatatgtcctatttgctttttctgtcagcagtccttcctttttttttggctgtgctctgtgatcacatgtctcattgtggtgataacgtggcttccagcagcaatcccagactcacagcccatcctcagcatttccagtggagagaagtgttctctcttcctaacactttccatacaaatcttagaaataaattttattggctcttaacatgtcacgtgcccatccttcaaccatttgctatgaacaaggggacaggatgctctgattagccaggacttagtcacctcccctcttctgaagacacagaagttgggacttcatctctacccagccacgtggacttagaatacaggatgggtgggtgcagtttccccgaggaaattggagggctgttcttggagcaaggacatgaataagcggcttacaaagagcaaataatcgttgcttatggcactcaaggtgttctgtcaccccatccaactcacctttcccacttggccttctgtccttgaatgcgaagaaccagagtcccctgctctaaatggctccttttctgtgtgtgctgcgtgtttgctctgctgctgagatccatgcttttcccttgcctgaaacaccctctgtggctgttgcagatgtgttcactctgtaaacgcagctcaaatgccttccaccccaaaaagcctccttaaacttgcccctgctcctctgtgtgaataattttcacagcacatgatctacacttccatcatggttcttgaaatacatgaaatacctaatcataggataggtttcatatgatcccacctcccctgctagacactgacagtgtgacagcagggccmctgtcttgttcgtctcagtgctccccagggcccacatgcagtaccttgtacacagtgcaggcaccataaatacctrttgattgattctggacttgccattcattaagagaagttaatggaggttttctgattcccatcagatgaacaattttggaatgttttatcagtcaaatttctaagaatcaataaaacttccatttggattattctttcccccactcaaattgtattttaaaaatagttttattgtaattgtccccctcaattctgacaatgtgtaagcattgcagaaaatttgtgaatataaaagtatgaagatgatcaaaagcttcttcctgactgatggccattgcatgtatgatttcctctgcctggaaccctgtggcccccagggttcagctccctggtgcctcatcaggcacagcttagtgtgagcttcacctttgtctctagatcttcctgtgcatttagatttttaaaaaatctggtgtatcccctcattggttggctatgaagtaagctccctgtgtgcagggacctttttttagcttggtgagggtgtatcctctccactgctggagctgtggtcagcacacagccagtgagtgctctacaaacacttacagcatcagttcatgaatgcttgcaaacatgcagaggttaccattgcttatasttttttttgttttgttccacttatataaaccacttatatattcagatatttgtgtatatatgcatatatatgtatttatgcacacataaacatactacacacactggatgtatactacacacacacacacacacacacacaatgttataaggtgtatgtaacacactcagggctgccccacagcctctcagtgccctacttatgttccgtccccccaccattccttctggcagcttctcactgtgaaccctgagatgttctgcctgagtgcttgttctagctgctggagcatggcaggccagaagtgctggagaactcgtacccccaggatcagctctcaaccagggatgaatacagatggaggataaatttccccactcccttgcccctttggagatgtattygacaccatttctcagagtctccagggagaatgagctccagtagcccacagtggtacctggactgataatgctttactggctttcttttcatatcactgcctcctggaaccacctcctaaataagctacttacattcgagaactaattccaataatacgctacttaagacaagggagaatggtagaaacaggtttctatacttcacaaaaatgagcttttgctcttcagaaatcacagccaatagattgtgccttctggctgccccctctgctaatgccccctctttgccccctgaacaagggcacccatgtacaacaatgtgtatatacttccttaggaagctggtcattcagagccccgtcagtgacacctgcactcagaatgtaatcctacccagcttcgggggctccaggaattcctgtggcatccgtgttatagactcctttgcattcagctttgcttttatctgtttccaatttgtgttttcaaggcttcggtttttctcctttctgcttcatctccagcccctcctttgcaacagtaccaaataaaaaaacccatgacactgccacagctgaaaaagcctttgaaaaaggcaggtggcgtggcttgaatgtttctaaactctaaaactgcaagccacagacaaataaagaaagaggtgggggtgggcatggggggttgtagtcttgtggaagcaatcctcagccttcagcaggctctaggggcacactgcctctagcatgttttgagcacgttgatttgggcatctgtcttgctgaatttgagtttgaattatggatgttacagaatgaatcattaaggctgtgtccacccggattgctctggctctctggcctgttcacagtgctgttcaattttatgtaagcattacttcaacatttttggtggatgttcttcatttattcattcattcagtatgcactgatggtgactctaagtcttgggactgcaaagatgtctgaggcccattctttactcctccacatctcaagacctaagggagatagacaggcaaatcaataaccacagtgccttgctattgktgctgtccaaggtgggtgctgtgaagaagtgcttaagggcaagtgctgcagaggcaggcacacctggggtccttttcctggcctggggggtccaggaaggtttcccagaggaagaagcagggctcagtcatcaagagctaaggatatgccgtcaaatagccctggcttattagaatctgctttgcactaagcctcctgaatacttaatttccccaagcctcagtttcctggtctgctaagtggccagaataatatttacatcgtggatttgtatgaaataaatakgataatgcatgaaccatgcttagcgtgagccataacacgcaaaagcaacataatcagtgtttgttaattktaacaaatcaagcccgggatattgacagacacctaaggcagacttgggagacaatgtctcttgctgctgcctcatgaggaaggtgaatgaccatgcattgccactggacgggaaaataaacggtttcttctttttattcttgtagacaccagtgaggcctaccatatacctatgtcaaaacctgcaatttatcaaaaataaagcccgagatagtaacagtcttgctgaccacaaaggcaaaaggatccaggtaaacagattgcttccaggactattatttcatgatgagctttcaggtatatagcacatgagagggaggacaaggtgcggctgcacttcaagagaccacgttggacaggtgagatgtccaatatattcttacttaagatctgatttcttctccttctctccagcaagggatgcccagagatataacaattagaattcaatacgctaatacagtgtctcattagccaagccacacaatcgcctctagtggtccatatgcacgacaacccgggatcctagaaattagctcggcttcctgcatccgtccccatctgaatctttactcaactactttttgattgtgaagagccaagctcatttgagcagtaggaatttcatggggctggtgatcccaagactaattcaaaaattaataagtttcccattccttttcttatttatttttttggtagggacacatttcaccacacacgcctgcttctttcttgccagtatttcattcaaaactagtcctcaagttttgaaattttagagacttaaaaaaaatcaataatgctttaagaagattaagaggctgtgcttatgtcagccttagacaattctggakagaagatagacttgattgtgcttctcattttgtttatgatcctgcaatgtatcacgcattctctgccaagtgaattctgactgcatgaagaaggggtagatgcttttacaacaggtttagtcatctggcatattatttaatacaatcagtggtgttttccttcgtgagatgcagccttatatacaggctaggtgttaagtttatacccaggttatctacccttccccctcctgtcctctctcccaccctgtttttattctgtcttccctcccttcttcccttcttccttattctctctcttcctccctttcttcttcatcttcctgtcttcctcactcctcccttctctcctccccatcttctttccctttctttccgcctcccttctccctttttcgctccctctttcccttcacaaacatttattcaaaccctattatataccaggcacgatgcaaggcactggaaatacactgaacagggcagatgtggttcccgttacatgatgagtaacacaggtgataaataaacagttaacaagataagaaaaatggccagcgagtatttggaagaaatagacaagtgatagggaatggctttggggagaattatctgcatataaggataagggatgagacagactcagcagcygtttcatgccagggcagagtagaaggccgtggagctgctaggtggttggcctggagaaaaaacaaggagttttttctgcaaagtgctggtaggagtttacagttctctgtaatgttcagaaatgcagaggtcagcggaggtgggtggatcacctgagggtcaggagttggagaccagcctggccaacatggtgaaacccygtctctactaaaactaaaaaaaaaaaaaacattagccaggtgtggtggtgggtgcctgtaatcccagctacttggaaggctaagaaaggagaattggttgaacccaggagacggaggttgcggtsagctgagatcatgccgctgtactccagcctgggtgacagagcgagactctgtctcaaaaaaaaaataaaataaaaaagaagtatagaggtcatttttaatgtgagaatgttctcagtgaattaggtatatgtgcctgccacattttccaaaccaatgtttttacgaatattctagtttagccctctcttctagagttataaaattattctgccttcagttctacatttagggagtcctcttttaaggaaaggaaaaggatagttaaatcaggggctgtcacagaagcctcagattggaggacaaggcgtggaccatcccctgtttggcgggaaaatagctttagtcacaggcaggttgttttgcttcctaaagcgtaaagttggaaatgtgataatttcgtcaagtagttgatttagttgtaycaagcttaactaattaacaccaattccatgcttgattcttttctccattaactgaacaaaagccattgctaatgaggctatgtatacaaagccagctgactcattttgttatggagatttcaaagagaagggagttgtaaacatttgtagggaagagataggggtagacatgatcttacacatatttaacaacaggtgcaatacaggcactggccaatgagaatgagcaggggtataatggtgccaccagcacatacagaaggagtaagaagtatcctcaaggcacggagagatgatagggtgcagggcctttgcactgggcttattcacaggcaaaatatttttccttattttaaagaaatggaaagaagtcttcctagaagccagggtctgtgatasatgacagagtgaccatagcactcaggggtgcagagggtgtgtggattctgatgacagattgcctgtctgattttgcagaaktagctccaacatggttttggtaacacccgttgccctctttaagcttgatgtctctgttttcatgtaatttgcacaaagtaggcactcactaaatatttgtaggtgaagacgtgtatctcagcacaaagcagcctcttggactaccatctgtgtggtattcaaggttcttttggtttcagagaagaggaacacagtaaaatttacccaaagaaaggagcatatgtgtcggttagggaaagaccaagcttccataacaaagagactcccaaatccaatggcttgataagatgagcctttatgtcatgttttggtcccttggtgagaggcaccgactggcaggctggctttgccctgtgtaatcattccatctttttccttccagctgttgctcagacgtcaccttgggcatggtccttgtctgcatggttgaaggtggctcatgtgtatgtctgcttttcagtgcacgcatggaggcaaacatctgtcttttacattagagatgactccaatgttgcttacatcacactgttcgcatcccatttgctcaaatgtggtcatatgccacatacagctgtgagtgacgctgcgaaatctagctggctggctttgtggcatggcttgcattcttctgctgtgggagagaaggaggagagaatgggttttagtggacccacagggagttactataaaagtgcaaatagggcataaggggatgcaagaaacactgaacaaccaggcatcagagtgcaggagcctatggagttcagatgagagctctccttcgtgcttctctagctctcactctccatctctcacactttctctttttctgtgtgaagactccactgtctctgtctctccaccagcttcctctgatgtcctatcttggatctggccccagatagtatcctctactttcttgaccttgggttttccaaagccaactggtatcttcttacttgtctcttgattctaatttatctaaagggaagatctgattcgcccagctcaagatagtcagggtctaaaacaccatgaccactctaaaaagaggggactccgagtcagctgtctgcgcttatccaatcagatgacgctgggcaaatggagaagctgtcagttttctgagacacccctccccagactgacccaaacacaacttgcacagtgtgaatatcagagtactatgtgagaaagtactctgtggagctgaccagcatcagaaattctgctagggctctcttataaattgataacttgtttctcagtcttttatacatttggcaaccgtgaatctattctttagaaccagaagagtcctgagtgatgagttcatagattagagattctcatacttcacagttgagaagtggggacaggcccaagggtaagaatcagagtgagctgccagttacatcgctggtcagctcctctttcactgcagtagatacaatgaacataacaatggatataagctccaattctatccagttttccacgaatgaagatgagtctttgaatacgcccttagcagttctcaaaaaccaatcagcagaacaagtctggccagctcccactttacatggacattatcatcaaaagctattttaatcccaggaaccaagaaaaagaaaaaaattctgaacttgcaatttttttctgttttctgtttcatgccacaggaataatttttaagaaattctttaaaatagacccaattctatgtcttatttaaagcaacagatatgaagcagtctgtgtagcagacaaatttaatggttccaatcaggggcttggaattagactgcctaattttaaattctagctccatgcttgcaagggatgtaactctaggctggttactcagtctctctgatgtttctgttacttcatctgaaagtgtggataacactaataggtaccttgcgaggctgtggacaataaatgagataattcatgtcaagtatttggcccagcgactgcgacatagcaagtgttggctgaagataattattaggacttcacatgagcgttgttggaggagcttagcttgtttaacctggaatagaaaagatatggtaaagaggatgcaggagcttccatttagtatctacagggtgggccatcctgtttcctgtggcagagagagaagaggtagaaccaatagggaagaaatcataggcagacagatttcagatcaacaaagaaaggcaaaacagatagagctgtccaaagaaggaatgggtttgaaagaaataaagccccagaagggctctagatgaggatgtgaggttggataagctacataagggatgtcccaaagtcagaccatcttctgggcttgatagcatgggttaggatgggctgacaaagactgccttaaataaaagtatgcatacacacacacacactacacacacacatacacacaatacttatatgtaaatacatttaaatatattatatagatttaatatataatatatagttctatataaatatattttaaatttataaatttaatttataaattaaatttattatttatatattacattaatttatatttatattcataaatttatatataaatatatttatataaaatataaaatatattttatatgtttaattatatataataggtggaggcaggtggatcatgaggtcaggagatcgagaccatcgtggttaacatggtgaaaccccatctctactataaatacaaaaaattagctgcgcatggtggtgggtgctgtagtcccacctactcgggaggctgagacaggagaatggcgtgaacccaggagggcggagcttgcagtgagccgagatcgcgccactgcactccagcctgggtgacagagtgagactctgtctcaaaaaaaaaaaaaaaaaaawwatatatatatatatatatatatawaaatatatttctatatttataaaatatataaagtatatatgatatacaaatatatttacatataatataatcattttatttgatttaaaaatatacagtatatttatatatttgtatatttataaatgtattttatatattgtatgtttataaaatattagaaaaatatatttgtatatttataaaatatataaaartatatttatatacaaatataacctataagtatatatgtatgttttacatacacaaatacttttatacataaatgtgtacacatttcagaatcaaacagcccattataagcatatatgaaagaacagtttgatttggcatattttataaactgtcacctgattttttttttaccccaacattaaaaaaaaaagctagtgcataaacaaggtgcagaaagaagctagtcatccattcatctcttcttgtgccagtgttacaatatctagtagctgaaagtctgggccagtcatttgcccggaccgcattatgtctgaatacctcctggcagtttctacgtctttctcagggcttctaaataggaatgaacatgaaagggccgcgtggcagtgaccgcagtgtggaggttctartaatgactatgagggacacacagttttcaaggagatctaacagtgtttatgaaagattctgtttcatctcaccagtgaagagcccttcatcatctaccattctcttaaggatagagtcttagaatctccagtgatcctgcaggaccctcatcccgtggttttaaacctgtgttctccagaggtctagcattgagcggtggcacttgggattctggaatggggaggatgcaagaggaacacagtgaagtaaacagcttggactctggcccttcaagcatacttcatccactttcatctgttttaggcatgtgggttcaagaggtgatgccacttgaaaaaagattagagggttctgaaaaaatcaggtgtagaattaattccaacatagacctaccttcttattgcacagacaaagacaytgagatccagagacattgaggggctctcttgggctycyccaccttgtccaggggaaagtcaggactgggatccagcgtatagtcacttgctacggctattcccattatgttttgctgctgctgaaacactggaacacattstaaagttcagacactcaggaaataccccacggtgataaggacaaccggtgatgccgatgagttcccaccaggtgtcagtgcctcgaggacttgtttaatcttcacaacggtgctctgagttaggtgctcatattagttccatttaacagttggagaaaatgaggctcagggaaattaaatcacttgctccacatcacacagctactaggcagtcratgctggttttgaggctaggtgatctcagtccagaggcctcagccttaaccattctgctctctcgccttcctgcattttatactccatacttctcttgggagaaagatactatcatattatttcgtccaaacttaccatatcttaaaaaaaacttaccagcaaacaaatcatccaactgcctttcatctattgaatgttctacagacttaacrccattatctcgcatgaccttgatgaagatagtaaccctccctttatcaaaatggtcaatcttcattaatttattttactaattagttaaaggctggtgtaatttagagaaagtctaaattatagaatacattttattctgtcactttgaagcacaaacctccacaaagatttgtataaaaatgctcccttctgggactcacttcagtgatttgtagctaccattmatactgcctctatgtaaatgaaagggaggcataatatcagcaccttgcgtattcttctccatggtaataaatcgtgcctgataacctatgaaaatggcttcatttttctcttaccacgcctatcatggtggctttcaaactcactaccctgtgccccacctatcacacctgtcctttgtccctttctcacatggatgtctacaaaatgcagcagtaaagtgttccataatccacacttcagtctacataaatgtttaattcccctgccccttttgttttcgtcaggccccctgaagccgcasctgagatggctgactccctgaactcttcttatgttcttgactgttygcatagcctttcctgggattacctcccagttccaagtttgcccattctgcaggcagtcttcttgggttccagcttttctccaccatcagcttctcccctagggctcttattaactctccgctctctgggggccactctcattttcagcttcatgtggatcagtgattacttgtcctatctcctctcctagaacgtgagcttcatcaaggaatttctctctattgaccctcaggcatgagcacaatgtcctactccctgggtgcttagttaatgcttatggagtgaatagaaccccggcgtgtgtgtgtgtggtgtgtgtgtgtgtgtgtgtttagggaaggcaaaggacgtttggcaaaaaaacaagttacctgagggaatagcaactcgaagtcattgtccctcaatttgggatcccggtaccacccgcataagaatcttttggatgctgaataaacctgcagtttctccagcctggccaagacctatcaaagcagggttcctgggtatgaggtccaaggatctgcaacyggaacatgctctccaggcaattctatacacactggtatctaagaaccactgcgctsagaactaggatatccatcaagcctgatttgaagtacctgcatgagtcccagtgtcatgatgagatcaagagagcttctgtgtccttgaggggctggagtatgcgtccccctgaaaccctttccctgcctgcccccagcactgttgggtgtcccttctctgtgcttcctctgccaacactctgtgcggtgtttccgggagtcagaatgrcagggtggtcaagagtacggwctcagaggttgcagaaagataaaaagatgattgcattcatgattgttatgatgtcttgtacatagaatattgtcttatttgctctaagactccattaaaaagccagcaaaagcaaatgcataccagaaaaacagtggtgtgctctttgaatattaggtggcctagtgcatgtttcacctaggtctctgactaattctatgagcttgggcaaattatttagcttctttagggcttctgtatttgtgaaaaaaaaaamaaaaaaaaaaaaaggaaaacaatagtttccctttaacagggctattgtaggaatccagtgagatcatatcttggaagtgctcagctgagggcctgggcgggataagtactcaaatcatacccttaatatcattattcttttttgagatcaagtttcactcttgtcgcctaggctggagtgcatgttggccaggctggtctcacactcctgacctcaggtgattcacctgtctcggccttccaaagtgctggaattacaggtgtgagccactgtacctgaacaagtgggtgttgttttaagccactacatttgtggtcatttctcccagcagccacaggacactcatacgtccataaaggcagcttctctgctctttgatgcctctgactccacttaagccctcttccccagggctgaaccaacatacccgcttccaagtctattaagtattgaattgtgttcccccaaaagatatgttgaagtccaaatccccaggatctgtaaatgtaacactatttggcaacagggtctttgcagataatcaaataaaaatgaggtcattttggggaagaagctaatctactgttactgatgtccctgtaagaagaaaagagggtcgggcatggtggctcaggcctgtaatctcagcactttgagaggccgaggctggcagatcacctgaggttaggagttcaagacaagcctggccaccatagggaagccctgtctctactaaaaatatataaattagctgggtgtgttggcatacacctgtagtttcagctactcaggagcctgaggcaggagaatggcttaaactgggcaggtgctggttgcagtgagccgagatcaatccactgcactccagcctaggcgacagagcaagactccatctaaaaaaaaaaaaaaaaaaaaaaaaaagacwcaacgacacacagagaacttgtgtgatgatggaggcaaaaactggggtgacgcagctacaattcaagggacaccaaaactgccagcaatgaccagaagctaagagaacagcatgaaacagactgccatctagagccttcagaaaggacatgacttttctgacactttgatttcagactttttgcctccagaactgtgagcgatcacatttctcttgttttacaccagccartgtgtgatactttgttccagcatccgtaggaaactaatacaaagtcccaaactctttccactatgtctagatccaaagtcaccaagaggcctggcttggggcagcactgggaacttagacaggaccctagctaagttccattctgagttaataattgttattaactcactcagttcatgcccagttagcaagcatcatgaagcacattaagccaggatatggcctttctaaatgtcctgagtatcaggagaagctttttcacactgcaaaagccagtctaattctatgacttgcaggctgaaaatcaactatggctgcaaccaagtcacttagccatcatcagcgccaatcctgcagtgcttatagccaagtcagggcgtctgtttgttgagaggcaaaggcggccccgccccatgctctggtttctgcttgcaccttattaacgggtaatgaagagtaggttctgctttattgatsttgagaccagagctacgtgcgatgctgcctaagaaaagccgcaaaggattttatttgatttttgcacacagcaataatctccctcaccagattagctggtgaactggtgggcttttcaccttgaaattgttgatagggtagccaaacaggaatttctatatttgctaatccttcctcaaatacacatccccaccgtctgtgccctgtcaagtgggtacctgggaaatagcagagaccacactgtggaaggggagacactccagtgcaggaaagatcagaagaaagaggtgacaatgacatgcagcacgaagcagcgatgatggggttttttctttgcaaaattacaagccacagtctcacctcattcctacctgccttttttatttcccctgctctcaaaacatacctgactagaaaatccccagtccaactccaggaatgccctttcttctttagccacatcacagtgttaccagatgccttttatgagctctttggtagaaactaagccatgtgtcactactgggtgttgaaaactcaggagtcagcttccctgcagtctgctggcgctcagttctttggctctgcctaaagtcggataaggaaatgaccttccaggcatggtgagatgagtccttaggacacagaagggcaggctggcctggcctcaggagactgcaacagctgccagagagccatggcactcctcaatcccccgaggagcctggaaaagacttccctcttgggttcaggcatgtcctctgcttcctgcctttatggaaactggattttcgggaccttggaggacctcctatggggaatagaaactaacagcccatcccgagcctgcttttccatgggaaaggtggtgggaattctccatgtcacctttgcagagagagagagacaaacatggatccaaattagagatggcttcaggttctgacggattcatctctcccaattgcctttgtaacacatmtgctaaatttagataagtcacaaatagagccaaaagaaaatccagaagggagccacaaaaaattattaaacagttgtaaaagttggggattatgagtggaggaatcggggttatttatcctggaaaagagaaggctgaggagggacatataaagacttcatactagattaattatgtaaataagcagacacccagctggcatggaatttcaaccatttggcagggagagtgggtattaaggggggtgactagttgttttaaaatcattagttgcctgcacaggtttctggaggggttcactgttgctgagtaatacaagttatgaatatgccaggtctgttttaatgagcccagacttcacccaccaaaaatcctttccagccaagcacgtgataactatagatcttctttgtcctttgcctcaagcagaagccttacacgggtccstcgtaagatgcacctctagggctcattccttcttcaagtcccggtgtagagtttggtgttagaagggacaattagagacttagagattccttcgtccagacaggaagatgctggaaggagtgccttttggggaatgagctgagcttggccagatgctgcagttgtgtccccttgctgaagttagtcacacttggctgctggagaagtctgcccaggtgcacttcataaccacactgccatcttctgcctttcattcaacaggacatgaattgagcacaggctggtcctcctgagccctggcccaacaaggctcctgaacctgggcccagagatgcataagaggatgccaaatcacataaaaaataagggtatggtgaaatcccatctctactaaaaatacaaaaaattaataaggtgtggtggtgckcagctgtaatcctagctactccagaggctgaggcaggagaatcgcttgaaaccaggaggcggaggttgcagtggattgagatcacaccactgcactccagcctgggcgacagagtgagactttgcctaaaaaaaaaaaaaaaaaragmgcccccccactcatccacacttactctcttacaatcctggaaggcaacttgtttcaatgggctagaggcaagttgttggctagaggagattccattgctggactcttttagatcctggtggttcccgacattccttagcttatagccacatcagtctagtccctggctccgtggtcccatgaccttttgtgtccaatattcctctgcccccctcttatgaaggaatttgggattctatttagtggctacccagataatccaaaataatctcttcatttggaaatcattaattwggccacatctgcaatgtctttaccacaaaagttaatatwgatgagttctagggattaggatttggtacctttggggatcattattcagcctactgtagtaggggttcatcagttagtggggggaagtagccagtttattcccaaaatgcatgtgtcatcacaaaccaagatgagtttcctaaaagaaaataagatactactgcgaatgtcacccaatgagacctgacccattctgtgtgtgcagggatgctgttttagttgggttcccacagaagcagaccctgcaacgatgatttgtgtgcaaggtgtttatttgagaggtgatctcaggaaaccggtaaggcagtgggggaagtgagacagggaagaaagggcagccagtgatgggagttgctttcaagcagttgcttgttcttatgggcagctggagctgaatcccactggggactctgggagacaatgaaaaccacatctcatagttatccccactgaggaatgagggacctggkgtatttatctaccaactccccttctattattggttgagtccctcttctgaygagtcacaggtattccyagtaagcagcctctgtagggcacaggtgagtgatgatgggattcaccgstgacagctctgctgtagatttccccgggcaggtgacctctgaactgccacctgwagtagaagtaggaagtaaccagcaactggggtggggatggtgaagaagaaggagaaagtgttaaggaaggaaacagaaagtgccaagccctgaggtaggtggggcacagtgtagtgttgtattagtccattttcacgctgctgataaagatatatctaagactgggcaatttayaaaagaggtttaacagactcacagtgctggggaggcctggcaatcatggtggaaggtgaaaggcacatctcacatggcrgcagacaagagaagagaactcgtgcagggaaactcccctttataaacatcatcagatctcgtgagacgatcacaagaacagcatgggaaagacccagccccatgaatgaattatctcccaccaggtccctcccaaaacacgtgggaattatgggagctacaattcaagatgaaatttggatggggacacagctaaatcatatcaagtgtccagagtgaaaggagttgagatggaacagcatctcaccagacctgagagccatttggtgcgtgttggatgcatgtggtccgtatctgttctggttgattgatgcctgtgccttgacatttgttcaatattttgaatatccttcacactgaggtcaatatctctttccctgggtggttatgagccttaaatcagctatgccatgtgaaagttatttgcagtttgtgaagtcctgtggaaaggttgttgctgtttttctgctggggctgttttaagatgaaacatggtatggggraaagatgcaagctctgggtcccattctcaggagtttccacgagcaggaacctcacatcactgccattggcctgtaatataattttggcctgagtctatctgggacaggtggtgtggagatgcactgttactaaagacttaaagcttggaacttaaaagtctacattttctttggagtcaggtggtcctgtgtgcaagtcccagttccaggcccttccactggctgtccaatggcttggagtctgaggctcagttttcccacttgcagaaggaaggaatgatgccaacttcgtaagttacatgagatgtgaaggcagtgatggaagkggagctggggctccttccccctctgttttaagcatttgattaaaacaagttaggatgggcgcagtggcttgtgtctgtaatcccagcactttgacaagccaaggtgggtggatcacctgaggtcaggagtttgagaccagcctggccaaggtggtgaaaccccgtctctactgaaaatacaaaatttatctgggtgtggtggtgggtgtctataatcccggctactcgggaggctgaaacaggagaatcacttaaacctgggaggcagaggttgcagtgagccaagatcacgccactgcactccagcctgggcaacagagagagactctgtctcaaaaaaaaaaaaaaaaaaaaaggtcttactgtaccatatgtcctcacttaacttcattgctaggttcttgaaaactgtgactttcagggaaatgaaatataatgaaagcaattttactgtatgctaaatggtataaacaagagttaaattcttacggcacgttcctggtcacaaaaacattaccaaacttcttaataaagacccaaaacacttctaatattaaacattgaaataaagatgagctatacatacatttaagaaagatgaataaaaacaagtaagataatcgtttgctcaatttttggtgaatcagtgagtgacggtggtcgtagtggtggtgggttaaatcaaggaataaaggtttgcaaagcgaaaattgtcaggggcacctcctgccaccgtgcagtttgaaaacaaacaattccaactaatggcagactgactgagtgctttcttactgcattgttttttattgtgcatttttatgattattatacacagtacttcatgagtttttgttttacaatacttcgtattaattaattcaccttccaaattgcttagtctataatagtttagggtcttgggtggccaaagcctctgctagcacagggtaggaactgaccctggacaggacatcattccatcgcagggcacacttacacccacgctcacactcactcatactggggcaatttagatgtgacagttcacttcacatgcacaactttgggatgtgggaggaaaccagaggacccggggaaaacccacacaaacatggggagaatgtacaaactccacacacagggtggtstgggccaagagttagtgtttttttttttctcatcaacattataataaaacaacattgaagaaaacagcattatatgatgtctggatgtatttattgttcatgatggccaggtcttcctgcattgttgtttgagtcagtcacagtgagttggcattgctasaagtcactgagcaaaaggccctcgcctggctcattcgccaatgagtctcctgtgcctgaaacaaagcttggtaaatagtagatgctcagtaaatactaactgaataaatgagtgagtgaggtttactggagaagggatcaagaacctgaattgatttagctctccccacatgattatgggatgaagccatgataattactggcacaaaacattcattttatacataatggaagtataaccagggatgcaaagtgatttgctccaagggtgctcagttaatttattcaatgaccagtcattcctctccttgatttaacaaacattcattgagcacctacagtgttgctgatgatattaaaacctcagtttctatcaaaaagcataagacattgcccccacccttgataagccatgacttggtagtgggttcacatacataaacaaaggatcatattgcaatgtaccatgatctagtatttacacacatgatgtgctgaaggaatacagatgaaggaacatcaattctgccttggggcccaaagaaaccagttgggaaagttatatttaggatgagtgagggacacggaggttcagaggtcctcaggcagttaaagagggagtagggtagaaggtgcaggatagrtatgggcacatggaaggtcatggaactggccagtcacccagtgaggctagagtggaacactgctcacgtaggcaggaagaaaggtactccaggtagaagtaacagcaaagtcaaagaaagcagtcggcaaagagatttgtaagtttgaagaattaaaagatgaaccataggaatgaaggagagtgtggcaagaaatgtactttgacagagagaacttgtgccaggtcattctggtctttgtaggccatgatagagagttcagattttgttctaaatacartcaaagccattaggaattgtaggcactgtacttccagtgagctaagttttggggtcagtctggtcactgtgatggagcagagagggcagggaggagagtcatcaggaggctgtaggtgcagaccaggggaaatgccagttagactacactatgctgtggcrgtgggaatggaaggacctgatgtgctttcctgaaatgtagttggggcgtgtcacatgcttgagttctgtgtccctaccctctctcactgacccatagtcggacagaccacactgccactgggcccatcgggaggcagggatgggattcaaggaagacttgttggtttggatggaaacacaacagagtatagaataaactttttttcaaatgttgtttcaatttaattcagtaagcattggagatgtattttcatcagaaccctctcaattttaaggggttaatgtctaaytcaaatgggaaatgtatagttcacttaactgaaaaggtccagggagttgagttttaggcaaaactgaatacaggggcttgaatcttgttaaatggtttctctccatctcttggctctacttttttctatggtgacttcactctcaggcagggtcttccsatgtgataccggctattggcagactcagatctgtagccttataatttcacaaccccagcagagagagagagggctgctattactgaacagtccttgcagagggctggcaatgatttgcccagtttgggtcccatgaacacggtacaggtactgtgccagatgaactgctggaattggctacgctagggtcacatggccagctctgcagctggggatggagtcacccttattttcatggaccaagtatggagagtgaggtgatttcccaaagacccactaggacactggtatgtggagaacatgagagatggcaggtagacagaaggacaggtacctactacgagcacctgccattgtatgcaagctctgcctagttctcctgcaggaagttcaggagtgaataattcagttcctatccccaagatgctcacagggtaccagggatgcagatacatacatataagcctttttcacgtgagcccacctgtgaagagtgccctgatttgatggcatgtccagcaccaggaagctctgactgcttttactcaaatggcacctggggccaaggcacatgttttctcacatttctattttaagagtcaataaatcatttctggtaccttaactggatattaaatcagggtgtttttcttgtcccctaatacagggccaagatgtctaaagttgaccttcagtctagtccaacatctggaaatgagtactaaagccaccagcacagayaaaaatggagaacaggtggacctggggaacagtctggggaaggaggggttccacatgagaagttacctgcagggagcagttgggtggcttgagttccagcctgagaatgattgtaatgtatctccttaaatccgtgtatgtaggtggcactctgttcctccttatccttgtatttcatctgctctcagggctgtgtttctttgcttcttgtgggcttttgcttttcagttcagcacatatttattgaacctttttgtggggactggctagttattcaccagctctcttccttctttgtcttgggaacatagctaggttatattccccagcctcccttaagttctctgtgactggattctggtctgtgggatgtgggatgatgtaaagtccaccttacttcagcaaaacctcctgtgaagttctccatgcaaatttgccctattcctctgtctgccacctggaagaagaggatctggtgggggacagtggagccacaagatggaaagaggagtctaggttcctaaatgacagcaaggagttgtcaatcatccaaactcctgtgcaaatacaaaactccacaccagattgcgacaggagtgaaagataaatctttacaatgttcacttgttgaaattttggagttattttctttttgtttttgctttagaatatagaatttagcctaccttgagtaatcagagttaaaaaaaatataagaaattgtgccatgtgctaggttctcagtgttgagcaaagcaggtgctgctctggccttgatggagttttcagtcttacctgttattttttctattcccactcygtcttccactccttgcaggcaataacagatgatgttgggggcaatagtcttgaaataactctggtaagtgcccagcagagccagatgctgggctgagttttgaaaatgaacaacttcattggtactctctgagcctttcttggagtggggcttgtctgtgggtcacagcctgatcctttaggccttgtgaagcttgaaagatcctacaattgtgcagggtaaagaggttttttgttatatacacaaattgtactttttcttatttctcatttttgttctcagacaagtccttctaattagttagaatttcattaatccagtcatccttccatccatctatccatctatgcatccttccgtccatccatctatccatccatccatccatatatttattctttagaggtagttttattaataatagttgtcttttgtcaaatgctcatttgccaggtgccatgctattgatatgactagtcctttttaattcaaatgacagtcctacaaggcaggtgccatgattatcacttaataaatgataaactgaggccttgagacatttcttcagagtatgatcccatatatgttttggtagagcctagattcatagtcatgatgctgtccttcattctacatttattgggatgccctcaaatgccatgtctgatggaggcatccccacctagagtagctgacttgaaggagttcacactgtatgtgtgtgcacatgtgtgaagatggatagtcaaaagagactgtcatgtaaacaagtaatgcaattggaaaggtgctgtgcaaagtagctgagagaatcacagggccctrtgagagactggaaggcacccagatgatccaaggtgatggccaaacctacaaacaggggagccagggacaagagcagggatgattgaatctagagtcagactgatcgtacaccctcartcttccagttggatgtccttggctgggtcagccattctctctgtgactcagcttccccacctataaaatcaggataatttagctcatacttaaagggtagttttaaagattaaataagatggcttcttaaggattaactgagataatacattttaaatagggcttggcaatactaagttcttgataaatattagcttattttgtgataatgatggtcatggtgatggtgatgatggtgttgatggttgtgcggatggtgatggtgatgttgatggtcatggtgatggtgatgatgacagttgtgctaatggcgatgatgatgatttggaactagaatcaaaagaatgttttcctgctgtttccctcattgcaaataacgtacatatgtctctttccccatactcgttattgtctctcaagttctgaattgtcccagctctatcaccaaaccaggtttgtggccttgggcagagcataaaagatgtcttggcttattgttctctctatagtgagggagaatagtgggttctggagctggactgtctggcttacaagctagctccaccacttagcagcaggatacccttgaggaagtcatgcaactcctcagagccccagctttctcatctgaaaaatggggatgaaaatagtaactgccacatttaggtgttttaaggaatggtaaaatgatctgcataaaactataagcctcattcctggcacatggtgacctcttaatgaatgctagatatcctcattttgaaattaagaggtgccttcaactttacttggtggcttttctctatacattgtacctttatttttactttggaaagttgtatgcagtgccccraatgctgacttgtaaactgatttsaacaccatcctcattccttttggctctctgagaaatgttcttttttaatgaatatgatagcaagacttacttattaccaggttatttcaggcaagagtgatttttaactcattaaccagataattattgcagttctccagttacctttctgttcatagacttaataaggcctgaggttatgtggcagagttttcttggctaagatgggagaattattaaagctctcaggtgaaggtgtgaaacctttggtgcacagagggtggccgtgccattcaagcagtccgtgatggtgagagggagctcagctgcttagggaactggtacagggtttcattaatcatgggacatttctggtgtacttgaaaatgttagttttacttatgggaaagatatccagacgtaaatgtgtgtgtgctgtgtgcatgtgcgcacggtaggttatacagcaccaaggggtcaaatagactggttgactgtatcctgtagtggtttggagcaggtgttggcaaacttttcctgtaaagtaaatattttagccttggcaagctataagatcttcatcacagctactcaattcagccaatatagtataaaagcagcaagaagatacatataagtgaggatgtgactgtgttccaacaaaactttattgtggacattgcagctggaatttcatataattttcatggaccacaaactgttaytttcttttgacatttttctactgtttacaagataaaaaccattcttttctcatgagctgttcaaaaacaggtggtaggtgggatcttgctggtgggctgttgtttgctgacctctggattacagtctgcatctgttgcagcttatttcaagcaccgcttgtttcattatttactttatcgccttgggcacactccataagtagtcagtgcctcagtctcctcttctgcaaaagagaaatcagagacttcctatgttggtagagaaaatttgtaagagttagcagagattaagtgccttaaacagtatctggtgcgtagcacccccttgagaaatactagcttttattgttttcattgaattactgtctcatggaattcttacaactacatcatgaggaaaatagtattaatagtattatccccatttcccagatgaaaacactgaggcacagagctgtaktctgtctgaggccagagttagaccatgacttacttatttacacaaagcagcagggacctgtctttgatgatgaacaagtccaaattactacaaaactgcttttgttcttcttctaatgaagtgcccaggattcccatccatcagaaattgcctgtgcctattagaaactgtcatttggcaaggggatgagggcggcggcggtggtggggttacaagatgcgcaggtggtatagggaaggagtggcaaatcaaatgacagcaacagagcagccgttactgcattttatttttttggcattttcttccattgttctcctttgtggacacactctggtgtttgcactgggggcatccctgttgtatttgtaaatccctggaggttgcagttgtaaaatgtgcctttatcctctcccattgcattttttttcctctctaatgcaccaaattagaagattgactgattttcgttttccctggaaggtaaaatttcagcttaaatcacaaatgtctgtgatgcacttagcagccaccgcagcttctaaccagtaaccattcctccttattccctctctacccaggagaatattcaggtctattgtgatttcgagatgcattagccgcacttagagttaaggatcaactttggcttctgtggaagctgctgagatttaaagggtaagagctcatcccatttagaacatggtgtattctttccctccttgctcatatcatttatgaaaggataaaagactggagaaagtgtcagagtagattctggaggtacttatattgctaggacaaaaaaaagaaatcacattaccagtagctggcttagttctgcatgttactatgtgatcagtttccaaagttcttcgtcttggaagacaggcagccccaacctaygggaatctgctcaccctacaatggtgagcagacccactccacccatctttgccattcaagtctacagcatttgaacagatcagcccgttctgtgtcaagaaactccttatgcatgttctggacacagccctgtgtctctgcaggttcaaattcccctgaatgagagaaaagttagaatcttcccttcgtatctcagcttctctactcattactcaaacccttgggaaagctgctctattacttattatgtctgcttcctctggaaaatggcagggtaatatgaataccttatttatagggctgctgtgagaatcaatatttgtaaaacacctggaagagagcttgacacatacaaagcactccaaaaatgttctctggcattaaaaacatttgataatatgggctgggagggatcacactgcttctcagatgcaatccttcaatggcaccccatttcttgtaaaaataaatactaatctcctcaacctggcttacaaggccttgttcagtttacccttatgggcttgttctatccatccacttttcctccccagcgacacggtacaggcacacctcagagatattgcaggtttggttctagaccacagcaataaagtgaatattacaataaagagaggcatacaattttttttttgtttcccagtgcatataaataataaactacagttacgctgtagtctattaagtttgaaatagtattatgtctaaaacgtgtgcataccttaatttaaaaatactttattgctacaaaatatgaatgatcatttgagccttcagggagtcataatctttttgctgattgagggtcttgccttgatgtgacattgatggtttctggctgatcagggtgggggttgctgaaggctaaggtgaattggcagtttctaaaaagaagaccacaatgaagttgtctgcatcaactgactgtttcttttacaaaaactttctgtaaaaattttgtatagcwtgtgatgctgtttgatagcattttacccacagtagaacttctttcaaaattggagtctaccctctcaagccctgctactgctttrtcaactggtttargtactgttttaaatcttttgttgtcatttcaacaatgttcacagtatcttcccaaggaatagaatccatctcaagaaaccactttcttggctcatctataagaagcaactcctyatctgttcaagttttatcatgagatttcagcaattcagtcacatcttcargctctatttctaattatagttgtctttcrgtttccaccacatctgccgttacttcctctactgaagtcataaasccctgaaagtcatctatgaaggctagaatcaacttcttccaaactccttttaatgttgacactttgacctccttccatgaatcatgaatatttttaatggcttctagaatggtgaatccttttcagaaggttttcagttcactttgccccgatccatcagaggaattactatctctagcagcaacagccttacaaaatgttatttctttaataataagacttgaaagttgaagtcacttctagatccatgggctgcgcaatagatgttacattaacaggcatgaaaaaactagtctcgtacatctctattagagctcttgggtgaccagctgcattgtcaataggcagtgatattttggaaggaatttttttttttttctgagcagtaggtctcaacaatgggattaaaatattcagtaaagcatgctgtaaacagatgtgctgttakacaggctttttaaaagtagcactgcaagagtaatttaggatgattatttagggccctaggattttcagaatggtcaatgagcattggcttcaactaaaagtcactggctgtttagcccctaacaagagagtcagcctgtcctttgaagctttgaagccaggcagtgacttctctctatctaggcaattcctagatggcatcttcttccagtataaagatgttttatctacacgaaaaatctgtttagtgtagccacctttgtcgatgatcttagctagatcttctggaaaacttgttgcaactctctacatcagctcttgctgcttcatcttacactcttatgttatgaagaaagctttctttaaacctcatgaaccaaactctgctagctttcaacctttcttctgtagttccttacctctctcagccttcagaaaattgaagagtgttagggctctggattaggtgttggcttaagggaatgctgtggctggattgatcttctattcagaccacttagactttctccccatcagcaataggactgtcttacttttatatcatttgagttttcactggaatggcactttttatttcattcaagagctttcttttgcattcacaacttggttgattggcctaagaggcctagcttttggcyggtcttggctttcaacatactttcctcactaagaagcttaatcattctagcttttgatttaaagtgagaggtatgcaactcttccttttccttgagcatttagagaccattgtagggttattcattggccaaatttcattattatgtgtctcaggtaatagaaaggcctgaggaaagggagagagagggagaggaaaggctggttggtggagcagtaaggccatacacatacaacatttacctattamgttagccttcttgtatgggcatggtttgtggcatcccaaaacagttacaatagtaacatcaaagatcactgatcacagatcaccatgacagatatcataataatttgaaagtttgaaatattgcaggaaagaccaaaatgtgacacagacaagaagtgagcacattctgttggaaaaatgacaccaatacacttgctcaatgcagggttgccagaaaccttcaatttgtaaaatatgcagtatctgcaaaatgaaataaagtgaagcacaatcaaacaaggtacacctgatgtctttcagttggcttaaggtaataattgctgcagccagctcagtccagcccagatttgttacattttcatgaatttttcaaatgttttgttaaatacagctatcattaaaaattaaattgcatcaacttataattaagttatattaaaagaagggtaatatgggcacaaaactgaccatttcctgattattttactacattttactattttctatgcttatttagtcctrttrtttatgtatggtgaaatctatataatggggaacagctgctcatagctgccagcacttcattcagtgaagtcacattggcagcttgaagctggccatgccgggagtatttataygacaggaactggcaaacacctcagggctagatgtcttgtttttgaactagaatggcagtcagcaaacttttttctgtaaaaagctagaggagtatcctaggctttgtgggcaccgaaccctctgttgcaattactcaaccctgcagctgaagagtggaaaacagtcatagaatatacatatataaataaatgagtatggctgtgtttcaataaaactttatttaccaaaacaacaggctcacagtttgctgaactctagtctagacttacaaaagtgatagagaaaacataaagaatgcaaattaaattttaaaaatgtgttgattctggtagctgttacattgtatattgccccccagaacacaggacataktctttaaacatytgaaaagtattttgggattcagyaaagaagctgctcaagacattgacaaataagtgaaattctgacttaggtcattggtttattttcaatcttgcttgttcatttaaatggaaatggcaatcaacattgatatgggaaccacacttgctcatcagttctaactgtaagttggctacaagtgtaagagtttggaaaaaaatcaacaaaagcattctgtgagaatcaattggctgtgtgtacaatttacaatatagaaaattgtgtgttttattatttgtaaattatgtgttacttatctttgatatcagtgaaatacataatcaacatatatgtgcctggacatgcctatattggtttttgtgtagagccaattattaacattaccagaatatcactgcttgaatggggcatgttctctttagcttccaggcctttgagtggttcctccacctgaaacaatctcttcttccctttgcctacctaactcctccttctttratctgcagcttaaatgtgacttcttcaaaaaagacttctttgatcccttcagtaccaaatgagttcttccytttatgcacatttttccttgtgacacttgacttaattatagttaaatgatgaattatgtgctggcttattacttcctttttaccaaaagactgcacgcttccccaggtagataggtccatcttctttatcatcgtgtctttggagtcttacgcagtttgttgaaatattatgtttgtagctgaactgaattgtgatttaaaaaaaaataggtctgtatttaaaagttttagtgtcagctccatccagcccaagttaagtactaattcagcaagttagttaagtaataaatggctrtcaytcaactacaacatatttgaattcagttttgaggccccagtagttgctaaaaatcaatgcccactttctccaggtatagtaattatttctcatattgttattgactgtctctttaaagaccagccaggacaaatctatttctgaagctgttgtaaatgatttgaaacaggaagatgaatggaatggaatgagggttgtttaaaagagatttatccctmttattcttgctcaagaaatgagtggccagttgctaccagcctatcccaaaagccaagagataaaagccagcagcagttaattttctagtccgtgtgctagtgaccacagatatctaaccactgatttccaaaggcttactattattcakacatatttactatggtaaatagctcatgttttcaggaacactgaggatctgtttagtcactttggatttctggtttcatcaagagtttgtgtccgacatctggggatgagtgagggttccggatacccattacagaggaagagtctgatggggaaactagagggaattcctatctggaatttaaatttaagtttaggatctcagaaagacaaatggagttgaagctgtgtcaggcagaagagatatctccatttgtttttctgctttctcaacataaggcaaatgtcagtagtaaccaggtttattccacaggcatactctgcaatgtgtgggtaattgtgcctatcgattgtgacaaagtcttcaagcatgaggcagagaagtttgctatccaactggatgccctcaacaatgtttgcatctcaacaatgtgtcctcacattggctggctttacatatgcagacaagtgaggacatgcagaaaatcatttcactggtcctccccattgcattgtcgattgtgtggaggctaacatgtaaagttatcagcccagcagcagacacggagtgagttgtccataaatagtcattctaattgttctgtttttcttattataatttatttttgctatgtaaaaaaaaatcaaatgatctattgcgtgtatatgtgagtttttgtttaaaggcatatgacccaatttgtaaacatgatcattatcttctctgggaagaatactaaccaagggaaagagttcatgatttggctgtgtagagctctcattaagtgataggtgactggttctgtgctgagtgtttttcatcatcttgatcctatgagacattcaacattccatcttcatcttacaaatgagaaaactgaggcttagtgaggttctatagatgctcaaggtcacagacccaacaggtgactgagctggggtttaaatctcmagggggtcttttagtaaggcttatgcttttaagcaccaaactctaccaggatataaatggcaaaaggaactgcttaagatatgaagagaaaagaaacacactacttaacacaaaacaaaaactggataaaatacccagttgcctgaatatgtatgcacttattcttgcattcagcaaataagtacatagcacctatcatgaaccagtgactttgcttaggaacacaaagcaagcaaaatccctgcctygatggcacttacttcttagggaaaagagaggatgacagaactgtagagaaaacagagtataccagatagcaatgagggctgtggagaaaataaggtgggaaagagaactaatattggagctgggatttcagaaggaagaaagtgtttgagttgagacctgaaggaggtgcaggaaccacaggaccatctggggtcatggtcagcaacatggccaatgggccaactttggcccactacttgttttcatgaataaagttccattggatctcagccaggcccattagtttatgcactatctgtgtctgtttttgtgttcaaatggcagagttaagcagttgcaatcctgtggcccagaaaaacttaaatgtttactatttggccttttatagaaaaaaaaaatgtgtccacctacatctagaagaagagttttccagggagaggggacaggcagcacataggagtctcaggatgggaatatgcctagtgtgtttgaggaggcaggtgcgcctgcaacagaatgggcaaaggggtgagtggagggcagggcctgggcacgtgggggccactgtaggggagagagggaggattctgcagagtgttaacaggaggactctcgctctttgtgatacatccactgtcttaggttgaagaagcaactctgagatggagtttagcattcagggccaacacctatggaaagcaggggcaggaagcaggagtgagcagagggagaagtccagctatgatacagaccaatggcaaccttggccactctctaggagcttcagaattgaccctgtttggcccaagacagacaggcctttatactccagtgttgatcggtcattgaatataggtctttcaatggcaacaacagttacaaggaaggagcatcacctgggtgattgttgagaagctgagagccgagggctgcctgctgaccgcactcccagcagctggtgccatgggtcctgcattgaagtaggatcttgggggcacatcacaatgtccagcacatagaggatgyagggagtaacagctaaagcaagactaattaggaggctactccggaaatctaactgagagatgaaggtggcttgaaccaggaggtggccaagagttggcagactctctcttttgaaggtaaagctttcatatattctccatggcctaagatcaccttaaaggagcaaagtaaaaggaaacaagccaaggggaaaggcttcaaagattcagtctatgttattaaatctccccacccattgattatcatccatgacagtctttgcttagcttaggtttacctgtgctcatcattttccagggtgtacagaaggaacactatttaatcacaaacgttccaatcacaaatgcttcagtgacaggaatagaagctgtcacaccagacagggcagataagtccttgtcacatggctgggwctgtccctgcagtgactgtgctattcatagcaagaatgttgtgttgctaaacttggcatgaaacaatacagttatttatgcracttcatgrmctagagtatcgccttggatttgagattctgctaaagctacatgagtgggcaaatcaagaaattgtattccataatttgtttccaatctgacagagtactatgtgtaatagatgaataagcttatagattttagcacatttattgcagtgtgatgtggtttgacacagtgtctatgagctgtgtggggtgaaatggaaggtttaaatggattccagcttcattatcccactgtgatctgaggaaagcgagaccacaatgttgccatccagtaaagcactttatcacattccttcccaagttgaacagcagcgttctgccaaagaaaagctatttgctgggtagactctttagcaagtttcatttttaacttgggtgccaagccagccaatrgaatctaatgggytttgcttacaatgtgcatggcytggctatttacatgagattgacagcacgagaaaaaccagacgstatactcactaggctgatttagaggtttctctgctcatttgaattcagccaagctagtcagtctagccctgggaaaacctgcaagagtaaaaagagaaccaataaaagcgattcatgaaaaacctgaagtgcataagaaattaattcccctgagtttccaaactagtcagtaagctgcgctgaggttttgctttctatgtttctcctttgcttagggactggtcaaaatctcgaagccacttgttgatttttctctctttaaactgctttgatggaagaacacccagggtgtaatgggcacctgggtgggtggatgcctaactaaatatatttatataatccttgaaacatgtttaactctggaggttaaggaaggcccaaagacaaagcggagttgttaagggaagaaaaaaacagaacttcttaaaggttgacacggtgccactcattaattctagaaaagtttgcaggggctgttacatgtcagacrcaatgctagccttcccagatgcattgatgaacaagttgcaattcttgctgtggtgagctaatggtaaaaataaacagagcactgccacacacagacataagagccatggggcagcatcccattccaatgcctggtacatattaggaacccactaaatacttgttaaggttcattttgtgatggtatttttttcctctctccgctagcttaaatctgttcaagtctcccatggttaatacgataatttttctgatgtttatcaccaataaatttttagaaaaatcaggctacacagtcactctctccaccttcttaggatacactcactctcttaccctttcactccttcgggcaatttgatctgctatcttttcccaccactttaagagaaggactcttgatggggttcccacacctggtcagatggcctctcttggttgtcttcctcaatcctttcattgtgttgtagttgggcagttcctccacctttcacttctcagatgcagcataatcgtgtttcttcctcccctctgaatattccttttctgcctctctgcattccttttcctcttcccaacacctaagtgattcttaaaaatattctctgactttctrtgccttctcsatcagtgttagtttcaagttatcttgtcatagtttcatttaggagataatgcctgaatctttatcttaagccttgaaccctctagaacaatttcatttgtgtgctgggcacctggatgtcccaaaggcatgtgaactcatcatatcaggagtcaaactcattctgactaattttatttaatgctatttccattcacttggtcatccaggtggagacctgagggtcaagatggagccctctcccatgtctctctctttgctgctctcagatggacccaggggtcatgtgctgtcaactcatccatcactatatttttctcctttgcccttccatgttatttccatttcacccaccgttgtgtgataccacagcgtctgttttacctcccactgaacaaaagaaatataatccttgaaacrtgctccttagtgtggaagagaggggtggtctgatgacttgtttcaaaatgatctcaatatcaaccactgccccaacggtcttgcatttcatacttaagcaacatatttcaatgcagagaaggtttatagtgtggtggggatttgagggtagcttttcaattctgctctgtttgatttttsactgatgaccccagacacagagatttggcctggcagaacctgcccttagttctatagaggacaccttccccatacttttttctccttttcctcttcctctataaactctaggttctttcactgcatttcttttttgtaaacagctttactgaggtataattgacmtacaaaaaattgctccggtttaatgtatacagtgtgatgagtttggatatatacaagcactggtgaaaccatcagcttcataatcaaggcttccaatatcattcacctccaaacgtttccttatgcccctccagtgtttgttgatttgtttgtggtaagaacacccaccatgcaatctaccctcttaataaaatgtttaagtgcacaatgcagtactgtcaattacaggcgctgtgttgtacagcagacctctagagcttactgatcttgctaaactagccacttgtcacacattcgttaggtttcatgacagtctgtcctctgagatgggctaagagttagtctgctctcaaagagtttcttgcaagaatatgatgggtgctttgtggtgaaaagtgaaatagcaataaaaaaaatcagtcacttccattgtaaaaataaacgtaactgcatggccaatatgttattctaaaacagaagttggcttcttacctggctttaccgtgcacggaggactttaatttgtgttcctgtcaaactctaggaatgtgaaaatgtggaaagcccatcccaaacaaaaataagcctcttgccggagtcctcacstgaaatctctctcattctcacccattcacctttcaaatctgtgcttttagcacatcacctttctgccctaaaacgtttagtggctcacaagctagtttccaaattccttagcttagtagttagccctccgctaccttttcttaakgcacttttacacttttctccatgctgtaactaaacagcactacctactaaaatagaaagatacctttcaggttcctgacctcatgccagtatctaccatttccttttcctagaattctctctttctccttatttaaatcctrtgcawtctctagtgcatttgggggaaaatgtcatctctttctgtaggcattaactctctatgccctaaaatttcayataaccttggtggttccttttatctcacacatttcgcttatttctttgactaatgttattcatgaacatgtcttaccatttattctgctgcacctacaacccctggtggccagtggctgtcttactaacttttgtgttccctgtgcctcacacatcacagactttccagaaccttttagtggataaagttaatgcagaaatgagttaaatattcaaagaagcagtgagcaagatacgttttttattcttcctttcggaaatgaatccttgctcttccccacccctgggaactgtgccctggttatgattgagatctcatagtcactcatcattcattctttagttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggggctagatgtgagggaagagaagtttcctaccaagaatttccatttaaattcaaatttagaagctttcttagtccctgagtcttattccacttcagacttgttgaaattttcctcatgaaatatgctttagttgtcttggtaaattttaagagtgagagaagaccaagtaacagtttacaaaggtaagaatcatttaaacctacttactctccctgtttaagcaatgaggaggattctgtttatttatttttaaaaagtgttaagggaagaagtgctatttcaaattaaatgaagacacgggaatttgcctttaattatttaaaatagtttaaatcttgttgttcaaacaacaccttgtctctacaaaagaaaaaggaaaatacgatgacactcagactttgtcaactttttccaaatattagcaagttaaaaaaaactattggttctgaatggtgagataaatatatgccacctgtaatatttacctgaatagtatatattcagaatgcaatattgtgtaatctcttttaacttcaaaataacccttctttgccctgcaaagatacttgaactcttggtgttggctacctatgaaattatgtcaaacacatagattctacatctccagatattcaaaactaattatcccttaatttgcaagtgaaagcaaaataccacctaatagaccatttctctggtaaacctttctttatcttaatgagcagaatgtggacgcctattacaacctgattttaaaacctccgtgccactcaacagcttactcataagactgaccagaaggaggcaacaaagatgtaaatattcttatttacaatatggactgagctcatatctgtctatttagcattttattataatgcatgccatcccaacagaatcaatagttgattgatttcttatgtaagagacttgagtactttaattctggatggaaactcatcagcaacttccagttgatgagatgacgttctccatttggtgaaactgggctacatttaatcatcacaaacttcaaattgtattatcccactttccagataatgtacagcgtattagcccaacccgctttcttcagaagtgtctttaaacagagatgggctgtatctagataggggtggaatatgccagtgtatcggttagccgttcctataataatgctgcataacaagccatgctaaaattccatggcttacacattgctccataggctgaggggttggctgatctaggctgggctcagctgggcttgactccagactgtgggtttcattcaggtctgctccatggacgtctcattcttctgaggacagcgtgctccttcggaaacattcttttcctgatggagactgaaagtttccaggttagcatatagaaacacatgatgcttcttgaagtctaggtaggaactggtgctcagtcacttccacccactgggcaaagcaagtccaatatcaatgggggaacattctgtttggaagaacttcaaagcctcatagcaaaagcctccatatggggagtagtgaaaaattgggaaaaataatacattcgatcacagctgctttgttttagggtttatataaaagaaataactttaaaaggggttacctccttctcatgcctatatttttaaaagtaagtgtattactctacattgaataacccaagctaaaagtattttatagttaaccttgacctagtatacatactctctcactctcactctccccacacccccaaacccaacaatgaccacagatcttcctttccttccactttcacaacccaaaacttgtcctgttcattctctgctcaaaagcccatcagtgaatccctgttgccattgatatagctcaaaccctcggctagctttacaataaccttcacagtgtgtggtttgtctcttccatcattctgtgtgaatttacttgtctgtctttccacatgttatttcctttgctgggacactctcttttctctctcccacctgcctggtgaattgatgtttattcgtcagagcccagctcaaactttacaacgtctgcacatccttcactaatcccctgcaggcttttctgtttccttatctgtggtttacaagcattttatacatatggctataaagcacttataataatagactggaattagtcattcmtgcgccttttgctgctagcctgtgaaatccttgaagatgggggtccatgcctcattcattttctatcgttagcattcatctccatgcctgtaacatggtaggcttcaaataaggtggttggattgaaaagaaggagattttaaaaataagcatttaagaaataaaaaggagaaacagccatggcacaaacagttatgttcaacctcgccattaattaaagacactataaacaaataaaaattatagatcaatttttatttttcaaatagggaattatgtttttagaaagacaagacatagtattgaaaaaaacatggatatctggcattgccaactggagtctaactgacaactttcagggatttttatcatttctctttctcaagtacttaaatatattcatatgtgttgacccagaaatttgattttaaataatttatcaagtggaaataaagatgtgaaaaaattacataggattgctgattatagcatcatttatagtaggaaaaaattgaaacactctaaatttcttacaatatcagcccggttatataaaatcatggtgtagatataacattgggccaaaacgtctgccattattagaggcacagttaataaaatgggaaaaggtttaccatgtatgttccaacataagaaattaagagcacaagaaatgagaatcttgtaaaatataagggctattgttagttacatcccatgtacgccaaaaactgaatttgaaagaaatacaggaaaatattaatagtgattacatttggatgtaataatcacaggatgatcttatttttatttttttctttttgcctttctctagtttccaaattttctacaatgaacatacatagcatttatagtaaatgaaaagatctaaaaatattttaaagatataattatgatacagtaacttgtactgttaactgggcttgtgtgagctctaagttattgattatgtatagctctttatgtgagtttctgctacttttgagccttgacttgtttatctttagattgggttccatttctcttttgtaattaactaagaactgaaatgaattttctaaatagaattgttcttaatttaaatatgaaattctgttttctctaatgtaattgtacctgagtgaaagtaactgcaatgaggactataaaggaagataaagtaggaatatgatgtataatttccytttgcataattgtaactctgaagaacgcatgctcccagcagaaaagtaatttaaattatatcacaacaaatgccatattttaaaatagaaactatccatcatgtactgagtaaagctggtggcaacctatacatctcaaaaatatactgaaaatcyctccatgagtccattaaaaacaaattgattggtttaattccagcacatgctgaaggaaagtataagtgacattaatgtaattttaagtgcataaaattactaattacatatttagaaaaaaattatgtaagagaataaccatgagaaataatttttattataaaatattgaaatgtgtacaatgtgaacagaatagtataataaatcccatgtatgtagcgcccacaacaccttttatttctcagtacaatttttattttggaaatgatttttaaaaatgtagaacaatacttttgtctttatcttctgggcaaaaccagttttgaamaacagtgaacattttaataattgtagaccagtgctaatatgttttttgtttttgagacagggtctcgctctgctgcccaggctggagcgcggtggcactctctcagctcactgcagcctcagacttcccgggcttaggcgatcctcccacctcagccttttaggtagtggggcctacaggcgcagaccayggcacctggctaatttttgcatttttttrtagtgacagggtctcaccgtattgcccaggatagtctcaaacgatccactcacccacttcagcctcccaaaatggtgagattacaggcattagccactgcacccatctactaatacatattttgaaggcataatttgaaatctgttggaacaaatgctccagcaaagacattaaaatatatttttcacctagacagagaatagacatacctttcatgtacacaatttaaaatacagacccaacactcagcattcttttccttggtcagcataaagcgtgtgaatatggaaaacatgtcaagtgttgctygtcccccactgttaatgttttctcacattcctgtccagagatagttctctgcatcttttacattaaaaatcttgccataagtgtatttttaatacaaatattttctattttataaatatgacatagaaaaatttcaagctattcaggtgtatgtaattaaatttgattttttacaggaaattttgaaattgttatagtgattaattgatttgttcatctggcatgtattaggcacctactatataccaggtgctcttttagactttggagaaaacagtgaacaagatggataagggatcccatttttaaagcacaaagttttctccagctatttcttaatggagagattaaagaaatcttcgcctccaagaagtctggatctaagtcatctccctttacttgatcaggcccatttccaccccctagttcagttgacagagatmggatggcagcctctgccagcatgtttcaggatatacccaggaagcaaatacctggttggaataacaaagtccaaagcgaagcaagagggtgattgttaaatgagtaattagaataaacactgaaaaatgrtatctgcctgggcctctatttttctcgcttttgtagtcgtttttcataggttggacttcttgcccttcagagataatgaaccacaatatgcatctatctgtgggtagcagtagcttgagtttgggattgttcctcgggttcctagggatttttttgaaaaccaggagaggattttctgaacccaattggtccagttaatgtatctatacgtcttacttctctcttttccaggcataaatctcygggctggcttctagaataccaggtccctttcccctcagttcctgtgtatcctgtgttatagctccaagaaggagctataacagggttagaacaaagatctcccctccctactactcctggataaaaatcacagctaagctgtgacttttgagtgcttagcacatgctaggcactgcagtgaatacttctatacacatgatcgcatttaagctccaccacctatttcgagggctggatgaatttatgtttcttgtgctacatatgaggaaactgaggcacaaatagcctcggccatttgtacaaggtgcagagcctgtaaaatggcagcttggcagtgatacccagttgtatcactctaatccccagagcctgtggccaccatacagggctgcctctcacaacacacataaatagccatrtgtctcataggtagcattgacagagtcaattcttttccagtacggagagcggtgaattttgagaagtgactttttggcagaaatgcaatctagtgacaaatcagcaaaaggttagagttcagattaaaactcagaatctctgacttcagagtctacaagttaatctgtgacactttaaaggctctgggaaacaaaagaatactgttgaatctggttaccccctcagactcaggctgacttggagttgtgtgcgtggggcgatgccattccaatggtagccgctttgctttatggggttttaggaagaaatccaagcttcagtagcctttcccaaccgaatgcattattaaagatacaacgtgtaactcaggactgattttgacattttaaacatgatttttctccattaatagagtaccataaagtcagcagtaacaacattacagaaagctgagaaagaaaatacggtgaaaccccgtctctactaaaaatacaaaaaattagccgggcatggtggcgggckcctgtaaccccagctactcaggaggctgaggcaggagratcacttgaacacgggaggtggaggttgcagtgagccaagatcacgccactgaactccagcctgggtgacagagcgagactctgtctcaaaaaaaagtcttactgtaccatatgtatgtggttccatcatacatcatcgtaggtcatcgtcacctttttctcccttaggtataagccttttcttatgttattgtctcttttcataaataggatttttcatagtgacatacacatcattgaattaataaaccacaatttaagtaactatttccacattactgaatatttagcttgttcttttagtcccctccagtttgacactgcaaacaccaaatttggtcctctgttattttacttccagaaaataattttttagarctaagattaccaagtcactaatatttttgtggttcttaatggatatatattgccaactgcttttcaaaactattgttatatttaataccatcaaaatatatccaytcacaagtttaattacactgtcttcatcattagtcataacgttttaaaaacataattgccagcataagagggaatctatctatgtctttctatttctctctctmtatatatacatacattttatatacatataagcacacatcaaacatactatatactatatacatactatatattatatgcatggtgtgtgtgtgtttatatataaacacactgtttatatatatgtgtttatatataaacacactgtttatatatatgtgtttatatataaacayactgtatgtatgatgcatgtatatatacatattttaaayaatttctaagtcataytcaaatagagatgatagtactttgacatttctttaaaatctaggcaaacctgagatgcttttatcattgaaagtagaaggtgtccccattaytggcagggaaatagattccagaatttcatattctctccaggtcagccactacaaatgagaactgaagaattaatctaagacttttttcatttttaaaaatcgggttattactttagcagaaatatgactttatgccttcataactaattgtactaatttatgaataaagtacatttttatttaaaaaaccaagaggcatactagaagaaattaatccacttattttcttctcaagtaagtggtttacttaagcatacatatatatacaatttcattttcctaagacctagaaaaaattcccaaactgayttyttaaaatttttacttraaaaaaatttcagcttataaagaagttgcaagagtcgtaccatagttggaaatactstgaatcatttgctttgttttggtgtgatagagattttttgtaacgatcacttataatgtaactccctggaatattaaaacaattgttaaggacctgatgttgtgattagagcagccctgtttctttcgtttttatattcctgacagtgaaaattgctgtgcaaatagtagaaactcagaatgtgttgttgaattgaattgttagattgtcttagtcctcttctattcaggcattttctaagacaatgtgattgatacaaacaagtagaaaatatgctttctcaatacaatgagttttatttccagtgggactgtttaatcagaatgaaatgttgttgtaccatgatgactgccctgcccttagaagtcaattattttatgatggagaaaaaactgtggtccgtagatcagtagaatcagyatacctgggacctggttagaaattcataatctstagccaaaacctatggaattggaatctacaattagaagaccctcaggagtatgcacgttaaagtttgaggtgtttaaarttaaagtatgcactttaaagtttgaggtgygtttattcaggtagctttcctttcttctcatatagtttttaggtataaatgaaaggtctggattatttcacgtattggcagatgtgtatttattttttagtgcagtgcttctcaaagtatggtccctggaccagcagcatctgcattacctgagaacttatttgaaatgcaaattcttgggtccttcstcaggtccgaatcagaaactttggagaatggcactactgtttaacgagmccttcaagtaattctgatggctagagtttgaggaccactgctttaatgcttacgagagttgaattagttgtttaaacagaaatcttagaggctttgaatccacttacaaattagtcttttcaaaggtgtactttttaagtgtctgcataatgcgaatgttgtgaagtatgtcaactcttgggatttaggaatagcagagtattagtattcyagaggcaaaattgtaattggccttttcacttgcattttccccacaagtgacaaaaggctaaaattaacaatagaaaggcatttgtttacatccaggcaaccttcttttttaaaaaccaaggcacaattttagatagttgataatacctggaaaagcttgggctcaacttgaggaagtagattccattttacttttcctttatttcccagatacagagaaatccatgttaaatgccttccgtgggtccagaacttcttgcttgttctctttgcccccagtctcctatttgacagagcagctgcactataataaatgactccctggcatttcarcatcatagctggggactctgccaaagccctggccacgtctctgtagtgggacgtacaacaacgaagaaaagaggctggatccacaaaccccacaggaaattagtctcattattgcaactcaattcatgttcccatccagaagagggcttcattgcacatggcaattaatttactatgcagagtgtgttttgcttggtatcagcttttattctgacttccaggacaaaatggttgcctgagttcttaatcgtgtgtgtgatttgacagtcaagatgggctatgggaatcatctcttggtagtgtcatcagcagaaagaaaattcttttctgaattgagctttggttgtatgggatagatatctgttctgttggtggtggtggtkgtggtggttttgtgttttaatttttggattgtgacctcagtttgagtgagcaatgtgatgaagctgctaacaaaaaaatcaaagagaaaactctaaactctgttaataattgtacattgtaaggtagtaaggcatgttagcctcactgtgcttgtcacagatcagaatctacctagagarctgggrtacacgtagaagcccaagagtactagatgatctcctataaagagccaggatggtagaagacctgtggattggccttctgctatgtttctgtttcccagcatcttttccctcctgccactgcctattttaagcaattttacttgaactttcaaatatgtgccttggtcatcccaacagatacctgcacctagttggccaatcagatcactaattgtccrgtctcagcgattgatctagacacatttatgaccaatatatggcaratgagagttctttgggggaaattaatttgaatgttgcagagtgttggccttctcactcccctgaaatatgagttccaaagacaaggtgaatctggaattgtggggtccaatttttttttcaaatggacacagtgagttggataaaaagcccgacagagccaagaaatgsagagagaargagagagagagagacagagagagagaaggaggaaggtgggaagagagtgacagaccttacggtgttattcaaatccctggatccagctgtacctaaagcccataccttgagcttccccattacatgcaccaatatattatctgtttaatgagtttgtttgcattacattcaatgaggcttcacttacatagcccaggagtctcacttacgaggaatagtttgaagagagaggtaaccctgatggagaaaaaatgaagatttatcgtgacaggagtggggcaggaaaacccacttcccttcacatatctccaggttcggaactcatctattcctcctaacagtgctctgaagtattacctagcctgtgctacagatacaaaaactcaatgtaaggctctaacttgtttaaagtcacatacagagtgagagagctgggactggaacccatgttcatgcgattgttttaaataggtgtccctacttctgagtttccattgcattatgtatatattttccttgaacctccttaaacttaacgtattataaatgtttgtagagtctactaggctatgccttgacagtcattttttgcttccctcctttccttccttcctcacttgtttctttgcctccctcattttctcccttcttcctcctttcctttatgttcaccagcacctaacatacatttatgcctattggaggtgtcagtgatgttatttttgccaatgactgaatgaaagaaaaaaatgtataagttgaaggctcctgtctctagaaacatggaactaaaggcaagtcgatttttgtttaggcattatggggagggtattcctgggtggggccaaagatcagattaagaatcccccataaccctttaaagtcaacagtccatggaggagttgcaccaaaaagagactctccttctaaacatctgtgtgtgattcctggaggacataagttgagcggggtgcttttggaggttaactccaaaagcagcgatgcttcagagggcagcggttgtaaacagaaatcaggaagcagatggtgggggtatctgtggccagaaataagaatatctttattgctgagtaaataaacaagccacatcctgactaaatgggtggaaatttcctgaacatccaggaaggatgtctggtctttaatctgtttttggaaagtcaacctcagagcactaagcccaagtgtgtgcctctaccagcctcaatctttatcttgtgatttatcacccactctctccttctttagggagcttgttggttattctgcttatggactcacagaagagaacaattcttcctccctttgcccattcaattccaatctgaatgttagtaccagactaatgatctgacatagactgaagaaggttccaaggacttttctgaaagctgagcccatttttgttcaccattctcttaaagtctcaggtggagaaggaagaccttaaataatagcttttcttttataatgaaaggggaaaaatatctgaaagaatgcttccagctgatagaggttggacagaacagtaaggagaaattctctaagtccacctggagcttattaagattgaaaattgcaagagattggcttaagctgattttttttttcccaacagcctaggcaaagactctgatttccaattttctgttatggttgagtgcattcttccggcaaatatttagtaggcactcttaatgctaggactggtcacttaaaacaagtgtctttaaatattcttaatttagacacataatcttcaaaccacaacagtgatggaatgaaagctagtcatcagcagtttgcaaaaattatggcgctggtcctctccccagccaacttaactgggcttctaccatcctcctccttcctgatctttcttttctcttcytgagcatctwtccagttccctatttaatcatatgtaatcttcagtatgtgcttttatgtggaaagccagatgtgtaccagttgatgtcaccatgatggacaagaaaaagggaagcttacagagaagggcagattcatgggcttgcaacatgtacaattgcatagggccctgtgcttaacaggagggcccatgcgtgcgagttaatgctctgtcatcactaccctgaaattcttaatagatttttttttgtgttttgtaaatgaagyccaaaggaacaatggagcatgagctggggcttggagcctcacttcacagacagccccacctcctcctgcctcctcacttccctgggagaggtctttagccacctgatccctgaccttgccctacacaaggcacacactgacctcctactacagcacctcattgcaactagcatggaccagagctctggggcagggaggtttttgtcaggtgcatgtaacccacatgcagaattataggacagagccccaggttcctggaaaggtcagacttatccttcatatattccatgcctgagagagcacaatattaaatagcaaataaaaaacaccatgacagattgagagaaagaccatggaraacaggtaaaaaaaaaaaaaaaagttttgtctgctttttagacaagagatcgcacgttttcgttttgtacctagctctgcaaattatgttgcaggctctggttacatacagcctttagtttatcagcacacagtgttggtgagcggatgagaaatgtggatcctcccgcaggtgagtataaggatgtctgaatgtacagaaagcagcctgatgtaggccagccccatacttaactgacgaatttatcggttgtatctgtcttccagaaacatacaggctaaacgccaacaaacaatgaccatgtctaagcatctgaatattcctctaagaaatcaactgacaaatttgggggaaacaagatgatagctgaaattaacagaatatcccccaaagcagcagcatgggaaacaagtgttatttataccataagctaacaaggcaggcctgggacaatcaatacatgagcctcctttccaccaaattctcttctcattatgtaaataggatggcctgaggtgcaagaacaatgaatagaataataatcggaaatgtaatggaacwaatagtggatttctccggactgttaacttctgttcaaagagyccgccaatgatggatagagagcggcgtgcaraaaggaatctttccctggttcagcttgggtgcaytgccttgtgctgactctgtcccctcccctacccaccacaccccatgtgtctagaacaatctcctctgcartmcttcatttcctaaatgaattagtccagagccctgttttgaacagatgcctgtacagttcttgattggttgaggcaagtctaaactgacataagccctaactctraaacatgtgactttttactttgaaaatgtccaattctcagttgtgagctattcatgtgcaagtaacaaacacctactcaaacaagcttaagaaaagcagggaattcctgggaggatgcaggagcaggaaattgagccagtcsttccaaagggccagaaccagaaggcagaccactgggtcccagacagatgggtcatctctttccactgtgattcaagccctgatttgtggcctttgcctattttcatgatatcaatacctccaccgtggctgattgcaagctaccaatgacgtatcatagaatgtggcactggggagggatgtgcagccgcaccccattattgtaccccattatgtagtacttctgccatgcagatataatagataaataatcttaaaagcatagataacagtcaaatacatttgtaaaagagttaagaagtgatgcattttgagtattcattgcctttgcttttaagattattgaatcatgagtgcatgtaatgtctaataacatcaatgtttaactggcttagaaaaatcctgaaatttcaaaagtgacctcttacaaacagtacgtgtcagctcctacttattattcctcctcatgagtccatggaaacagcctctctgggaagaaggcagagagcaggagacaggtcgtggtacagaaggaagtgactggcagaagtacatggatggcatctcagttcaatctctctttattattttggcataattcaaagttcatatctcacttcatctcaaaaacaatatgcatatctgtccttggcttcattttcctcctacctcttcagacatctcttctctggctctyccccttaacccctaactgggggctttctaccctgtctttgcacaccatttatcctctctataatgacarctcctaaatctaagaaatgggcacatttcccctgctaagctacagacctgtgtatttacgtacttcctagatattgccccatgcatggcccaccatcaccttaaattcaagatatccaaaacaattctccatcaaaaaaaaattctttatagccaaatggaagtgtgctgtaatgagaggcatggactttgattctagtgccaaattgtaggtcttaatgagcttgctgactgtgagcacgtcactgattctccctcatctcagagttttgccatctcataaacaggcttgacctcgattaatgggttttactccacaatccatggggcccttkattctgtgggtccacctcagaagctgtccaaacatcaagagagaagtggccttggtccagtcctgggcaccccatctcccatcaccaagggccatctgtctttcatcttttcatatgttaaagttccatgaactatttcttctctgaagtagtcatccactaattcattgattcactgtgaatcatgaataagatcatgatcactcaggaaccctctaggtctagcattccgtgattcttcggttagtgctcacgcttctggaatgaaaagtacaaaggtacaggggcagcagctggagatgacagcacagtctgttgccatgtgtagttcatggcgcagggtcagggcagaaactccttaatattaaayttagtgtacagtaactctaatgcctgatatttgatttgcattaagcactgacaagaacctttcatgtctatttctgccctggggtcctaaaacataaattttaacattccwtgcttctccttgatgatcattcccacatagaaatggaactgcattaataatgattgttgaaaaaatraataaaygattgttgaatgaataaccgaatgaatgccaccagggaaaattattgtctccawttcattktagggcctgaactttaggagaataaagttatcctaaagagagctgttggaacctgcctttctaaccagctycctattttctagaaaaggggtcactgtttgtaggaattgtctaggattcctgagaactgccatcaaacattcattttgcttttcctattgctaagcattatcagacagagacacagcttctacacaaaggaagayggtagggcattgtctgttcagggctgctagatcaatattatagttttatttatctattaatttatttggatttctaagcagctctaccttttgttrygatgattatatggcaaaatgcaaaacaacttgacaggactttgctatctagacttttgataatgatctctaaaagccaactcatttcatttgcrtccttttatgaataatacaaaaaaatccaaaccttaactagtgtttgtcacagtcagtgggtacttcatgagccaagagtgcatagaaaggtatttttggttcattactrggtttctataattgacctgacattttgtgagagcaatcatgtttgttaasgagaaactcaagccaatgctgtagttgcaaagttctccttactattacccygggaaacaaattcatcagaagtgtgcagatgtgttttatgtgtgcgtacacacatacatccctatgcatacacaagcatgtacacacattggcatgggtcgacctgataaaatatatgcagtgttctctttgtccaaatccagctggtcatctagggactgtatagaaaatttgccagtgcctgcagccctactccatgtttccctttttctctgcagcttgagcctcaccttaaggcctaagtgagatatgcattctgtcccaaatgatggctcatggggacagaacayttctgagtcttcctttctgaccctctagttatatggcagtgattgcactgagggaaaaccaggaaataacaaaggaaactgcttaagcaagttgtgtttgggaagattagaaaagggagtgcacaggaggatgaagctgaagtctctgaggaggtaatcttgttcaaataatagcttttcttgtaacyatattttgtcaaattggttatttctgatgatgtatccccaattttctgaaatrttttaaaacttacattgtagctttctctcatttccttattcctatgttctcattctggtccatcatctgttcatttattcagtccattctttgtgtattcattcaattattctttcaagtgacrtttactgataattaaaactgttaaaatcactgacgtcaaggtctatgagcaaaactgaaccaaaccaaaacaagaactaaactagaatccgttgtggcgggattgaccactaggtggtatgtccattctttggccttactggggatttaggcatttgttttggttatgtgccttgttaaatattcatcatgtcaaaatggtggtagtaacatgaacacaatcaagaaaatatgaagagagtgatataaattatatttggagctcagagaggggccaggaagactttacatgttggattgcttctgccttaggcagaaaagaagttgcagagcgttctaggaggagtgaaatacttgagtaggggctgggaagcaataaagcaagtggtattttcaagtttatgcatccacaagatcagtgttcaatatttaaaatgttcaaygtgtaaactctatcatggaaagatttttgaggaagtagcttgtaaaaagttgcatatttctatttgttgctagggttacctaaccaacaggttcttggctaagcaaaaaactacagtctgtaaattagatattctggaataaaaaatttggggaaagaggaaaaggactcatgctcccaagaaggccaagtgaaaagtgatatccttctgatagggraagaagtcatgagtcattagtctggactgctatagtaatgataataatagtaagaataataatagccaccatttgtggatcacttactgcaaaccaggaactgtgttaaatccttctcatrtgcaagctgctcctttaacctgcgtggcaacccggggtgactagctgttagtatagcagttccttgcccaagtttctcagtatctttcagcctcagtttcctgttgggcaaaatagagattacgggacagtgggaacattaaatgaggctatgcttgttatgtggttagcatggtgtcaagcagggagtaacaggtcagtgagaattatagtattagctactattagcatttctccttcctcgttagtatttttccttccctgaggaggaaacagagaattaggaggaccaagctgaatataagcagtacctgagagcattcttggaagattatgctttcgtgagctcctcttagaactgaaaattgatgatgagagagacagactgtcaccaatgcatgactatcaccttgtcattattaaagcactttccactagtttatattattttattctcataagctctgtgagggccaggatttgggtcttctyttgtcccttgctacatcctcatctatatcagtggctggcacattatctttgttgacgactgacctttccttttcctctttctttgcctggcaaactgttacttgcccatcaggatccatggggacattgacgctcctccatcactctcacctccagtcctctcttcccacacaactcttagttcatacagtggtcacagtacctccatgctgtattgtatcmtatctactctcctgtttgtctcttgctgcagactcctctaaggcagggaccacttttcaccacctttccatgcccctggatccttgttcagrtttggcttgatgtacgcactttgaagatacttgaatgagtgaccacaaatatcttcatttgcatctgaacaattttcttgatatttgaacttcttacccaaacccccaagtccaaaggcccttgtcttgagcttacaggttttcaaagaatgctttacctgggtatagggcagctctcacatgcctgggaggaagccttggagcaaaaacaaatcgatggctctgaaagaattatgtcaacatttaattgcaagagatagctgctctgcccagagggcttccggaacaccttagcttttggtttaaagctcaattttaggtaactgatcaggtagaagctagtttgactaccgcagcttgcaaatgcaagctttggtaataacgccatagctttttttttgttttttttttttttggggacagagtctctctctgtctccaggctggagcgcagtggtgcgatcttggttcactgcaacctctgcagcggattcaagcgattatcctggctcagctttcggagtagctgggactataggcgtgtgccaccacgcccagctaggccagctaatttttgtatttttagtagagacagagtttcaccacgttacacaagatggtctcgatttcttgacctcgtgatccgcccgcctcggcctcccaaagtgctgagattacaggcgtgagtcaccgcacctggccgccacagcttcttaaaatgtcactatcaatccattctgaggctagaaatctctctggcaagtgtgtgaatgcaaaggtaatggctttacctttcaggttagttgtagataatctcatctttgttgatgaccggtgagtgccaagcccccagcattgagtatgtagtctccaagggacattttccttggaccaattgggaaaagacctggtcaaaattgaggaatgggcaatactcacctggtattttgagctataatttggttctttgagctatgagaaaaaaaagggacacgggctatgttgaagtaacaggaatttgagaagtaagggtgatgagaatctcagaaaacttgcaacagctggacatccaggtctcctggaaatgggaagttgattgaggaactggagggaaagttaaggtcctaactttagtgattgggtttctgtgtcaccaccttggcccaggagactgttgatacccccccmmtttgctttgtctccccatttcttttagtgtctctttccagctgagcagtcttctgactcccactagttcaagtttctgagggagaagctgattgagcggagctgtgcattagacagcttatagatgggtgctcttaggtcacatgttcccagtgagccaatcagcagcctctagaggagaggtcacgcggcacagaatatggccgcctatgcttaaggcattacagagggcatcttcctctggaggggtagtaaatgtaggcactttcttctaaatgggctatgggtgtaacaggcattaggctgcttctattttatcagaggatggggccatgattagcccaatgaacatttactaatcattgaaatttaagcatggcagcctggtgtgtaaccattgtttgagttagcatacttcagttttccccygttgatttagtctcatgtaaatctctgaagcctcggccagtcttttcttaaatacacgtaacagctaccataattctctttctgctagtcctttggtccacctaagttcacctagtcaaggtagacagtctgcagccactatccttcttcactttctaagggctttctcagcattgggggcttattaagcagcaagcaagtcagtcctgtaaatgtggggaagctggctccctggggtctctcttaactgttgagagtcagtggataaatggcccggcttcctgtgagacaattgtgagtcaggttccacacagctccttagagtgtccccactgggagtgagcagaaacctgatttttaatataaactttatttgtgtatctcccttctctgcctcatttttcacacctcctcacttgtacttcccaaatatattctctgctccaaaatccttgcctcaggctttgcttttgggattattcaaactgagacaataaaatactacacccattttagggaagatcaggagctaacagtgtagggaccaatgcattatggtcttcatctaaatgaagtctgtttctaatatactgaatgtttctgtaaggcaaaaactcataggtaattggttaaataggggattgtatattaatatgtagtaatatatacatatatgtatatgtataatataacatgaatataatatacatatgtatacacatatataatatatatgtataatataacataaaaatgactttggtccatatgcagtattccatagaaaattgatattttgccttaacaagaagcggcaattaaaggaatgtatactaatatagctgaatgcagcacacctcaaaagaatagagaatggtctatagaattcaaataggttctgcctcttgactcacttgccaaatcctctgtcttagaagtgcttattgagtaattctcccctatcctgacgcactgcgcctctgttgccataattcagcagattcaccctttccttataacccgtctaccaagccccaatccacattttttaaagggaaagccttatatttactgtaagttttcatttatcaacaatttatgtcttctcaaacacaccaggtttaaaaattatgattataattattatttgcaataattatgtgattacaaagttgcaaagatctggagcattctactctaatcttgtcttttccaaaatccttatgattttattgcacaattttcctaagcatagagtttttctggaacacaaatattttccagaacacctatttcagggctgctccacacataggcatatctgtgccagttagacataagcacccggctcattgcgggtacttactgagggggtagaaggaacatagtaccgcccccgyaaaaatgcaattagcctgttatcaaaataacagggagagatgaattcttatctttttgctggaaggtcggaagaggcattgggcttaggaagtggccacatcatagtcatttgatacactgtcatttgcatctagtgtaaaattcaccattgtttatcttatgattttatgagtagagaccaactgaaaaattttgtacttttattaatattatggcattacaacaccttactttaggagattcatagtttggaccctgtttacaaaaatgtaccagttatatggtatttattgagtgtctttactgcatactaggaatcatacaagagggaaacagaagttatttctatatgactctgatagcacctgtatttgtcccttttgtgttgctataaaggaatacctgaggccgcgtaatatttacagaaacgaggtttatttggcttacggttctgcaggctgtacaagaagcatggtgccagcatctgtttctggtgagggcctcaggcagtttacaatcatggtgtaaggtgaagggggagcaggcatgtcacatggtgagagagagagcaagagagaggaggaagtgccaggcccttttcaacaatcagatcttgcagtaactaatagagggagaactcactcatgatcgcagggttggcaggaagccattcaggagggatctacccccataagccaaatatctcccaccagcctccacctccaactctggggttcacatttctttctttctttytttttttttttttttttttttttttggagtctcactctgtcacccagactggagtgcagtggcatgatcttagctcactgcaacctctgccttccaggttcaagtgaatctcctgcctcatcctcccaagtaactgggagtacaggcatgtgctaccacacctggccaatttttgtatttttgacggggtttcaccatattggccaggctggtcttgaactcctgacctcaggtgatctgccctcctcggcctcccaaagtgctgggattacagacgtgagccgccatgcccggcacatttcaacacatgagatttggaggtgacaaatatccaaatcatgtcacaaccagtaggataaatactacttatttttcattcctcagatgagaacatttagtcacagagtgtggggcagccagccaacttctgatgttcagagtcagtgctgtctaaacttagctttcatgttctttctacctcagaaggctacttctcaatcaattatttgggatcagttggtttcatcacatggcattgcatcatgaatatgctgaacaaggccaagggaaggcaacaattaactggsagtttgtaggcttgtgattagatataattaaaagtcacataaagttccaaaaaatatttttcacttgtttcatatctcaacaacttccacttgtttaagttagtgtttttccaagttgcattgtgatgaggagaatttgacatatttttgagggctaagagtgagaatgattcaaagctgtgagatttgaagtgatgtctaaaagatttttttatcatgacttatgattttttatacacacacacagacacatacacacacatcctagtaggaaaaatatcaaaatataataactttagataataagaaaaatggtttctgtttacactgagttttcacaggtgagatatgcattaaaggcacaaaagctaaaagacaaagagaaatggcaatttaagcacttgaaagccttgctgaattttttacagactgtgtcaagtggagctggaaagtgaaaccacaaatcggaagctagaaaggaagcagctaggcaagagagagtaccttggactgctggctgcagtccccttcttttcccccaagtgacctgcacatcggacttcaccctgctactctctcttcccaaagatgaaatgaagaggttgaatgtaatgattactaagattctctttctgctcccacgatgatctgatgctgaggatttttaagacttctgtgccgttagaattgattacttctaaattgttatctactattcataaaaagaaaattattcaagcttgtacttcttggcacaaaatatacctgtgattttctaaaatattatctcttaatgcacaaagttctcaagtgctgtagctaaagggagctaccacagagtattaatagaaaatgtatgtgagaggatgttatttaataaacccctaagtcagtaattctaatgattcaaaatgactttaactttctactaattagaagccagactctcagctttgcttcttgatctgcacttctccccatcttggtgttcttggtgatggtcatgttcctggctgggtcactgcttccatgactgtttattaaaatcccctggccaaacagtgggcgtactggacttcctggaggggttccctggaatgccttgagcaaaacttgggtgccaaaagcaaagacctgctgtgttggagaaagaggaagagaagagttctgctgtctttgcatgtgtttggaaatgtctttctcatcaacagattctcatgcttggggatgccaggggtggtttgggtgggcactctcttcattaatagccattattgtggagtccttaaagtggattaatgatgttttttaggaaagataattatctcctatgctttccgggaggtacatgaactgctctaagattgcaagtacaaaacaggacattcgtggtgctactgtgtgaaaaaataaccagcagtaccttgacatttatagattttatataagcatgtgagtatggaccttgggcctcaccagccccagaacaccccaggcgtccttgtaccgcagggcctttgtatgtgctgctcttgctgcttgacctgccccacccagtatctgtaagccttgctctttctttcaattagaatctttacttaaacatcctctttttgcacaggttaccctacataaatcaacgtgcctcctgtctcctatcactctctgtccctttatcctgctttgctttttcttcacagcacttatttcctgacacagtaaatcatttataagttgcttattttccacctcctcctctggaatacatgctctgtgaatacaggctctctgcttgtcttggtctctgtttaattcctaatcctggcagagcacctgtgacatagtgaacactcaacaactgtttgctgaatgaaagaaaaaatgaaaaggttcacatggagatgagagccactggccaacaatttcagtcaaaacatattatttacttaaaaatgcaatgtctgcatatatttgacaatgataatttattgaaaacaacaacagtgaatacatgagttgatatctgtcttttcaatagatatataatgagcctctggattttatttttatttttattactcacgtattttttgaaacagagtctcactattatcacccaggctggagcacagtgtgcgatcacagctcactgcagcctcctctgcccaggctcaggtgatcctcccacctcagcctccccagtagctgggactataggtgcacaccaccacgcccaggtaattttttgtagatagggttttgccatgttgtccaagctggtcttgaactcctgggctcaagcaatccatcttccttggcctccaaaagtgctgggattacgggtgtgagccactgtgcctggccatccctggatttgaaaaggaaaggggtagagtgacaaggactggttgcatctcacattccaaactgcttgttttagtatgcgctaatgcatcaaccttttattactgcccagaccgtagacctggcttgttccttttcacatgttattctcaccagaagctacaaagtaggtgttatttgtattattattgctgttgttgttgttagaatacatattcctcatttacagacaagtacacaggctaagcatgactgcaacttytgaattgtcatgcagctcagaactgggggatctagaaactgaattcagcagctgattatttgrttcccaataccatggtcttgctacttacctactagaaaggattctcatttgtctatttaagttcttctcctctactctctgaggaggattctttcagctcttagtgaaataaaactagaaatggaaagggaagtctcaaatctatgttcagaagagggaagaggtttaacctgggggtgggagggaagcagatagatgtgctagcagagcaagcagtttgagatctaatatacagccttagtgggattaaaaatatgaggtataatttgtgttcatttattctacagatgtattttgagaacatagtgaaggcatgatgcctggcccacagtaggtgctcaataaacgtgtgttgaataatacatgaaggacacgaataaatgtgtgttgaataatgaatgaaagacacaaattcrggaggtaattttgtttgctggtttgtgtccctttatctctttatcttgtgatgtggaaccacactcacagagtcccttcatcttcattcatttcattcattcttttttttttttttttgagatggagtttcactcttgtcatccagtctggagtgcaatgttgtaatcttggctcactgaaacctctgcctcccaggttcaagcgattctcctgcctcagcctcccgagtagctgaaactacagacgtgtgccactatgcctggctaatttcttgtatttttagtagaaacagggtttcaccatgttggccaggcaggtctcaaactcctgacctcagatgatctgcctaccttggcctcccaaagtgcactgccttcattcattcttaaatcattcatttctttgtggaagccccttagctccatgtastttatggatgtgtcagaacaarctgaatattgtttattcttttactttttaaagagatgagtatttgagtcctctgattcacagtgaatttcagaattctatcagctaaatacctcttgaagctccgattaccaagactataagcccttctacagcattaagggattgctcgtaaagatactgctrttatgcatctggtgtaaagcctcctcatctttagctcaattcaacaagtttccattcagtgcccagctctaaaagtcttaaatggaaattgattccctactccttctrttktaactgtcaaaatcatagactgcattgtttccaactgaaaatccrctgacagctccccaccraccaccccgtgagccttccyagggctggcgttgatgatgctgctatcaatggggaatctacattgtgcacgggtatttatgatgagaaaatcatgtgrcataaaagagaataattgccttcataagtgtataattttttatactataagcttctcaatgaaaaagcattctaaggraggcataattgctaattttcggtgttaaacatacctctgaagagtatttcacagtctaactctctgagtgtcatgtcttcctgtggcccggggaagagagtgggaaggaaataaaatttcattgagcatctacataggaccaggccctgtragttcttggatattggtttcttcttataatgacttgagaattacatggaattatccccattatatgagaagacagagtctcacaggagttaaatcacttctcataaaatcatctctcatagttatgtgagttcagaatgcaygtctatgctaccccaaagtccaagcttaatagagaaatctacagcaactctktatattctggagaggttttattactaagcttaagaattgaggtgccctaagaacgggctgcccccaaaatattttcctcaccacctcacttctgtttccagaagcccaacatgaaaatcactcttctgaaataagkcctggagtcttctttaggcttctgctaaaaagtcttatkcgtgagatgtctagcgtaacttctttttttaagtcaaggaaaatgtgtagaatttaggtcaagatgcactgagaataatttgcaaaacccgtaaatccgtagctgatatatttaacaccaggtccaaactgtttctgaaggattraatctcttgcctgaatactgaagaaaatggaggcatgatctgaggttggggaatattctaccttgccaaggataactgtagagtattgtgacaaagtgcaaagatgccacatggattctggatcagtcagacctgggttggaatcctgattctgccagtacacctttctgcctggttagcttgraacaaagcagttaatctattgagcttcattatctctctcctgaggctcttgtgaggactaaatgagacaatacctaatgcttcatacagagacagtggtcactctatcataataataggagccctcattgtttatgtctttaccatatatcattatccaatatattcctttatatcattatccaaataaatacatctgatcaaatcccccaaattgctttcttctcagcattcctyggtgcaaaatatgagatgtcctttgactatataatataaaatatactataacatataatattgaccttatattgaagatgtatttgtacccracatacaatatttttagaaataatgtttcattataaaattttttacacgtacagaaaagtttaattttgcagtgagcactcatgtacccaccacctagattctaccgttaccatttaatccacgcattttaccacctatctttccttctgtgtgtctcccgtccatccactaatctacctcatgttttcgattggacacatttcaaaataaattgtagatatgctctccctctaaatacttcagcatgcatatttttcagtagagttcaatatttgcttacatattgtttctcttttgatgtaaaatttacacacagtgaaatgcataaatcttaagtgtgtattctgagttctaacaaatacacacatctgtgtaacccaaagcattgccaaaatgcagaattactgcagaaagttccctcaagcctcttccgagtcaattctgactcctaccacagcaaaagtaaccattgctctgattgttttctatcttggattagttttatctgttctagaacttgatataaatagaatcatgcagcacatactcttttatgtaaggcttccttgactcaacatgttgtttttaggatccttgcatgttgttgcaccgatgtgctttctgaatcgggaaaaacaaatatttttgtgtttgtagaagtctagcttaccctgatgccagatttaaattccctgtgccaaacacattgtgtgctcctggtccctgccccctttaacttccccagcatagtgcctttgttcatgttctttctttccatcactccctggactctggctgttcatattctgcccttcctctggagatcagctccaatcccaaacttttccaaagtctgcattgactcccttgggtttctgcctgagctctctctcctttggacactggactgccatcccattaactgtkgatgttgtcatcagtgatcagctcctggtcataaactaaggaagagttaggtgggagcactggcactgagggtccatgtgctcacttagctttccagggaggggctagaccacaggtactcttcaccccacgagccaaaaggagtggatctagagtgaccattgcaaggcctcaaagagaaacgaagagtgaggagtgatggggaaagagccaaggggaccatccctgagtcatgggcgtgccttgggttgaggctaaaggttcaagagggaggagtaaagaagggaaggaaactgtcaggagtgattgctgtcatgtggaagaagcctaaacatgaagtcatgagagacgcaccttgtggctggtgggaatgctacacaatcatgcaacatgtgcctaattttctcaactaaattgcaagctgatgtcttactattgacaggaataaagtttcataaggtgttccctgcagtggcctgactgtgcaaggtgctgatagatacytgctagttgataatgatgcctctcacatggccagtcattttagcaattagtttcattgatattgtgggactgggcttattggagatttgactgaattgaccatttcagccactacagcctttgcagaatttgtgtctgtcaacctggccttcccaaggaaatggaggttaggcaataaggaatgtgttcattttattgccattttactaccacagcatggtagattccagctattaatcctcatggtataaggtgctttttatatcttcaaaaatakggtatagccttgatctctcttcttgctgctctggaattaaaatagaaatctttatccctatctcaaaatctttggggcaggttaggagagctgggcttcaggatcatccagcctagtgcttaggtctgtttacagctcagcaacatttccattggttgagggatattgttcagcagccactgaacatcaggctctgacctcttgtttctttgctgtctaacccagcagaccatcctcggttaatacttactctgattcagcctagcaaagaagatcagaagcaattctgtgtccgcaggctccctttcacacctttaatattttgtattttgcaaacattttgagttagttagcaggtctcttgctttctcttgagggctgggcacaaatgttcaagaataatcattgtaatggcatctctctgattaaaaagacagctggcaagattgagatagaacatcaaattctgaaacatcattagcaggattctattttggttaggtataatcttctgtgaggtcatcatgttgtcttcgatgagtctaaccattttatatcatttagatctaaacagacccatcatgtcacaggcaaatggctttatcatatttaattaacccaacaccatgtaataatctccctggtaattatccctcactagtgcttgaaagcgtgctgcaacaaataaatcatcaaagttgcaggtatacttaaactgttatttggtgccgtggcagaagaatattgacaagtcacagtgcaatcctaattatactaagaaaatgtaaatggcttcatcaaaaaaagaaagagccagatggcaggttttatatactgtatcctcctgtgttagaaaatggggtattaaaaaggcttcatgccctcagcatcagggaagaagaagaaataaaggctgatacctmtgtctttatggaggccacgttgaacctctaattctggagaatggtaacattgaagaggacattagtggccattgacrtttatgtctcctgatgccaccctacatataagtgaatgaatattaccaggatgaatgctacttttcttatgataggaattgattgaggaggataggagcaattccatgatgccctagattttactttatgtttgcaaatgacaaattattcacagaaagacatgtgcccaccaggtggtgaatcaatgtgtttccattgacctggcttttctaatgcatcagcaagaacacatttaccggaatgcattgcaattaaaaagcaaaattcagttggaaacaatggacttaaacctacgaaatgtracaggataagtcagagaggaaatttgatttcaatggtgagattaacgagcccatgaatgcatggtgcatacggcacagacaaagataactgaattggattttcaataagcatagagttctagatttccctgttcttgaattgtgtaccgtaccacccagctgctgtycccagctaattttgccagagctggatgtcagccaaagcacaactgtctatggcttgggaagttctcctttgagtcagattatttagttagctcaggctggtaactgccacagaacctggctgtgatttggtcttattagaaaacaaatttggaaagtattagagaatagtgttcgaatagtaatgttttcccttgctttccttaatatttcctttgtgtgagtgtgtgtttttgtgcacattgcactgttgttacccaaccaatcagaaattctgtttattataaaagtaattctccttaattagagaaaatttggaacrtaaaaaaggaaaaggaagaaaattgctcaaagtttgcagtccaattataatggttcttgaccgtttagttatttagtctttttcctttatgcatacattttgaaattgttggtttagtttttttatagtttgactcatcaaaaatcatatattcactatcctgcttaaaaaatcatcataagtttaatctatatagttacatattcaatcattatgctttgagttatattgacattccatagacagatgtcatttcatgatttttaagcagtcaattttcaattactgcataatattcttccatttrgagatacatattttagttcagtattattgtggcacacttattttctatatttcctttttttctggagacagagtctcagtctgttgcccaagctggagtgcagtggcgtgatctcggctcactgcaacctccgcctcccaagttcaagcaattcgcctgcctcagcctccygagtagctgggactaaaagcgcacactgccatgcccggctaatgttttgtattttagtagagatggggtttcaccacattgcccaggctggtcttgaactactaagctytgagctcaggcaatccccccrcttyggcctcccaaagtgctaggattacagccgtgagccaacacacctggcccaatagttccaattttttatgtgtatatttttaaaaaattaagttgtgactttagcgtgaattgaaatttgtttgactatacttyataaacccttttatattgttttataattttttgcaaacataatttttaacaatgcataacttgtttatcacaagtcagacccagaatatttagctcttcctttgtgttcattcactgaaatcaaggtgctttccagttttttacaatgataaataatactttgacttatcaattaattaaaatgtgttatatgtcaattatatacagagcactgggctaaactggttatctgtgtacataaactttccaagtttgggattgtctgcttagaaaggatatattaaattggtacsattggacccaatatgactggtgtttgtaagggtctaggtagaggctgcttgatagcatttgtaaagggcaattaatctattctgccgtcagcattacagctcgcttcaccacacctgtgcactcaacgactcttcctccccgaaagtggagacagtgaggcaaaggacatggagaaacggaggctcggagagtttcagtaactttccccagtccaccagcttgtatcggaattgggatttgagctcaggtctgtccagctttagaatgcaaactcttaagtgctgccttaagtttgmttccccagaagaaggtcctgggatgagaatttgtgttaaagtgatgtatcggaaaggttgctaggaaaaacgtatagggaagtgggaacygagtttggcaagagggagactgagcaagggtgtcatctcaagcgaagttccattgagataactttggcctcatcttccagggagactgggaatgatgtgatttgcacttcagtgctggcccctttggggcaaggcaacttgagtatttataactcttgacccacaagtccttggttaaaggctgctgggatagtgggcaggcaggggcacaagttgtcagatgcttctgtacttcatgtgttacagacaaagcagatccactagatgcagccttttggaaaaagacacagatgcccttgatgtgctggtgtcggttagcaatggcttggaagagctggatgttaaattgttaggaattttgcaatctggttgaccccactgacagcttgaaatcagccatggtgagagtatctacaccrtggaaattggccaacattacaaattagggctcccttccctccacccagaagtgttcagtaaatatttactggcatactaccggagctgctggcctttgggaatggaagcatactgggggtccgtgtgcactaaaatggcaaagaaaayctaggggatgtggatggtgcagggacagcatctactgcagcactcatgtataccagctgcaatatggtaggaaacctgcccctgcccacacaggctaggcagaggtgtgtgagaaaaagggaactggtgagagggargggaacatgctggatttcagagcaaggtctctcaacctgaggtggcctgggtatgagacatgctacgcagaaaaaaacctagaaataactgagattaaaatagctaactaagctactgaatacttgcactgccaggcactgagctagatgctttactttggctaatcttcataggagccctaggaggtagatttcatcatcatcatcctcactstaactattattatcatctttgtcatccttcttctacagatgataaaattgagatttagagaagtaaagtaatatgtctaacatcatagtgggatggctgagctctgaacccattcaatctgactccaaatgcaaagattgaataactttgacagaataggtcccacttcctatggactgagtacacatggttgtgggggcataggttgcttcagtggccatcaggatgacctgggagtaacctaattttacgtgattataggcttaaccatctggttatcaggaaaaaaaaccatgtagagagcrcacgagagcccagaatcagtagctgggcctcctggtgtggaaaggwtagaactcaaatctcatcgagggatggaagtctggatacactcctttcatctctcagaatcagctccaggctggcccaaaacaaatgatacagaggctgagaaaggcagagcaaacctgggacatggggctgagccagcagaatcattagcagtcaggctgtgtgaatttttttgtggtaagagagataaatgtccctcttgttctttgyggtttcctttgccataagagccactgctttgtgaaagttcttctttcctttctctggcttgcccatccctggattgatgtagtagccagcagcaaggacatatgaagggtctggaagtggaaggctgccacccctgccctgctcccacttctgggcccccagggatcccctgacataaacagtcctgcaggaggaaataataggtggacttgtccctgtgacacagtggaggtaggtctggaagtttcctttgaacattaggtaggtctcagctttgtatttcaggtgcttttatcatgtgttttatcctgtaacagtacattctagagctacctttcaagtgtcatcaatctccaattcattttatattttcctctatgtatgtacatttgtatgtatgtgtgttcagttaccattatgaagtaactgacctgaagcaaactgaaaataaatcttgccttatgttgccaacattgcatttttttttctttttcttaatttatctgtgaatattgtttttcttcttcttcttcttyttttttttaaatggagtttcacactgtcacccaggctggagtgcaattgcgcgatctcagctcactgcaacctccgcctcccgggttcaagcaattctcctgcttcagcctcccaagtagctgggattacagccacccaccaccacccctggctgattttttgtgtttttgggagagacagggtttcactatgttggccaggctggtctcaatctcctgacctcgtgatccacctgccttggcctcccaaagtgctgggactacaggagtaagacaccgtgcccrgccagtattgttcttctttatacctrattactcatcattggaattctctttaaaaaaaaaatgtgcttccctaattggttgccaacagagaggctacatcatagtggttaagaatataggctcttttcccttgactgaagcagtgattaaaacaaaaaaataagaaagaatataggctctggtgtcatactgcctgggttggagacccagctcttcaatttacatctgtatgacttcagttcattttttttttttcatttctacatggcttggtttccccatctgtaaattgtggatacttacactagctatctcataggttattgtgagaaataagtgagtctgtatgtatgaagcccatagaaatatacataacacagaggaagcactacctagtgtcagggtctaccactgtgtattctttaggaggtttcaatcttgaccttcagaaaaagaattatttcattcaacaagcatttattgaaaatttccttggtgctcatctctgtgccatgtcctttcatatagattttatctgacataacttaattcttaccatcaccctgtgttaaagttatggtgttcattttctagggtttaagttctggaaatgctgtgtgctcactgtatccaccaggataggtgaggctctgctgcattcatgaacagtcacagatctcagagcctgtgagcgggtttaattctccttcatgagaagccccctggtcagggtgtgttcctgcacctggtggggcagcatggtgggctatcccctcctatggctcctctgttaccaaacaagctcttcctatagctgcagctgaggaataaaaatgctggagaatcttggcggttaaatgctttgacttggaaataaaatggatcagttctacctgcagcccaggagcaagattgggttgcagactctacctaatggccctagagactgtaatcctcccacgtgctggaaggagagtagaatagggtatggtgaacaggagatgtctctaccactcacttgggactgtgagcacctgtctatacctcggctgtcttatctgtgaaatgaggatgacagctgtacctactgcatatagttgtgatagagtgaatagataaatgcatgtaaagctcttagcacactatatggcactcagaacatagtcaaaatggggtcactgtaatcatgatatacaagaaagtcagcggagcctcctaatacagtaaagtaaccattgttttgaatagtcacgtgtggatatcaagtccagttatattacttaccagctgtatgtatgagcatggggaagttatttaccttctctgacttttacttttctcwtacgtaaaatggtgtgggatcacactcaccccataggctgcatcaagggttaaatcgctaacatttactgacaccttggaaagatgagctaagcgtttaaaacctgttggctcatttatgtctatgtcaatgctatgggaaaggtactctgttatcccccattttatagcagaggaaactaagcctcagagasgttaagtaatgtacccaggcctctctaactgctaagtggtagagcaaaaagtgaaacccaggcattttgtcttctcaattaatgatcttaatacgcattacagcctccctgagatcagttgggtaaagctctgagcacagggccaggcacagtgtacacccttgcaaaaatattaatttgcctgggtgcaaggtgagggwcatawccttttcctattctgaaactctactctgcttaggatgcatactgatggctctttttttgtgaatggatggaagtatgaaaggagcagtaagaaagggcactatcaggctgcatgcagtggctcacrtctggaatcccagcactttggaaagctgaggccagcagatcacttgaggccaggagttcaagaccagtctggccaatgtggcaaaacactctctctcctaaaaatacaaaaattagctgagsacagtggtgcatgcctataatcccagctacttgggtgggtgaggcatgagaatcgcttgaacccaggaggcagaggttgcagtgagccgtgattgtgccactgcattccagcttgggtaacagagcaagactgttgaagaaaggaaggaagggatgaaggaaggaaggaagggattaagggagggagggagggaggagagggaagaaaaagaaggaaggaaggaaagaaggagagaaaagagaaaagaaaagaaaaggcactatctatgccatatgcttttgtgagactatcaaggcctgcatgcaaaaaaacccagtgcagagttggtggtcaattagctggagtgctttattatttttaataatcagccatgcttagtgggagtctctgaatctgtagttatgactgtagtaaatgggacacaaagggagcagctggacataccggcaagtattataatgtgcagacaacctgcaaatatgaaccttcttttcaaataagaatctcagtgctgtcactatttgttttaggaagtgctggttttaactgaatgaggaagttaaacgcatgttctgttttttgttttcattgcgcccacatgggttgactrtgggttcggttttctctccagattgaacacttagtacttaatgggggaaccaccttggaaaagcagaactgatttgaggtggcttcatccctctcttctcccaccagaaagagatgggagcttccacttcaacctggggtgaagacagagaacaaggtgtcccagcattttgcacagaaccaaagccctggaaattctggtggaagctagacattcagagtcatcaagctaacagtcacttcctgctatgtgccagatactatgcttttcacagacatctcatttacatttcccagaacatcaggttggagtgcagtgacgtgatgcaatcatagtttcctgcagccttgaacttctgagttcaaatgatccttctgyctcagcctcccaggtagctaggactacagacatacactaccacacctggctgagtttgtttgtttgtttgtgtgtttgtttgtttattttgtagcaatagcatttcactgtgttacccagagtggtctccaactcctggcctcaagcaatcctctcgcctccactttccaaagtgctaggattacaggcacgagccactgtgcccaaaagttaagattcttgtagctgctttatagaagatgaactgaggatcaagaaggtgagacttgatgtgagtcagatagtgaatatgctatagaaaactaaacccagttcctttggggacttggaatttggcatcaatattgtcaccgggctttaattttgcttaactccacactgtggtctttgtgaatggtgcctccaagagttgtgcccctgggtgggcctgagctgaaacatcaggtagatgcaataggccttgtcttttgtgacagttctgtaccatcgtctataatatatctgtattagtaatctatggttatacaacaaatcaccccaaaacttagcagcttaaaaccatatttattattccacaatttctgtgcagcaagaatatgggtgcagcttagctgggtctttgggccataatcaaggctaaaatcaaggtgtcaactgaggcagcagtcatcctaagacttgactgggcatgggttggctcctgagctcattcatgggattgctggcaggattctgctttttcaggctgctggactgagggctttgcttccttgctggctattggatggaagaaccctttaattccttgccttttggacagctccagagggaagctcacaacaggacaacttgattcgtcagagaaaataggtgagaagagccagaaagccagagggccaagaaaacagaagccacagtttttgataacagtcatagaagagatgccctgacacttttgttgccttctatgctttagaagcgagtcagtaagtccaccccaccctcagtggaggggattacacaaggacatgcatatgaggaggcagggttcactgggagccagccactgcctactacaagaaccgtgattattttaacgcaaaatgatgggtcaaattccttttattgggtagaattgtccctccagaaaaatctcttttgtcttgaatattcatgcatgctctggtacctctctttctgtgataaggacgttccagtttgaaaaacctgagtttattagtcaaattgtgctggtgtagaaatattccctctctttcaaataactttgcatccacctgctttgactcatgatgttgaatctaattttattacagagttttggatggtgggggcatttccacgttgctgctatgtactttctatacaaataagtgttgacctttgaagtagtctccctggaatagaaggttttaaactcattgatgatgcaaactttgcttaagaccttgttgtagcttctctttgggaatggcctttggaatcacgaccagaaaaaaaaaaaaaaaaaaaaaaaggtctgctttatctattctcactacacagcatttattagatatggctgccagggagatatctccttcctcactgattgttattctatgcattttcttcctaaaactagtagatttgaactcatacctatctagagccctcattatgaacaacagctttaaagcacgcaaggcactaggaacccctatttaatcatttacagaaaaaacatggcaaagaccaccacctccttccttaattccatggtggatttaaaatgcttagattagctgagtcttaggaactgaagtatccttggtctttcatttgtgataattttaaatacaagtgttggtctgaagaaaggaaatgatcagkaattagccctggagcctgctgtgtatattaaatcaatctcagatggaagaattgagatcccggaaagcaaagaaatggctggacttagagaggaaagataatctagaagtgtaaagttagggtgggagggagaagggtaaagcttgagtaatgagtccactgaaaactattttttaaatgtaataaatacgtaagtagcagttactgtatgctagatatccttctaagtgcttgacaaatttactccttagaagctaagtactattttccccattttctagatgagaaaaccgaggtgcagggaagttgagggacatgtccaagatcacacagatagtaggcagtccagcttcagaatctgtggtctctaccagtgcactttgccacttcacagaactatccagacagaaagagcagaggccgctttgagaatttctgtgcaggtccaagcgtccacttaaatcagggctcctaacacagcagttctccaatgtcctgtagaaaacattcttgttcccttgggacaagagaaatctgaactcagttgtgcaaaaaagagggtctgggaatgaaccaagagggatggtcagtggctccaaggggcggaktgggagaaggcaaaggagaggggccaggagagaatgccaggaaaaaccagaagaaagatttaaacaaacctcataatttacctgtaaccgacagctctccttggatagtttatctgggcactctattccaccagaaccagattgttggagttgtttcaacagaggaatgcagagcttaagtgtgtctgtgctgtgtgaatatacctttgtgtatctgtgtagcaggtagtggtagaaagattttggaagtcgagggagatgactgaagtagagggaaaggtgggaggtcatggctctcatagtattttgtcacgaggtaactttgacaacccctgagaatcgatcagtcccccaagaagtcaaatacatctgcacatgtgtatcatgttactgcatcttaccttgacaggcgcactttaggggatgcagtctctgcccttttgtgccaggagcaaatccattttgcccatgatttcaggtacacaggtgatttcgccaaacaaaacaagcacagctgaaatctgtgacttaaatcaagcaacggtgtctgcaatastctcattgcagagacttctgctcccttgttgcttgtaggaatgggggtggggaaaggtcaggactatatatttaagaaaaaaaccccacatatgtcgacccacaagtggttacaacaamattggtttacttgaaagctctgtctccactctccctacaaaaattcaagtaagaacctggaatgcaaggaggtggaagagttttctctccttgccaatctctccsttgctctctgataaaaggtgcggcaaacagggtagaaatgactgcacgggaccagaggatrtaaatattcagtcatgacagtccccataggataaatgacagcagcccatgcaatgtgccttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggtttaataaacttacattagaaataacttactaaaattacaattggcatgattagctacttttttaaataaaacataacagagtgactttacccatgctgacagcttttttctttcacgctggttcattgttctattgttgtcttggaggaagaaaagacatgtataacacagaagttgtaataaaaactgtaataacccgatacacaaaaacaagggttatatttcattctacatttgacagtagctgagtagtgtactttttcttgttttctgactggactggagggaggaaatcactgtgactttgaatcagggtcacatttggggtagctgtcctcttctcctgctgtctggagagactgtgaggttgcctgaaaggcagtgggatttaggcttgacttccttatttccctaggcattgattttttttaagtgtatcttctgaagtttgcctctaggttcacttgaggtatcatttctgaagaataaaagtggcagttttaatatgcaggcaattttttaaaacaatgaaatagagatgtgattattgccagggcaaggctgtttagttgccacagggaaacattataccaattggcctatagcttgaaattacagcattctctatattcgtccagctttagggaaatgcagaccacaagggtcctgsctaccgttctgcttgctggtggttcaggttttgtgaacttatacaagggcttggtatttgaatgctatcttaatgagaataagcttttttgttgtgtacaytggcaacttgatggctaaggtcattctccatccatttgtctagctacccacacacctrtacatccatctacccatctrtccacccactcacccatctattcacctatccatccacccagctatttatctatcatccatccatccacccacctacccacttattcaccaatccacctattaatctatccatctacccatccattcagctattcatctacctatcagtccatctatctattcaacctttcacatatccacccacttacctcccctctcatccatcaatatagccttgtatccatccacgtaaccactcatccttaaacaaaaatcagttggcaaaactgtaagcattggtaataaagagacatataagtcgcagttctgtccttaaagagcttaggatctagtacgggagtatatgtaaaccaaaaattacacaacagtgtgctcagtgcacctacagagaactgtgccgtgttgctgtgggaactctaaagaaagaatggtttactgtgtctgaaggattcaaagaaggaggcacacatgtgaacctaaatgtcatatgtggtaaaagaggaagtaaccagccaggggtgaggaacacaacagcaggaaattaagtagcygatgaatattcagacttgaagttcctsctaaagtgcccatttgttgtttggtagaaatatggatatgtaggagggggcctctaccagggtgcagaacatatggtggtattattagggcaccaggcaggagctgaagtaggggctcagaaagccaatcacaagaaccaggattcagggtgggcctgtggttttgaatggaagaaaggagaaaagagtaaacaaatgggctgggcacaatggctcacgcctgtaatcccagcactttgggaggctgaggtgggtggatcacgaggtcaggagttggagaccagcctggccaacatggtgaaactctgtctttactaaaaatacaaacattagccaggcaagtgcctgtaatcctagctactggggaggctgaggcaggagagtcacttgaactcgggaggcggaggttgcagtgagccaagatcgtaccactgcactccagcctgggcgacagtgccagactccatctcaaaaaaaaaaaawaataataataaacaaatggatgcatgaacaagtgcatartaggtagataaatacaccttaggagacagatcaaaatgcagacttgaatttaattggcacagacacttaattatgcatcttgacatctttgaccaaaaacaaaatgccaagaacaaaagcagcttcacgaccaagcacatgctggaatccggccttctgtctgccttactcccgctgctggtgaagctgcaggaatcctgacaggagcaggctgcctttcagctccaagttcctggcactaagttctgcgcaggggcctgggcgagktctttatgactttccagaggcttccaggtctctattgaaatgcaacagctgttactaggggcaactctacttcccaaacaagaacatagactttgtggagctttcccaggtgctgtgaacccagcattgccaaacaatgcctgggacccacagcgtctccttcccccatggagtttaaatagattggaagcaaatgcttgttgacaacaggtgtggctcaatgtgagcaaacgttccattccgttattgcagggttggcaccgagggacatttcctgtgaaagaaacaggcttccaggagcatgggcaatccatactcatagccagacctgctcagctcctccccttcagggccaaagaccgcaaagctccgtgaacaggtgctcctaataaatgcagagttttccatagcccaagcaaggctagcagggaggggaggggtccctggccacaaagctccaaccagccaactgatcaggctttctgcgatgatggaagtggctgcatcatcattaactcagctagattaacytgttcagcagaagcttgcagagctgcgtgagcctgccttccactcagcttgaattaaagagattgggctgcaaggacacagagaggtgagccccaggaggtggggwcccagtcctgagattagtgacagcagccctgaggatgtagagaaaaacttcttactcctttgaaaaatgtgtgcagtgattcttttcctccctgagctgtcttggagccaaagtaagttcttcacggaactaaatggarttgcttgttcartgagattctaatttcagtgagaggacttctcggctacatatgyattgctttgggaagtcctcccttccgaggcaagggcttctccacacctaggatttgatgtagaattactagggcagtatgtaaggacagagaaagaacagaggcagcggcaggcttctgacaagggaatmctggtaatcaggctctctgcataatttttggagatttggagatggagttagtggagggaaagaaagaaacggatataattagaaaaagaaaaaaatactaatgtcttcacaatacttaatgttagaaattcaatttgtttttttcttctacctccgcaggctctacatgttcctggaggtgtgtgtggctgggcaattatcctttttcactcttgcccagtgcttgttttgaatgcaaatgtattagttcagatgggccaagttgcagtaaaaraaatccacccccaaatttcggtggtttaacagaacagatgttcttatcctgcttacccaacagctctagtgggtgtttcttctatgaagctgctcagaaactcaggctgatgggtgaccctgccattttcaacatctggtcttcaaagtgaccttagacgttgacatccctgtcrgccagaatgcagaagtatcacggcgcagcatgtgggagaggttcttatggactgtgcctggaagtggcagacattgtccccatcacttggtcaaatgaccacacctaccagcaagggcaatgaggaaatgtggtccagctgtgtgtgtacaggaagaagggacagcgaatgctctcccccacaccctgctttcagggtttatccttgtcatttattgagggcctgctatgtgccctacattgtcctaggagctgaggatacagctgtccacagaatacccacggtccttgcccacacatggttagaacctagtgagggaagaagaagaattaatacctctttataaaattaattaattacactttggataagggtcataggggaaaacttcagggcaccatgagagctggtaactctctctatggtgaggtgaaggggaagtagaggaggtttctgggaaacagtgacattcaaactggcaaaaagaaagcaaaacagacttaaccaggcagatgcacagcagggtggcattttaggaagtgggaccagcagctgaaaagtccttaggcagaaaataatttcaaacattttagacccttcctccaaagggcagcgaggctgatgcacattgaagaggccagagagcgccttgaaatgagacagaagagctgctccgggctgagatggaagtcatcttcctggactcagacagttagggctactccttagcagtagtgggggcccgctcatgggtgtaagaaagaatgtagcatgatcagctgtgcttgtcaaaaatctgctctgcctgatgaagtctgaaggagggagggtactgcagtctttcaggggagagacgggggcttgcgttcggggctggcagttgaaacggagagacataagatagattgttgaaataggaaggggaagacatgagactctcttatgtctaaatgtctaacatgggttggaaaggctgcscaccagtcccaggtatgcaggcttggcacttggctcatttgaaagagagacaactaagccataactggtttatccttttcctctgcagttttatggccttcttgacttcaggcctatttaataaaatgcagctctttaaaatggatgttcagtggagctcaaattcaccctcaatgtgcacttctgcggactttgattagtatgcataatagagcagcacacctgatgtccgcagcaggcagttctaatgccggtggagagaggtacragataaatcactccaagtaaatgactaattaatcatgcacttgattttaataacatataccatctggctcaagatttgtctgtctacaatcttgtattccattctagagatttgataatcagtaaaaccacccatggattcctaattgaggacaatttctttcctttcttttagaaaacttaggaatcaaagtgtattccagtaactgcatggaargggctggagggagaaggttattgttatatataaagtcgcggtaccgcaaaagaaatagcagtcgaatataaaattttatttttaattctcagcaagkcaagttacttctatatagaagggtgcacccttacagatggaactatggtgagcccacatttggacaagagaggggaaggggttcttatccctgatgcacgtggcccctgctactgtgtggttcccctgttggctagggttagaccacacaggctaaactaattccgactggcaaatttaaagagaatgatrgagtgagtgctttggcaggagtcaaggcagagcaggtagcaagtaatctgaatgagttagggtgagcaagtgatcagaatgagttagggtggagcaggtgatcagaatgagtcagggtggagtaggtaatggaaaacggttgctttacgaggaagttaagtttagaagtagaaggcaaagaattgcacatactgacatattctttgaaaagaaatttagaagtcatatcttacagttaaggtttgattttttttttaaatcttaaaaccatcatagatatttcaggataatttatgggacaaaatggacactatcccaatgaaaacgtgtaaaatcacttccaaaagtgtctatgccagagggcttacttgcaatgatcctttgatcctccaaatcagaaaacagttttttttttttttttttttccatagtctcatctatgcctttttggtttttcttcttcttttgtgtgtgtgtgtgtgtgttttattatactttaagttctagggtacatgtgcacaatgtgcaggttttttatgtatgtatacatgtgccatgttggtgtgctgcacccgttacctcatcatttacattaggtatatctcctaatgctatccctccccctccccccaccccacaacagggcccagtgtgtgatgttccccaccctgtgtccaagcgttctcattgttcaattcccacctatgagtgagaacatgcggtgtttggttttctgtccttgcaatcgtttgctcagaatgatggtttccagcttcattcatgtccctacaaaggtcatgaactcatccttttctatggctgcatagtattccatggtgtgtatgtgccacatagaaaacagttgtttttaagggtattggacaagggtcatgactgcttagcaaggaagcatcctctacttgtgcatggcttcaaacgcttctaaattaacaggagtatgaaccatctgaggattcacaatttccagtgagtcttsgctctacttatttgaaatggatagcttcctaaagtaacatataattcacctataaaatactattttatctcataagacaaaatgagtccatggtsttattatgtaagactgttttccattggggctggtctcaggstaggcaaggtgagtatctgtaggtggaattctcctgagaacagatgctctaaactttttaaataattgatttgacttcttcaccatgtccatgtatatagctgagcatggccaatctactggtttgtattatactgtcaaaaaacaaacaactttccctaacaaaataaacagtatctcaaacagcagcacatatgtcctggggggtaaacagaaaacttgtcccatttgactcatttcattatttggaagaaatttccatcacagaaggcagatgtcggtggactgataccagatagtagagaaattctgagtgtttactgtgtgcaaaaaaatgctgcattggggggctttaatcagaaatccatgaaaaatagtgtaagtacaatttatcgagcatttattgtaagctagacatatgcatcacctcacttcagaattagcctatgaagtagaattattattgtcctaaatggacaggtgggacctaggttgcccagagaggtgaatgggctttcacagggtttcacaaccagtgggaaaaggctggactcaatcccaaattaggctcattaatcatgctcttgattttaataacaattttgtttgttttttctctagaaaagttacgaattaagttgtattccacggactgtatggaggggrgtgaagggaggaagtgtgtgtgtgatctcaaaagccatcatacatctttccggagagtttgaaaataataatctgaaaatccaaaggctgactcacaactcctgggctgtacctacgatacagtaagtaagaggatggtgtcactgtgtcctcccttctgtcctgaagcattccatgctacacaccattcataagatttaaaatcatcttcaagaagtgccctgttggaataataagtsagtgctctctggaggctataaccaaatataatttgccacataaacatgaaatgtgtgtccaagaaactagtaggaatgcmtctaggaaccaaagtgtctccttcctagagagagaggaaaaaaacaaagtgaggatggtcctctgcacaggcgttgtatattttgttctcaaatccagcagccttgacttgacatgggatggttgggatggttctccacgtagccacataagctcrttactrcccattacatctgcctgtacctccagcaggtgcccaggagatggctgagtcccaagagccatgcaggcctcctggaygaccgccctgatgtggtccacktgactcttaacaggtatcatggccttggcacatgttgggcattttccagcgtcactctcagaagaccctccctccatgagttcaccactgctggtctttaactctcagcttagggaatcagactgaattagttctttgtgttattaaccggaggaacacttacattttctgacaactctaatcttggagctcagggaatagcacagagcatttgtatgaaattacccctcgttctatctataggcctaacagccagcatttgtgaatttggcagaagccagcagatctcacagttaatgtcttcctctcctgccaggatctttggaacaaggtgcttagagtgccacatgacaaagagccggacagatcctgggatgtggagcccaggtgatgttatttgcatccaattaaagaagcaggaatgggtagcataattgacatgcatgactcttaatgccttttggttcattaagcctttggatcaacttttgtaggaagacatktaaaagaaactgagcaggacttgggcacaggtagaggtgagcttccgggctgaatcccctactaggccgttagtcaattgtatgtttcctttttggactcamstctgggttgcaraggaggttgctctgattgtttcttgttataccataaagataaggagcttgagttactttccagctgataaggcaattttcrcctttttccatttgtcttggaatttcacacccyaycccatcctacccttaaggtgccctggaggggttgaagggccattcttggtcatccagtctctgtgtggttgggttgatcacagaaactagagaagtcamgaagagtaggtgttcctcaggttaattacacaaagaactaattcagtctgattccttaagctcggagttaaaaacagtgattgtgaactcatgaagggagggtcttctgagagatataaagaggctgatatatgctctttatatctcacctttgatgatacacagctcacctttgatggtmactctgaatcacrtcaaggcgatgacaagaacaactgtctagacttagtggtgtggctttgaaacgacacttcgccattcagggattcaattgttttccagttttataatgagggagctgagcaagagaaatattttcaaaggccattctgggctgcacaaggatagaaacaaatgggaggtccattgggcaggacacacctgtttctacaagagcaacctacttttytgttttgttttaatcaagggagtgtcaagcaattgcttatttcataaacagggctgtgctgctatttttamacagtgtgaagtccacaggtctgaataatttcttcttgctccaagagttcctaggtcctgtgttcagattttgagagccttcatgtctcaggtcccartagcagtttctatgactgaccagcctgtccacagagcatcycctcrctggacaggcattgtgggcacgctcctgsggaggaagaatcagggtggtgaggcaattagtaggtgttctacaatcctgacrtctttctcagaccagcccccatctctgtctattggcgagatttcttctttagcttctgctcactatgacatgaaggacttcttcttacctagatattctggtgctataggggggtgctgatcagtggagcttagaattactttacacacacatgcctacaccccccctcgcaacacacacacgtaccttacaaaatttctaattataggccaggcgcggtatctcatrcctataatcccagccctttgggaggccgaggcaggcagatcatgaggtyaggagttcaagaccagcctgatcagcagggtgaaaccccatctctactaaaaacacaaaaattagctgggcatggtggtgtgcacctgtaatcctaactactcaggaggttgaggcaggagaattgcgtgaacccgggaggcagaggttgcagtgagccaagatcgcaccactgcactccagcctgggtgacagagtgagactctgtctcaaaaaagaaaaacagaaaaattgctaattatgctgattactttagataaacatttctcaatttgggcttcaaggcatattaatagacatacaaaaaaattatttggtcaagtgaaaataaagcatatcctgcgtcccatagtagggtagtgtattagtcccttctcacgttgctttaaggaaataccggagactaggtaatttataaaggaaagaggtttaattgactcacagttcaccatggctgggaaggcctcaggaaacttacaatcatagcagtggcagaaggcagccatgattgtttwccaggcagcaggaaggagagtgccaagggaagagggaggagtcccttataaaaccatcagatcttgtgagaactcactcactaccatgagaacagcatggggaaaactgcccccatgattcaattaactccacctggtctctcccttgacatatgtggattgtgggtgagagacaggactagctggatttcctaggccaactaagaattcctaagccagctgtgcctggtggctcacgcctgtaatcccagcactttgggaggccgaggcgggcagatcacgaggtcaggagatcgagaccatcctggctaacacagtgaaattccgtctttactaaaaatactaaatattagctgggcgtggtggcaggtgcctgcagttccagctactcgggaggctgaggcaggagaatggcatgaacccgggaggcggagcttgccgtgagcagagatcaygccactgcactccagcctgggcgacaaagcgagactccgtctccaaaaaaaaaaaaaaaaaaaattcctaagcctagctggggaaggtgaccacacccacytttaaacacggggcttgtaactcagctcacacccaacaaatcaggttgtaaagagggttcactaaaatacaaattaggctaaagcaggaggtaaagaagtmgtcaaatcatatatcgcctgagaacacagggggagcgacaatgatcgggatataaacccaggcattcgagcagggtgtggtaaccccctttgggtcccctcccattgtatgggagctctgttttcactctgttaaatcttgcaagtgaacactcttctggtctgtgcttgttagggcttgagctgagctttcgctcaccatccaccactgttgtttgctgccgtcgcagacccgtggctgacttccacccctctggatccagcagggtgtccactgtgctcctgatccagcgaggctcccattgccactcccgactgggctaaaggcttgccattgttcccgcaaggctaagtgcctgggttcgtcctaactgggctgaacactagttgctgggctccgtggttttcttctgtgacccacggcttctaatagagctataacactcactgcatgtgccaaggttccattccctggaattcatgaggccaagatccccaggtcagagaacaaaaggcttgctgccatcttgggagcggcccgccccatcttgggagctctaagaacaaagacccgcccgtatcatggggattacaattcaagatgagatttgggtggggacacaaaggctttcatggtttttggcacccgctgctgtcccctccttttgagtgtgggacrgatctgtgactggcttctagcccatagaatatggcaccttccttcacataaaccatccatctctgagccatccccggttccttgacttcatagactcacaattccagataagagatgattctaccaccttgctgtcctggcatcccgggattcctgccgcgtgggctgaactgtctgcctttcccagtatggaagtcatcacttactcattcaatcatttagcaccctttctcgcttgcttggaaaatacaaggtaaaaaacacactagcctactatttgatatttgtgcgtgggtgtgtgtgkggggygtcatatatccctcttagcatctgataaaaaaaagatcaattcattacccagaaatatgtatctgcatgtgtgcaagtcccaattcacaattcagtacaattctgggggttctggactccctgaggaccatttataagttctctccaagtcattgaccccaggtttagttgsccctctagactataaggccccctagatagaaggcaagtgtcatatgccactgcatccccaactctgaggacaaagcctggtggcaggtggaccttcattcagggtgaattgagctgaattcgrtacatggctctgtactcagaaggcctttatttatttcttgtgttcctcttatcttgtcacactccaaaatagaaatgtatacctctgctagttgaatgactgtttatttggaaatcatcacccaatgcccaactgcatccaggctgcgtgacatcattccagactacaaagtgccaagcgctaattgatttgtaagaaagtccacatgaaatgcctggcactctcccaaaggcacccatgggcttggagggacracagcattggactgttatgcgaggaaataattcttgcttgcccgcctgggatggggtgacgttctggccaggaagcagaagcagacttgactttgggcagcagtctgcccctgatggagttattcacagatggctaagttaaatgcagccctcatagcactaaggcatttcaggggcgactaaacaagtggcccatgaaatggaggcaccagaarcctctggaagcggcatcagtgcatcayccagtgaagccattgtgtcgcctgttagtaatgagcatttgcaagggcagcatggggaatttcaatcaacctgtgagaagacaaggtgtgcagacattgtggatckgagcgagatggggagaaaaggcaataaaaagcagtagcaamggggaaaagaaaagttygggccaggagccaagaagatactttctgtggaaaagggagggaaaaaaaaaatcactccacccctcctgtccaaatgaaaaagcatttaattgaatgttctttatagaggtgaaaaaataccctgtggagktcccagtgtttcattatccgattgagttcggtacctcaagtttcaaagaccgttctcctgaatggttattctcatttccatgtcagtctgccgtgtgcttggtgaacccctgctgggccgcatcatttaaaactcaaaaccctgaaagtatttttatgcccgatatagtaacagagcaaaccctggtatcactcattttattctccgcagcctccttcctcttgtctgtgatgtagatgactgtgctgctcgagatgcttgcaatcaacagggcgctccccaagctctgaatgaggtgaatggcctcagaggaaaacagattagaaggcttagagatgactrcatctcaggtgcaacacttgaagcaggaagatgggagtctcagaattttccccttgcagttagaaaaatatgggacaggctggggcagtaggagtggatttaagtaagtgagacagtggatcaggaaaggccaggcttttactgggtggaaatagcctggatgcaattatctgctacaagccccaccaagaagagcctccctgctggaggaaagcagaaagggaactggggtataaccaagcttgyccaatccgaggcccgtgggtcacatgctgctgagggaggatgactttgaatgaggcccaacacaagttcgtaaagtttcttaaaaggttatgaaatttttttgcaattttttttcttttcttttctttttttttttagttcatcagctgtcgttagtgttattttatgtgttgccaaagatcattcttcttcttccactgtggcccagggaagccaaaaatttgaaaacccctggtttaaatcctctctacaaactcgccagctctgcaaaataatcatctttgttggtcttaagaacactttaaatcaggtttaaatcatctgaacatcagaaaggaatttttttttcttttcttttcttttgttttttttctcccttgagagggaaatctaggggtggagtagagaatcatttaaaatatttcccttcagagaccaacggctaggaatagctgataaataacataaaagagcggtttaatagtttcatgtttgacccatgtaataccccgcacatttggttaatttagaaaatatttgacgacaacggaatccaatctcattttctcaaacagaagcttaatttctctttgactgaaatgaatagttatgttgccatgccttagccaaacaccctataaatataataccccttcagccttaatatttcaaaaactatggttttcagtttgagctgttatratgttttatctsagaagttgtagaataatttaaaccagtttttcctactttgsttccttggaggctgattcttctgcctgaattcctctcacagaacatataaaccccttttacctccckcactggcacaaaagcaacttgtttccaagattcaggacttaaagaaatggctgtgggttggtctacgaaaaccattatgctgcatcctcccagtccygagagattctgaagagaagcaggccctggcttcagagttgaagaaatgataccttccctcctttgcctcatagtctcattcatgatgtttgcttcccatactcatctccaactggctcacacattccttcaccagatagtgtgggaaggagtccatctttctgcagttggctaatccaggtrttggcatggaagttttagctctggtctgagagttctagtcatggacaattgtccatgtctattggaatgaataattttccaatggacatggacagttgtcccaggggactggaaatcaagggtgctgagtaaactcagcctcagtggaccacctgtgtgagttaatacagagaccacattctgcatcttagcaacctaaacaaaggagaggcacagcaaggtgagaagcttcaaaaggcagtcagccaatgcatcaacctgggcccggaggggtcggggaacctcaaattgtcatccttatgtaacagtgacaactaacatttttcaaggctcgttaccatgccctggccacctgtcccacattattttatggaatgctcagtcaaccctatgaattacatactatattatccccattttacagactacaaaatgaaggtttaaggagaagcttacacacctcacccaaggtcctacagttgttaagtagggggacagagacctgcatttatctgtagaccctccactcttaaccaccctattgacccagttcctaatccagctcacttctgagctctggacgtccaccaggaagaaaacaatggctgtagtggtgcagtgacccttctttgccagtttgtcttgggtcctgatgagctgccaggctcagtctggaaaagtgccctcaatccctgcatctccatctctcatwggcattgtgggaccccacaaagactctgtctctattcgcttaacacagtggaaaaaaaggccacccttcattctttttttttttttttttcattcaacaaacatttattgatcttctaatgttttttcaagaatgcttttgggcctsggatacaaactaatggacccaacagatgagtcccttgccctattggcacttactggttcatgtcaggttcctgtgcctctcctggagaagcaggtgataaggtctctgtgttaaaggaggaaaccaaggttctaggcagcctcktgggtaatacagycagtaaaytgcaaagctgggtgaactcaattgacaggactctagccagaaactggttctttgccattagtctctactgacccctatggatgtatggagggagtatggggtacctgggaaacatcaagccttacctagaatcatctttccaatctcgctcttctcttccatttagaaccaccttcaacatctccccagggtacattccctaaayagccccgattattcattattttatggaactaccagatactgaattcctgttctgggccatgcaytctrggagctgtgatttcaacagtgaaggaggacagggtggaccccaccatcgtggaatttacmttctaaagggcacagtttttctgttgagtcttcccaggaggtgtctttttatttcatacctttgaccttcagatccattcatgatactttggcttatgggtgttccacacttgattccaagggtgatattccatatgtgtaatgcctcgctcaatcagaatggacactggccctagtggccacccaagatggattcttggagcttctttgctgtgacaaataatgaccttttagttgacgaattataaggaagttatgggagatcccagaggaaggctttaagacaggggaattcagagagcttggagcagcagctctttacgtagggccacagtgtatttcagtgtttctccaacggctgcacctgtggacctatgtgtactgggagactattgactctgctcagattacatgggtaagtttgctccttacaactagactgaatgcccattggaggcaggatcctatcaactttttcttctgccaaaccagcctgacacagtatacattgcatacgattcttccatgactatgtacttgtcatgagttattcctcatcattctaaaatttgacctcaaagctgagcaaagtctagawgaaatgaggttctagtttttataataatgttcaatagtttttcctatacgtcactctttcagtgtggggaggaatggtgacttttcagttgcttctgaatacggtttgctgtacactgtgtgttaccagtgtgatttgctataacccagctcttggagcctcatatggtatgtggttcaacagtacagtggtcagtcaagaataaatacagagcaagtactacggtagctgcagaaagagcatcgccaccatgcatcattagtgcagagccctggaccaaaggactcgagctgccgccagacctttacccattccaagtgcagactttgctaattcatcactgccttcctcaagaccccagcaagcttctcatcacatcacttttggcacttatctgatctttcaatgatctgagttagctcaagaaattacatctagttaccataccatgtcaagactgctatttaactagaaaacaaagagacttcctccactccatgcaaacacatgttgattctcatttacctgtttaggaaaaaaaaatttagattcaggctcatatactaattttattcagtgcttaaggtatgtctgttatttgggatagaattcagtgaacaatgctaaggtttacaagggcccatgtatgactttagggccgtgtgtgtgtgtgtgtgtgtgtgtgtgtgtgtgtgtgtgtgtgtatacatgtgtatgtgtacatacttttccccctgtaataggatttctttagatctgatgcttaataagacagaaagacaccacagccttctcagaagacctttgcaatatgtccttactactggtttgtgctttcaaagttcatgtgtgtagtggtctctcctgtcaccacgatggatccagatttaagatgtcattgagccatcacaaagtaaagagacactttctactccaggttgctctggggtgagaaaactttgatgactaaactaaaggtaaaatcaattgcagatgcagtgtctgaattggatatgaaagaaaagaggctggcatttattagctgtctaccggaaaccaggttgctcttgaaacaccgtctcatttaatcagaaaaatgaccgcttgcagtggatatcatcctctccagtttacaaatctagaaaacaagtacatcaaagcagttaagcattttcgtaggagccgcacactcagtaagctaataktagaactcaggtctgtctgatttcagagctctttccacactacctaaaatattcatgcaccagatgaaagctttcttttttcccctagactgtttcttaaatttgtagttctgctttcaatacagggtttcttgaaatgtgatggtgtgattagacttctggttattactctccaaccatcatttctaagagaattggtgtgtgaggctgaagggatgatagtagggtgagccgtaaatacaggttaactgtcttaatgtggcctgggcaatgtctaattactcagggctgtttttggaagacacttccccattctaggataggggttacaagcacaaatgtccataggagctgggtagttactgtgaataagtgccataggctagcctgtttgggtttggggagctgagtgaggctgtactgggaaacacatgccccaggtagagctgggggttggtgtctttgctccgttaagacgattgcaagatcccagcaagggatcttgaatatttgcaggttctgggttctgtgttgagtgcttaaatggatatcttatttaataataacaggaacccttggaagtgagcacaggtttgattctcactttgcagataaagaaamtgaggcccagaaasgtgcccaaggaagcagagttatttaggacctgacagaggtaggattccaacctgggcagtctatcaccagagtccttgtttaatcactaaattttgtacctcttaggactattcaaacccagcaatttgtctctgagaatgatagataaacatgaagatactggagaagtcaattatatatmcccctaaaatgccttcagcgtgttcaaaagcaccgagctctccgccatgatgtttgtaagggggtgacgttagatagtgatcaaagaaaagtctaatacatgttattttttgttgtacagttcagttccttgtacataattcatgtgtcaattgatactcatgaaagttggtcttgaaatattgtatacagcccaaattaagagcttggcacccaatycccacttggactacaaatcacttcctcttgccaaattagagtctagagtaatttaccgtaagatgggcttttaaccctaatttctagacatactcagcagtctgctttgaaagctcatcagcttctagaagcagctcatcgttaaggagataccatcagggtaaacacatcagttyagtcttttttgcaacattgctaattccacgttgtaatcaaggagaaataaatggaaaactcttacttagtattagtttatttagacccatttatttccatcagtgaccttgggagatagttggttcagcacattttctcatattcggcctctaattcagtgtgggattttgtgtttttataattaacagagacatttacaaatagaaaaaaatatatttgtgcttttgggaaaagtgccaacaatgtggctatggaatttgattttctaaatggagactacacaaagtgtagattttttatttctaatgtatgtctctgcctatctactgatgatggattttggctttatggcaacccactaccaggcttttagctgtcagaattggacaacgtattgactcctaggtaggaaccgtggaaccactgcgttatcatgataagctggtacaagcagagaggatctattttctaagcagatgtttactaagggactactacactcgaatgacatcacatctttgttagcagttgtggttggtgccatgtttattaaaagacaggaagaccctttggttggctgttaactattgcatatttgtctgtcttgtcaataagcatttttttaaaggttacttttcctttatgtgtttacttggggttaaaattttgggattatgacaaaggccatattttgagattaygacaaaaaatwattcaaaaatgaattattgaatgaggaagttgggtctcattcagtaggttaggtctcctttaaaattgtatttttctcgtatgaagacccagttcaatgggtttcatagccagtctgaggcaaaagctggctatttacttccaaaaggacttctcctcaaggaagagaccccctagtgatacccaaatmataaatcagagttcttaacttgggatctatggaacagagatcagggagtgagtcttagaaggcccgttaacctcccagtatgtggaaaaatgcttcagatgttgacacatttcacagaagtgtcatcacattaacaaagggctcataacscataaaagttaagaaccattaattttcaggtaattcttctaaataatgggtcctggccagctctacatgatttggagcatatttacatacatttgcatactgcttgtccttggtcatgccattcaactgccacacacctcattatagaaaagagaaagaacaggatttacctaaagctcaaaggaatagtgatcctgtgctaattaaaatttgttctggtatttgggagtctcagatgagaaatctggagtcatgttgagtttggttattttactcatttgtagtcagtattcaattattttaatttagcttgtgcattttcatgcaccttatttcctttttcctcctttcgactccatttggtacatttcatctcactaaacaaggagaaaaaaagggaataggagttcttgaaactcaaaagcagcattaagttcttgtctgtgacccttattgagcaaagattaggaccagtgtttacaaatttttcaagtactctcaggagctcttgatgcttagactctagaaaatgttgggtttgttcttaagaaacagaaagtgtccaaatcccacttggcttcctaacctctcagactcactctctgccctacagagccttagaaggatggccaccaacacctatgagatttactcctgaatcatttgtctcaagccatttcccactctgctatcagcctgtttctgttaacctggctggtgattccacgaatcattgtcccctttgaagatctatctaacctcctggcttgatgctcctcgagggacctctagcttctgtggattcaaatgctttaaggaaaaatactcagtctaatccacactgtctctagaaccagctagctttgtgcaatcattcaggaacatctctggccctccccacccacacactttccatcaatccagaaatgatcagattcagcccttgctcacagatgtgaagccacaaacggcagctagggtcaagaacagcaaggttactactggatgctgactcaaggcaagaagaggagtcaggcacaaaattctgaaattagtcattgagggaagtacaaagcttaaccgtagacaggaacctggaaatgctgggtcagcctcttcgtctacccgtacatgacatacaaaattattccatgttacttcaatacttttacccagagccttgtaacaatcttcttgaactgttgaatctatacaggtgtagattggrtcaggagatagctttaaaagtttgttgttcacgttcgtgccaactcctggtgtcttagattttgttcccaaacactcattatgacaaaaggatttaagtgcattctatttatttgtgaagtgatgcaggaaactacagtaaggagtgcggatgtgaataagtggaaggcaatacagtgtgtgtgaatggtaatgtcamctccatgggcgggtggggctcagttccgttgaggatctctggaagactacatataggctggctcagagctgtgccccactggggcagctcactgggttatttatctatcatctccctcattggttggagcctgcttctaaggggcataatattcaggtgctttccacctgccaagagaggaggccaagcatgctccagtggccgcagaaagtcctcagcagaatcccagggtcttctaagaagaagacgtggagatcgtgagaatagtgagtgctcacagkatgtagcggggacaacaacagtgtctcccacaaccagcattacagataaccaggagtcgaccctgatgaagctggtggctttctcagctttacagaatgctcttttctgcttcgcctggcaaaacaggaggatatctgtctcaaagttttcaaagaaaggacattcagtgatctgttgagagattcagaggttctccttttctctggtggtgctctatcagggacagatwggtccctaagacttagcagcaaaagggactctccctgcagaagcatgtrcatgatgtgagtaggtgtgcccacagcccagggttcatactctggggcttcatgcccttttcctattctttgtctccaaccgcatcttataagaagtgcatgttaggaaagagtacactaaagacaggaacagttactggattaatataactttaaaggtgagcatactggggaaaagtgaacagcaacccttaccagaatgtttaggtacatttctgcctccctcttcaagctgccaggaaagtgcactgtaagttaccaaggagcaaacttcagcgcttttccaacagtcacaaaggactctctgccaccatctgtgttgcatgtgygctttacctttgctgtcctccttactttgaaataaatcccacccactacggtgtcccatttcagaaactctraaatactyacttgaatccctggaatggattcatccaaccctgttcggttttcttccttccagtgtgctattctatagtagaaacagtgccaggccatgggatttagacatcagaggcatttccaggtttataaaaaggcraagactgtattaaagtatttgcttttaagtttgttggccagttcttctcactgaccctggataggtctaggctactctcagcttacctaccatgtctttgtaagatgtgtagtccatggtgcttgaatagcaccacaaagaygtggagaggtaaaagacataagatgatctcaattttgaataattctccttgaggggcaattatatatttttggaaagttcattcttatttattgggcctyctttatctcagaattcaggaaggggcagagtgttttcttcccaagttactgactttcttagcatgcgaggctcaaatgacaatgattatttagaatctctgagcagctcagactcagttttttttgtaatgccagcatataggtcaaatgtgaattccttacaattttttctgaatkggaagtttarggaacgactccaatgttcctgtagtcgctstaagtcgtttaggtgtgctataggatgaaaagaagaataatgaaactgtggtatatgcatgccgtgggatatcattcagtcatacaaaagaagaaagtcctaccatttgtgacaatatggatgaacctgcaggatattatgctaagtgaaataagacagtcacagaaggacagaaactgcaggattccacttatatgaggtatctaaaatagtcagactaatagaagcagagtagaatggtgatttgggggagcagaaaggggaaatttattgctcagtgggtataaagcakcaattatatgggaaraaaaagttctagagatgttttgtacaacttagtgcttttaggtaacaaaactgtaatgtgcacttaaaaatgtgttcagaggctgggcgccatggctgatgcctgtaatcccagcactttgggaggctgaggtgggcagatcacgaggtcaagagatcgagaccagcctgaccaacatggtaaaaccttgtctctactaaaaatataaaaattagctgggcgtggtggtgcgcgcctgtagtcccagstactcaggaggctgaggcaagagaatcgcttgaacccaggaggtggaggttgcagtgagctgagactactgcactccagcctggtgacagrtrcactccagcctggtgacagagtgagacttcatctcaaaaaaaaaaatgtgtttagagtttagatctcaggttaggggatcttgctacacacacacacacacacacacacacacacacacmtgcacacacatacaaatacaaagaaatacaatgaagcttttagaggtgatggatatatttactaccttgattgtggtgatggtatcacaggtatatgcatatataaaacatatcaaattgtatacatttaacatgtgcagttttattgcacgttaaagatactttaataaagctattaagaaaaagaaataaaaacgtttgctttcatatcctcaggtcatcatggattcggatcctagttctcttgtgtgaacatcttcctcattttccccatatgaaaaatagtggatttaatatatgccttatcacatcagtttgtggattaggagacactgtatgtatgaaacaccacagtcaataattggtaggaatctccttacccttcttcccttggtatgtagcaacttcatgaatgaaaacactttccccaaataggtatctcacagagaagaaaacactatgaattcatgacccatttgcatagttttaggggttaaaagagctgtatataaattgtaaaacatattaagaaatttagagaaataatctaagggttatcaaagaatgttcaaattccctcagattttgtttttcaccttatctaaattcatattttcatccctattttaagcagaattattcatagttatctacttagcagatgttcaaggatgatattctctttgtatccatctttccttatccagagrcgtaaaggaaaagcatgaagataagggacacggcatcgttaagtatcccgggtttgttaacagtagaagagagtgtggacttgcttttcactttcattgtgtgtgtttctaggagatcctctatcttcatgctcagcccccaggtccatgtgtccttctctctaataggactgtgctatgatagctgttggtgggagagaggtcttgcaacctaaaaggaaggagagccatatgcagaagagagaagtgattagatgataaagctgaatggtgactctgaaaaacaaagtaactgtaaatttgtggaacttttggtctttcttctcatttgatgattagaaattttttagctgtccaaatccagtccttgtcttatctcagctatgcagagtggcatggctggttcaagctttcartgaagaaacagatgtatgaggccaaatcttgcaaaatgccagaagagtgtatttgggcagaataccaaaatgagttcgggggcctatatggaactgcgggcagggccaatgacagatagttgaggactgcaatgagagatgcccaaatataagtatgacaagcaggaatgtcattctgtgagtcagagtcaaagtcaaaaagactttgtaaaaatctactttggagactaggtgtgggtgtctgatttagaacccttctcatagtctrgtgatttctaatggtgcttttgccgaaggaattcttaggagcatccaagttccatcttaaagacatggctttgccagtctgttgtgggtgtgctataccatatcagacagagaaataaggatgtgtgtgaaggtatgaatctccggttkacgaactctagtgtgcaaataagacaactgtctgtcttttaacatggtacgcacatttctgttttgatcaccctttctaccagttggtgaaaactttagcaaagtccattcattgtctccataatcccctaggtttctatctaattttcattgagcttacaaggcacatggcaggtgggaggcactctggcatccactgagatgttagtgaacccatctggtcttcatttgtttccttmcaagctcaagggtgattgagtttgccagccttctstccactgttttagtcttttcccaaagcatataaggactcttctcttgcttccttgctgaactgggcttggagatgcagctcagagagaagacatgcccttgtcccttcataataaaccatcaacatgtccctttttacatgtctgctatttgtctcctcttctttccagcccagggagtctttatctagataataggtcgagtaacctggaccacagtccattcttccctgtctaccattgaaggtacaaaacgtataccagacacctttaagatttagaatttgaaatacaagaatgtgggttcttacaaaacaaaacttggaattttaaagttaatttttgttattcttgagctctctgttttttgttttgttttgttttgtttttgtaacattatctctctcctgaggcaattaaacagaaaaggagtaatgagcagagtgaaagttaaggaaaggtcttatttaattcctgcccaaactttcagactgcctgatgggaaccccagttgaataatggtgggatttttgttgttgttgttgttgttaagcaaagatgatttccaagctctgcagggcagggagagctggagagttcacatgtttgtatttgaactcacatgaaacaatgaagagtgaaatacagtcctgtttctctagcagtgaaatttcagatccacagagaaacaaggctttcattctaccataaagaaggacaaaacataactgagaaatacagtgtaaaaggaggaatttgcaaagaataatatgctctagcatattccagcaaggagtgatcagatgtgggcatagcagtcatcattggggtgaaatccaagacaactatgggtagcaaaggaagcagctatctttgagaaagtaagactgataaggttttcagtccaaatgacaagtaacttctagtttctaagtataaggttttgcagttgggatcatgcctttttttttttttttcttaagaaaaaacttaaattgcttttactgacaacagacattgccagatttatccacacaaccagtgttacaaatgtcatataaaaatgcaatgcagcaattggccagattgttaagtaacgtgctataattgtttttatttgttttaatccctgtgaacaaacattttattttttgtccaaaagacaaaaaggagttgaaattttatcgttgtttttccaggcaaaagaaaatagggtatttgttgactgaagaaatgagatatttctctttggcmgtttgggcggcctaattgataggaagaggtctggtagctgagaatagcagggttagaacaatagaggattccaagatcaaggggaagggtcagaggttcacaattcccaactggagtgggtgagtgggagagaactttacaaaagaaataagagcaaaaccatctgggtaaaaatgacaccatgtcttgatctstggtgctaaggacccctggaagtgcaaccatttacactcgctcttgaaaatgcctcattgtgggttcagggataataacccttaagctaaagcctttatgagttggaagaagagaaaatgtgcttcctgtttcttacagaggatgaaagaagcagttaattcccaaatccagcctccaaacaccacaatggagcattttatatgtggaggaaaattgctaaaggttatttacaattagatccataaaaataattactggggacttttaacaaactttatttaggctcttccatacttaagacacaattctcaagaatatcttgggtaattttcaaactgttcttttccttaaaacgatcaaagggaattggttattatccaaggtcaacttattaacgagagacagaatattccccaattacagtatttctccagcgcagttcttactgagctctaggcaaggggcaaaatggggaggagagagtgtagtcagaagtcccagggtcttacttgggtctccagctaactagctcagtgagcctgggcaacacccctgacctgtctgcatatgtttccttgtttgcaaaatgaaatgagaggggataattctaaaaatcctttctttgtgctcttcctaattttttttagaactgctaaatcattgcacgcatgaaatgatttgcttttgttctctttgaaataatggagctcattgtctaggatctccagcttctatttctgtgaagcaagatctaacagcctttgatacctctctgtctactttctagggaattacagatataatttgtggagacacttagtcaaaaattgtcactgaatgccttatgcttttccacaatgctttcagagctgaatccttataggaggcaagtcagagatgaaataagaaggactgacaggaaggagaggtgtaaacagagctcgtgaacacamatgaaaaggcaagtgataggtacacaaggacatcaccaagaagaaggctctttttctgcccttgmagtataaaaatagttatttattttttcataagatgatgttggaaaagtttcaaaggaaaggcttctagtgtttgatgagcacctgctgtgtaacgggcacaggttaggcaattttatamaagataaagatgtttgtacccacttaatggataagaaaattgaggcacaaaggggttaagcagtcttcccaaacttacccagttattcattttaactgctgtgtcatgttcctggtgtgagtctgccaaaaattaattcatttaacctttttactattgtttttcatgattacaagcgtttctgtagtgagcatccttatacctgccctcatgtttacacataagagtatattttttaggtaggtgcaataaactaagcatgtatctgtagatatgtgtatatgtatgggtatatatacacgttatatatatgattgtgaacatgcatatacatatgtatgaatacatatgtgtttgtatatcagtgtatgtatctacatatatgtatttttctaagatcctgccaaattatcattgcaaagtggctctgtaaaatttcactcctccccaacattgaatgaaaatatctgtttcctcatactgtcaccagtgtttcgtgtcaccatattttaaacatttgccaagctattattacattattttttcatgttcatttcttcaatcacaagtgagtttgaccacctctcaagttatttacgtccaaaaaaaaaaaatcactgtaaatgaaaaatgagtagtttagccttgccctgtgctgtgcagaaagccggtgagtttcttcctgaagaggatgctgcagggtcatttgacttggagaggagggagtggtaagatcacattatcattaagaattcgctcagggcatgtaaagatggctgagcagcttctttaagcrtgtaagtgatgacgctcaaatctatcagaatactaaccctgaaatcaggtctgagtttacagccattatatctttctttggatttggtttwatgtttttacccttgatttatgtacgtacttcccttagcatcccatatctcaagcaacataaaggtattaaagtgatgggatttagcaaatatgttatggttaccatctttgttcccaagagggaatttggaaatctgacaagtattatacctttcattttcaagacccgttttctgagccgtttcgctaacaagtcccctgatttaccatgccattaacaaaaataattctttctggacagcagtaaaagaagtggattagaacaatttacagccttctcaagatacatataaggtgcctgttaagaaaaaaaaarggacagatttttgattaactgatacgtagacttgcttttaaaacatgtcagttcattctctgtatgcccatctattaagggcaatgtccctcatggaggaagcctgccatcgcccggtgccttagcacgctctcatgtttgccaacagtgattaggaattacttagttgctgacaaccctccatcattgatcgaagtaagaaaccttttctgcttcaaggtaaggacatggtgcctactttctaaatgagatgttatccagagacaacattttgaatctgtaggcaaaaacgtatccagttcaacaaaagaataacctgcaataagcagagatagaatgggtgaggacctaggacagcggctcattaggcagaacccgtcctttctctttgctaaagttagggaggaaacaaatgcctgcygaacagaaggaggagatgagaggatctgtcagccakggagaggtacagctaccagaaaagcactggacagtttcctctaatccttgggaactttaatcgtctcstcaataattctcattttgagaggatctcaaagtggagggatccattagtaagttccactttggcctggaatgagagatgccgaaaatgacaagggtgcttttctgtggtggtgtaagtagcgtggccgtggatgtgggcaattggcttactccagtctgtggcattagttagcatctctgaaaccctgagacatgattctcagcccccatggctggtcaagggattaccagagaagattttcaagtacatgggattggggggtgctcccaacccttcagtcagctgtgggttttgcgtgtgaagagcataagaggggagagagaggaaatgagagaagctggaccatgcagagccttgtaggtgatgggaaggattttgctttyatcctaagaagagtgagaagccattaataggattcggggtgattgtgagtcagggggaaatggggggaggtatcaggacrtggaggtctttgcaattattagttggagaacagcaatggttcttagctgcttcgtgtgccctggacccttctctcagtctgctgaagcctgggcagtccatctcagatcctgttcaggtgcatagattaaaatattttaaattacgatataagctacttatgctataccatatttatactatatcattgtggtaataaagaatttgtcatagattaatagacaggcataggtgtcctggaactggttctgtcttaccagcttgtcaaagctgattacgcgaatttctttccaaattcttactcagtgatgccaaattggtagcttgaaatcaagccacggtgagagaatttatatcatagaatatggaaaacattacagatcaggacttttcttctcaaaagtcagctgttaaacattgaccatcatagcactgtgtatatacttatgtatttaataataggctttggtggcaggtttagtaactattgcaattttgaagtagtgatgagtatgaatcccatttcaggatatttcccacaattgaaatgtgatataataacttttttcctataactggtgacaaacacaggttctgctaatactattgtgatttgttatctacattcatagttgaagaacctgcttaattttcgttagagggtaatgaaaataagggtgcatttttccattgaaagagcctctgaactacagtgtccagaaaatgagaaaaaagagggaccatagagaccaactagaaggtgatagcagtattccaaatgagttgccatggtgtcttgtattccagtgaggagatggaaaggtgtatatggaattggaaatggttagtagataaactctatgasaattgggtatgtatagacattggggtgaaggaagtgtcaggagtgacttatagggttatggcttacaccactcaacttaataaggatgagaatgccagaagggcccaggtttagggaagatgaccatgagtttggttagggcctgttgagtttgaagtgccttttgagtatcatggwaatattaaaaagatattgggacacatgcatttggaatagagacatgagtaggttctaccttcagccttggggtgggaccaggttasgaagggatgttattctttgatggatgagcagactacaaaaarctgtgccaccctttgtctctatgtattcacactgcttcccctagcacctcttctttatctcctaacaatcattgtgccaacagactgcctttagaaactggcagatggcccctcttcgaaggatcctgtgcatacagagtaactactttcccagtagctgcatggctatcttgctggatctgcaggtccagaggaggggctgggacagtagaggagcactaggaagtcattaggatatttgcaataattgaagcttgcatcctatttgaaacttccccaaagaaaaaaatgagcgagaagagtggtcagcagkaagccttgaggagttccaaaatcagtggccagcagaggtggaggagcctaaaaatgagactttggagggagcagccacaaagataggagaaaagccaggtgaggtggtggaggtgcagggaagacaagcagagagggtgcttcagtgagaagagaggagaggagtgaaactcaaagtcgcaagagaacactggaagttcttccctgcatctagtgacacggagggtgttaattttacacaggctgtgttggtggaggaaaccagatgggaggggaagaaatggagataacagttatagacacatcttttaagaagtttggcggctaaaaaggagacagatagtgaagtagttggaggtggatgtagagaaaacaaagttttttttttctttcttttttatttcctttccttctcttccttcctttttccttccttccttcctcccttccttcctcccttctttcctcccttctttcctgtaggagatactttctcataaggattcatttgagacagagagggtaggagagaagggattkatgatggcataaagcttctgagaaggtgggaaaggatagacttcaaaacataagagggacctgttaactttttaaacctgggagttgaatcaatgaaaaactgagtcaatgatgtaacacttttaaaggtagttgtttattgccccccatcttagagaagagccttttctggttacagaagacaaagtgatttaatgtgtgctgaagtaagctggaaattcaggtgttcagttgatgtttttggagtagactgtgaaattgaaattggagagacattatccaggcaggaaaactatgagttaagggctctggacaataaaaaaaataagggtgtcatccttggggaaggagatgggagatgctgatgcgtttagggcttcagagctgcacctgtgctcctcttgggatcagaactgcagtatctctgcagctgctgcaccttgtttttaacccctgcatccaagagctgagtgttgcatgactctcaagatgcagatattaaaaccttattgactgatgtagactyttctgtgcatcaaagggctcagaagtggtattagctggctgtctccttttaagtgcagagagtgcttttctgtagatagtgctatgagctacctggggttaagataaaaggcttcaaaaaggtagtgtcttcccggaggctgcttgtggccactcgctgtgtgtctgtggctatacagaccccagattgctggggctggaytttgcatgtctctctctattaccttctagagcctgtgaggcccaggcttttaaagattcggcactgaaagaaactaaaaccaaacttttgagtttacaactgcctgaggctgcctccatctacaggacctttactaactgtgccattttggcgaaaagatagattttgaagttcaatcagtcytggtttcaagtattagctattcctcagatgattgtgggaccttgaacaagtctcttgccctctctgagtcagttttatcatccatgcaatagggataatattacctacctcataaaaccattgtcgagacccatctattcagcacatacttgagttcctattcaaataccggctgctgtgcttggctgtggagtctaactgcacaaaatggtcttgaccctgagggttttatagtttgagagtggatataccaaagtgcctggctgtgattattatattgtgatataataataaatacatatttggtctctgcccccagttctaatatttagtctgtgaacccagttcctggcacacagcatctaagagctttgtaatttcctgagtgacgggaacatctgacacagagctccgaaatcccttggtatttcctggctgataggagcatcttttgctctaatgagttgacttgtgctgggctcctggatacccccaggatgggtgctggtttccaggggaatcaaccatgtatttttagaaggttggrgctttcatcatccaccccacctccagggaggaaagggaggctgaagaytgagttgatcaccaacggtcastgagatactcaatcgtgcctatgtaacaaagcctccatgataaccccaaaggacaggggttaaagggcttccaggttgctgaacccatggaggtttctggagggtggtgtgcccacagagggcatggaagctctgcatacctttccacatacctttccctatgcatctcttggtgtgactgttcatctatactctttgtaatattctttataataaatgsgtaaatataagtaaagtgttttcctgagcacttctgtgagtcactgtagcaaattaatagaagtcaaagagggggttgtgggaactccaatttatagtgggtcagtcagaagcacaggccacaacctgggccttgtgactggcatctgaagtaggggacagtcttggaggacctgtgggatgtggctttatctccaggtagatattactgaattgaattgaatcagaggattacccgctggtgtccactgaagaatggcttgatgtattggggaaaaacccactcatacttggtgtcaaaactgttgagtggtgtgtgacagtaggtaaaacattttgtttttttttctatccttcatattggcccagagagcttatttaataaatatctcattcatttcttttttcttatccattataccgtaggctcagctgaaaacatcgttcatgacccacctgaatgcacagtagggtacttagaaagtactgcatggttagcagacagctctgtagggagtcggaacagccacgcagtagagtcttggaagcagaagagagtaaggcacagagaccccgaatgagggccgagtgtggacatccacatcacagctccacccatgactagtcacaggaacagagacagtcgacttgcctctcactctctgcctcagtttcctcacctgcatgatggagacgataatggtacacaattctaaggtggttgtgaggattacacgagctggtggtgttgcgattctgaggtggttgtgaggattacacgagctggtagtgtgtgtcaggtgctcagaacaatgcgtggaacatggaaaacactccctacatgggagatattatttccatgttcagaaacaagctggtttcattaaagcccactgctctcaaaaggcaattcccatgggaatagtgatgacttgaaattctgtatcaaaatgctggtggatgctgcttcgtttgtagtttcttttcttttccagtctccacagggctctgttatttggatcctctaccatgaagaacagtgcccctaatcgtagactatcactttgttggccactgtgtgttgtccacccattatactgtgaggtctcaacagctttaatttcaataatttgaggtttgttcaatgcattatattccagatagttcacggatgcttttaatttaattataggcactttaacaccacagatgactgttggggaaacggaaaatgtcattctttctgaatgcaagacacgtgtttaggactgataaaatacataactgtgttttatttcagaataaaaagaaatgtattaccaagtatgtgacagtaggtagactgctgggaagcctgggtctgatacattgttgtcagaaacaggctcaattttggtgaagcgaagggtgtacggaggatgagccttgcaaacaagctaaggtgcccaaaggacagctcccccagtgacctcagggtcagcctctctcttacgtacatacaaggagcccctcctggaagcaaaccccactgcagccttccaacaggcacatccttgttcttcccactatcttattatttgtagcagcaattattcattgccatctgaattcactcagtaaatatttattgagtaccctgtatgtgtaggtagtggtgatacagcagtggacacacagacaaaaatccctactctgaaggagcttatattccgggggraaaaagagaggaaaataagtaaaatgtgtgctggttttgtgcatgaagatggcaaaggctatggagaaatcaaggaggatagagttggggaggaacagttgtaacttccatagtgtgggtggagaaggcctcactgaggcatcaacatttgagctaagtcttgaaagaggcaaaggaatgaaagaggtgccaggccaaggtaatagttcctataaaaatcctgagaatggagagtgcctggtgtgtctgaggaagcccaaggaggtcatcatggagtgagggggagataatagaagatgaacttcaaaaacgaagatgtgaaaaattgcattgatccttgtagtccatttggaagggtttagatgttttatcatcaccgtcgtcaccatcatcactaccacctgctagaaacttcggggggcggggggtgggggggaatgactcatcatctcatctctgcactcctgaagctcmaactcagcacaggatacaacgaaaggataatgtgatgcttggtaccaagactttaaggacattcaggagcggacagaaaacatgacctaaaagagagggaaaaacagagactttttacagggtctcccttaggaaagggagctatcccttaggaggagatatctaagccactatgcagttgtgaggtctttagaaatcaaccaagtgcattggtcagattgaggctaagttttccaacacagagaaccctgaagtcccattctgtactttgtcttgactctcctttcatttctctttatcactcttcgccccccactgcaggtacctgttcctttttctgaccatgtctctggacttggagaaggttttctctcataagcttctatccagccctacacccagtggccatacaggtccacccctctgtatggctctgtgcattaatgagcagctcttcttagctcagcgtgctcactgtctttaggaatggtttctgctgaatccattgactgcacaataagcccagtggaatgtgtactctaggccccagttacctccaaggagaagggatgataaatataacagtgacaaaatactctcatacacacagaaatatatagttacacttaaatgcacacasatatatacatacaaatatagagtgggtgcagtggctcacacctgtaactccagcactttgggaggccraggtgggtggatcacctgaggtcaggagttcaagaccagcctggccaaaatgatgaaaccctgtctttgctaaaaatacaaaaaaacagccaggtgtgrtggtgcacacctgtagtcccagctactcaggaggctgaggtgggagaatcacttgaactcaggaggcagaggttgctgtaagccacaatcacaccactgcacttcagcctgggccacagagtgagactccatctcaaaaaatcaaatgaaaaaccacatatagttatatataaaagcatgcacgcatgcatgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgactatacgcacaatgcacacatgtttatatatgaatgtattcactcatacatgtatggttgtgtgtgtgtgtgtgtgtgtgtkttttgggaagactaattactccaggagatttacatgtagtttcccttcttaagtagatcacaaccctgctctgcatttgctgccattgtttctgttacgtagatgaggaatttgagtctctaaaacttgaagttgcccggccaaggtcacgtagctagtaagttgtgaagctgatattcaaactaaggactaaaagayaaaaaagaccactttcttccaatgcttaaaagatgttaacagaaagagagcaaagcaacaacaagaaagaaggaaccctaagtatgttcatcgagctactcacagaaaacagaaaatatgattacaacataaagtgataatttccataaaagaaaaagttayatgagcacatacaagagggaataacatttgaggaatctcttgaaggatgggtaggagttttttagaaaggggtggggaagcaaaaagattttgcttttcatttaaagttatgatagccaacatttaccttttagaggtgctcaaaaggcccactgtacctttggcttcatagctgtagaaatcgggcattttmcaaaaaaaaggcagtgacggtgcctcacatctggccacaggcatctctcggcagcatgcaggtcatctagggcaagtctctgtaaaggcctttctctctggtgttgcatttgcgtattcatatgtctgcatacaaacaccaagtctgctgttagtggtgtcataactttgcaaaaggaagaaaacatggctaacggtaaaatgagttatgcctttataaaacattttcaatgacagaacttgctcccctctgagtgctttttgaggatcagtaatcataaactgtggctttgccaggaggtgctgtcgaagattgtgtggacattctttcagcaaaatcatctggcatgtgtgattgcttctatttattcaatactaaagaacagaagattgagttttatgagagagagaaaaatgcacattccacatagagattggataaatttcattgtttagagtgtttttattgccacaaagtaatcttctgattgctaggtgagtaatcctgtagttacaaaaacaatcaattaattgatctaaattaatcggataacatattttagcctgctaagcatgaaggcatatttcaagtaactttccagataaaggaggtattgaaccttttcagccaccagccagggacagtgacacagattctagtatcaaatgctgattctcaaattaacaaatgctggaattactatgagaaaggcatggactagggagtcatgaagtcctcccccttttgttatacaggaagcttctaagctgcctgtcccactgttcctccagctcttttgtcccaggcttggccctactgggaaggagacttccctaacttctgggctacccctccctttccctacctctagccacactgtgtttcagggagggcaacatgggagacagaggaaattaagacacctgcatgaaagttgacagagttacccaagaggagatgccactgggcagggactggagagcactcaagggaagggaggcaagtccgtcctttctcctcctttcttcttcaaaatgtattgaatgcctatgcttttccaggcagtttttaggcacttggaatacatcaatgaataaatacggcaaagatccctatgcttgtagaactgacattctagcagaagagacaactaatatataaataagtcacatagtattttagaaggtgatatatgcaatgggaatagaaaaagcagagccgaatgagggctagatggatgctgggatcctaggtggagcaactggctactgttaaaatttatctgagaagtggttccgagagacagcggcagcagtagaggagaacacagcagtcagacgagccaggagggttcctggctgttccctgcacatgtcattaatgtgaacactcaccagcatctcttagctccttcatctttaaaacagggataaggatatctgcaatgtggggaagtgggaatgattaaatatcattgatttgtttttactgctcctctttaaaatgacagcatcaccacaaaggagatgaaatagtcaatagtgaatggaaagcaccaagcacagagactggcacacaatgggtactgagtacacgtttacgttggtactcataaaagaccaggaagagcttatatgtggtgccctggtaatgcctcagatactgttctaaatgcttcatggatattagcacatttaatccttacaaccctttggggtaggaactaatttatgtccattttacaggtaatgaaactgaggcacagagaatttaagtaacctccccacagttttataattggttagtggtggaggcaggatttgaacacaggcatcctgcttctggaactgcactgcagttatttttagagcccaggctatggaaagaaaccattcatttattcacggaacacatttttattgattatctgctacatgacaggtctgtgatcagcactaaggctatagaaatgaaagacatagacagggttcctcccccaaaacattcttgatgtaaatgtgagactcacactataaccaccctaaggattttggtctgaaaagacattctttattaaggattatacatttatgtcctggatttcctagatctggccctgaaggtaaatattccattttcttattggagtataacaaccaacgtttgactgcaaaaaatgtggtagattattttcattcatatgaatatgcctgcccttttctctggtggagtctggcccggtaagtctgygggacctgcctctaccaatgaggggtagagcttggtgacttttaacaatgatctcctcattagatgaggccatcagttacagcggaaatgatcattattggaaagctggagaccagctgctgtcagagagggatgggctcctgyggaagsttgcaaactgatgactacttaatccttgaacttcagcagcaacaacattagctgaaggtctgtaatgcattcacagttctcatctgacattttccccacatcattatttttctggttttacttttaaattccctataggaccattgacatgaaattctgagggggaatttggaacattaatgactgtttaaggcaaakgagtaagtgttctttccaagaggaaattgtctttataatattggcataaggctatttttaaaatttatactaatgagacgattcgaggcagataactgaatttcccaggcttgaagttggccyatgccccttggtgaattcagccttagggtgagctcygtggggccttgcaagtctggctctagatgcaagagatctgccctatccacattccttctttccataattggttagagccttgaccattcaaacctgggcttggatgttgggcttacaagtggcacagacagtcatggagcttgctgactacaagggaagaaagactttatcaaataacactacttatggatgtctcaactacaaacatgaatcaatgacttgaaagaaggagagtaatattccctgaccttaaacaataaaggactatgaccctgtttggggactggggatggtcrttgagggctcccctaaaaataaatacttgctctgaacctcaaatgaagtgtaggatttagaaaggcaaggggccaggtgaaagaaaatggtttcaggaggagggaagaacaagggcttgaaggaatgtatggtccccttggaccatctatgcttcctaatcctggggattgcacctccagtgatataagaatgtgtggcaaagggaaccaggttcctcactgactttgttcccatccatagaaccaaaagggtcttccttagtaatgcctatggctattgggtattgagttcttactacaggatagaccctgctccaaggactttgtgtgaattaacttatttgacctcgacagacatttgcctcaccccactgaaacaagtgacattaacagcaatcaaaagattacccggggacacaaggctatgtaatacagcaatatatgcaatataaaaaaataaataaaacttgaatgcttccaaatgtctatcaaaagaacacaggttgaataaacaatggaatgtctacacaaatgagtactgtggagctctaaaagggaatgaggaatagggctataggctatttgggataatgttcggatatatttttaaggtagaaaaagtaagatggagaaaattgtgtgttatattactgcctgtctttgrggggatgcacattcacatacaaatttacttttttaaaaaataaaagttaggttaaatcatttttttaaaaaaatagttactgttccagttatcttttttctttgtataaacagggtctcattctgtcactcaggctggagtgcagtggtgcgatcaaagctcactgtagccttcaccttctgctcaagagatcctcctgccttagccttctgaatagctgagactacaggtgtgcaccgccacacctggctaatttttaatttttctgtagaaattgggtctccctgtgttacccaggttagtcttgaacttctgggctcaagccatcctcccaccttggcctcccaaagtgctgagattataggcataagccaccatgcccagtctatctacttattttgaagcaaattagtgccttaaaatgtcaacaccattttattatcgtctctcacagtgtagggattgtctgggctccgctaggtggatctcagggtttctgatgggcttgcagtcagtggccgaggctggagtcatctggaagtgcgctcgctcatagacctgggtgtggaacagagagacaaacctctgagggttgaggctggaactgctaaggctgccttgacatctctctatggtctctgcagcaccaaggcttacaggtagctgtatgttttacaagttggcctgaggctccaaagatgcctattccaagagagaggctggacaagctgtactaccttttatgacttastgtcagaaggcacacagtgtcacctttgccacatttctttttttcttggcagataataaggcccacccaggttcaagaaaagtggggcagcaggggaaggggatggactttacctcctagtgagaagatgataaggtctggaagaggaggtatggcaaaaaatattgctgtggccgttactagaatatataatctgacgcagttacctaaagtgaaaagcgtgaaataaaggctgaagagatagggaaaaaaagtcacatttaaaaaaaaagttgtttcatgaatttgaaaacaaaatgaaataaaaagcctattctaaaattcaaaagtcagagaaacaattgaacctaagtgtgtactcaagatgctggcataaccacttgataggaactacccctagttattttaaaacgcagttatttgactctgtccattaaagacaattgaaaaccaaaaaccaaaacaactgcaaagggaaatcttaaagtattttcaataatactgcttttggaggtagtgttgrtatatttattgwtatataaaatatagtataatattgtgtgtattgaaagataaatgtatatgttaatttggagaactagaatattgaagtatgggaggaagaagatgcagatataagaccagcgagattaatttaaaatgctagagaattggaagtgggattatacatatgaatttattaggtgttttatcttagaaattcatgtattctctttctactaaaaagccctagaaacagtgaccaacccaatagcaataaacttccttagcaaatagattatggtcactagtgatcattttctagcaaaagaaaccaagctgtcttgagaaaatgattgagtttatatttgaggcaggaaataaacaagaagaatctgtaaaatcttgtcataccaagaagcagagaggctatgagatgtcattagggtsatgtcatttaaagaagccagtatgagtagctcaaagatgagataatttgagcctcaaaacaaaataagtgatttcaatggatttaaatacactaaatctgtttaaatacataagttcataatgataggggaaaacaaaattatttataggttaccttacaaagatgatagaaaccatctcattattttagaaacggaaaggaaawaaaaacataaacaactatcctgcctttgttttcagaattccttgtagaaataattaactagtggatgaagagagtttstctttctaggtaataagcaacgamaaaatggcagaattagaatataatgaatttgcagttcttactaaattaatatatctaggcagtaaccatcaataaaaagaaagaccatatgacatttgtatgtcctgaagtaagttcacaacrccatctrgtcttgagccaaaaatactgcacctgaatctgatccagcctccaggatgtatctatttataggaaacacagtggacaggcgaacatgttaaatgacaccacagagatgcaatctgcgaacttccactgtggaaacaatccaaatgattcaacacgatgttgcaaagacaaaagaattatacatgaacaggaggctggatgaattaaaaaacataagagatgtatcaatcataatctttggttctaatttggattctgatttaaaaatagactgcaaaaaaatttgttagaataatatgaacaaagactagatgtttgctgccatttagaaattctcattagtatttgttcagttatgataatgcatgstgcttctgttaaaaaaatacttttaatcttttacagataccttctaaatatytatagatgaaatcatatgatatctagaattttctttaagacaatctgtggaaggggtgagtggatgtgtgctcaggtgagctaatggtagccatgagtttaatattgaggttgagcgatggatacagagaagttcatcatacgaatctctccactttgatgttttcttgaactctccaatactaaaaatttwgccaaaaaaattaacaggggcaacgaactttcttctttttccaagggctttttatcgatgattttaagaaaatggtcagacagcgcaggcgtgttttacyttagtccttccaaagcagtaaggtgcacccacttctcagccaccctccctgactttgttttcacaacccgaattcaccaggaaaataccaggagtctgctttgtattgtgccatcttttaaataatgcctcactttctagtagcaaagtacctcattctttttcttgatacttcaaaaaaacaaaatgaaacaagaacttctcattagctgaaagtgtttttatctagtgagaactgaaatcttcttggcttatttcctcttagatctaaacaatattaacttttttttttttttttttcccaaacagagtctccctctgttgccccggctggagtgactgcagtggcacgatcttggctcactgcaacctccacctcctgggttcaggcaattctcctgcctcagcctcccaaatagctgggattacaagcatgcaccaccatgcccggctaattttttgtgttattagtagagatggggtttcaccatgttggccaggatggtctcaatttcctgagctcaggtgatccacctgcctcagcctcccacagtgcgaggattacaggcgcaagccactgtgcccagccttaacaatttttttttgtttgtttttgaggcaaactctgactctgacaccaggctggagtgcagtggtgcgatcttggctcactgcaacctctgcctcctgggttcaagtgattcccctgcctcaccctcccaagtagctgggactacacacgcaccccaccacaccgagctaattttttgtatttttttagtagagtcggggtttcaccatgttggccaggatggtctygatctcctgacctcatgatctgcccacctcagcctcccaaagtgctggaattacaggcttgagccaccgcgtctggcccaacaaatatttttaagatgcattgtctactaacaggagatgcctctgattctgaagtactttgcgataaacagccacacaatagccaaatgaaatcttgaaatcagagggttgctttctcatgaagttagactgcttgagaattgcagtggcttctatatggcaggtgcttaaattgtccaagttgaaattctaatttttataatgagtagggatgagtgcatgaaatggttgtgtgtttttttatttcctacatacaatatcgaattcaatcccaaacttgaagcattgatgtaattgaaacatgttggtaattttaaatcgtgcagttctgtacatgatcagaatcctaatcattattaaaataggtgtttctattatatgcatatgtataaaaagtcctccaaaatgttaaattacctttctcatctcaggaatagagtcccaatcacttccagattgaagcacttacggggggaaaaggcgaagngctccagtaattttamattgcttcgtacaatgaagagtgcctgtaaattactgaatgtggtaatttgttccataagcttttttgatttgtaagtaacttagtggatttgctggtgaaacagtttggcaggttcctcagataatttagagatattgagcatagacatctaaatgtgattaaaatgtggtattagcagacattgaccacaggaagggtgaggcaggttttcaagttacagcagctagagaagctgagaaagactacagtcgactctcaggggacttgggaaaggtactaagaatgcacaattgagctaattacaggaaaatgccacacggctggctttggaagaattcatccagcccctggcatgttttgcttatcctctgcctgatgataaaataggggttatttctatcagtggacacatttggcccayatcttaattcaggcaacacagccttagccttgttctgctagtgctaattatttttttgaaaaataatactgttaatatagtaaaatgtagttgttggactcttagaaatggataaagtttaggtttgtaatttcccagacagagagagagtggcataagcatcgtgtgaattcccttctaataggatgtcttcatctttactattttgcataataatgtattgtttggccataagagggatttaggtactggatctagaggcattgggtgtctttaaggtatgaaggggtcaagcaaatgtctgccactcacagagtgagggaggtggagccagaggttctgaacaaagaacctcaccaaatgatggggagaggctgtgatgcatttcatgaggcagtgatgatgtgagtcttgggctctgtaagtgagggtgcatagaagagtaggtcccgccctttttaggagtatactgtggactagagtcaatctgtagacaaagctaggctaacttcctactgggcaacrtctgacccctttcatctttgacctcaagaaagtcactattgttggtaaagtgaggaaggacatggaacctctggggagaatctgacctaaaatggcttcataaagattctcagcatgaatgcccttttttacttgatgaaaatagacctgatagtggttgggttatttgagcagaacaataatggtaaagggaaaatagtagtgagatttatggtgtaggatggtcagatgtggtatgagtatgacacggagccagaagtgcctggtcattcactgatttgtcacactaatggagttagaatactctaccttgcaaggcagagtaggagtagagtatccagtcatcctggtttgcccaattctgtcccacttttgacacagagagtctcacactccgggaaacctctcagttctagacaaacagagacagttggtcatcctattatgagaggttagagaggaagcactttctggatgggttgagtctgatrggctctgttgtatttgattagacagctttctatgagatcaaggttttcaataccatcacagaaccatttctggagctgtgttgaggaagagagggcaagggttagagaaaagcttgggccgcagcattgcctctgccatgaagactctttacgtctgtttcacacacagtcagcccttcgtatccacaggctccacatctgcggattcaatgaactatggatcaaaartatcctctggccgagtgtggtggctcacgcctgtaatcccaasactttgggaggccaaggcaaacagatgacttgaggccaggagttcaatactagcctggccaacatagtgaaaccccaattcactaaaaatagaaacctcagctaggagtgttggcgggcacctgtaatcccacctaatcccagctactcaggtggctgaggcatgagaattgcttgatcccgggaggcagaggttgcagtgagatcacaccactgcactccagcctgggcaacagaatgagggcctgtctaaaataaaaataaaaatagatgtgtttgtgtgtgtgtgtgtgtkatatatatatatgtatacacaaacatatatatatacatatatacacacacacattcaaagaaaaaataatacaaataaaaatacagtacaactattttcatagcatttacattctattaggtattatataagtaatctagaaataatttaaagtatacaggaggatatgtatagattatatgcgaatactatgccattttacatagggtattttkgtatttgagaaaaatcctggaatcagtccctcacagataccaagggacaattgtgctaaccttttagataaagtttcatagaccagagacttccacagtgaacacaagattagataccttaggctagagcgatgggttttagaaaaaaggtggacacatggaattcatgkatatgaaacaatacattgtccagaagtaagggtggtccatggagactggttggagtggggtgggagaaccttttcttcatcagagtcaagtcattctgggttggcaatatatatacatgagtggactggagagactgaggaggcacaagtcgaggaggaacacatcttttattttgacttaattttctttttatcccctytccttctrccccagggttcttctccgtgtggatcacattaagggagcgtataacctttcataccgcctgactaggatgatggatrtggaaatacacastttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagagaaaatcagcaagaagattactgaaagggaaagaggggraaaccaaccagctatatatttcctgcaacatgagttaatgaaattccgttccttcttacacagctgtattcggtttgttttacattgtttggtatgtraaaggatttggctttgcgttacagaactaattgcttactagatattacatggatatcaaaatactttataaatattaattaatcttcacctaattccctggcaagcacaaataaccagtggcatatttattgaatgtgtaagcaataatctgattcttaaagatttgttttctctgctgaagctttctcatcatttccatttgtcaaaatgcctcatctcctttgaggaccatatcagatggtacttccataacaattgttaggaaaatagtaataaagacgatgtttagagtaaccaacattattatttgctgaactttcttcctttgccaagctcttgagtaaacatttcatagatatatctcatttaatcctamagcagtcctacaataaaaatgttattgttactacttttttttcccccagatgagggagcaaagtttttgaaagctgaatggtggcagggctgggatccatagcccattctgtccacgtgtgaaacttataataaaagccactatcttgccccttttctgattcacactacagggaggacacttggtacttatcaataactccattcatttatctattcaaaaatatgtgtttgaatgcaagtactattagaggtactgtgctaggctctgttatgacatacctggtgttgactcttgagtagggattacagagttgagcatcttttctctcctgagattcatcatggtccccatgggcagtgaacagtgttgttgtcacactatgaaatgggtatagtgcctggcacaatgaccatttcttgaacaaatggggagtgatacagtgaaagtaaaaagaggatctacagtgtcgtttgcttgtgaatggtgaggggtgggagcgcttagaagatgtaaggatgtgctctcttctttcctcacactcatcttatwtgtaatgacattaatttgtgttcttacctgctcartgtcttctcagtttgacatgccatgatggcatggactatgtctgtttcttctagcgcttcatagctgtattgacacatgtttgttgaatagaccaataccttgttttatgcataaaagaaggccagtaaaaatagtcttacatgcatattaccatgaccrtgaaaataatcccaccctgggcatagcctggctcttgtttgaaatgtgtggtacttctmtgtgacaagatatagaataagtcattggaagaaaaactgtcctattactatattttatataaaagtgtatcttgtgttataatgggcctggtatacagagggtgcttagcaaatcttccgcagagctgaaactgagctgaagctacggcccccttctctgcttgctctcctttattctctagagtgctgcttcccaatgcgtggtccatggaccaagcagcttcagcatcacctgagcacttgtcagaaatgcagcacctaggcgcygcaccagacctgttgaatargaatctacattttcacaagattccagrtgatttgcatacacagtggcatttgagaagcatyaatccaggggcttctttgcagtcagtgatggtgatttgccaatcattagcatttcagaaacmccaggccgaaaccatacatttatccttagctaggtyggtatcaagtttctctgctttcakccagaatcctaacaattcagcttggttgattatctaagaagcttctatttgataattatatatctttcattttttttaaagtgctgggggttgggagatcctgggaaatggcataactattgcttaataaatgcagtttgcttggaagaccaaaatctttcaagtaatgagaagcagcaaaggaaacaactccaacaatgacacaaagatttcctgacaataaaggggctgaggtgaggaccccagctgtggaccacactacccgaagagaaccaacaaccaaatcaatayccaaaaaataacaataacrtccaggtcatttcacttatgagacagaagaggtaaaacaaattctcagatacaaatatttctgctgctccacattgttccatggggccaggattgtgaagtcaatcttcctaatgattaatggaatttctcaccttttgttcaaatgacttggcccctttggtttttaaatgacatctaagggcaaaacagacccaagactttgtggaatgactttccaggaaacaaccatayctaggtaaacccatgctcacaggttccctctgttaatggtgaaattacatcaaggatgaccttttgaaagaataaaactcattatcacatggaatatgatagctgtaaaagagcaacgcttggaagccaaagcaaagtcccgcatatgataaattaattagaawagaagttacataaaacctcgaccttctgtgtgacccttatcttataattacctcttctttaaaagcagaatgaaatattttatgtatgaagatgttactgttgaccctaaatgcattaagagtcaaggagacatttttcacrtattgaaaataagatttgattgagtgcttgcaagtggcctagtgaaatctcattaaaccactgttwaatactttataaatggcagaatattaaccattaattatgaacatgaaaccagtttgaaaataagttttgcaatatctaagcttgattttcaacccttattaatgcattgtctttttcatagttttcagtgttttacagcaagtaggtacttacgacttaggtgtgacttttcatctcttcttcctcctcctccttctctccttcctccttctcatcctccttattgtgttgctctaccaacatggttgtaaaaatctggatgaaaataagaaaatacagtctattaaacatagttataggctgtcactatccacagttataattagatttataaatcatgtgcaagattcccagcaaaaaaaaaaaatgaatcttaaacattcttttcaactattatcaccccaaaatgaaacaaaacaaaatatagcaacgatatgaaattgtttcagtaacattgccatgttacagtaagcttttgcatctggatcagtcagcctggtacaaataactgtatattctgaaatgtaaatagataaaaagataatgaccttcttgagcatctactgggtgacaatcgttgaaatagtatctgaatttaactgcaccaaggaacataggcagattttgattcagatgacagcttccattatttggcagcagatgcttaagaggctgctttgggaggattctgatgttggatccagcctacatcatagaactgcagccatggattagcaatatgtgttatgtgagtgagctgcaaaaatatgccacaaaattcccatcttacagttatacctttttaccctgaaatgagtcagtgtgttatggtaacattcccagatggcagacagaaggagagccaatgtgagagaccagtgaactcwgacccgtctcccaagagccttgtgtaagtcatctaaaaaacaaatgtttcggatattcagggttttctgatttcaaatgtgttcataccatgaataattgtgtagcactatcttactgtgtgctgaggacattaatgtgcttcttctttcatccttcgaatgatcctgcaaaataattctcactgacattttcgtggaggtatccaacttcagctcttatggaaaagaaagtgcctctgtggaagttgcatagatagtaaattgtggcgtggggactcaaagccaggtttgcttgacttcacagtctaaattcaacccaggaacccaacagcctgttgctgtgtgattctgatccccatgaattcactatgttgtcaaatgctgagtttgcaaagcatggtctgagtgcttcccttctggacctcccttaaccattccagggctttccattgcttgtgcagttaatgaagatggaaaatgattcccttccctcccgctctgttyttccatctgtccaggtaatagcctaatgtcaacctagtgacttcatggcatctgttttcaatctactgcctccttgtctggaattctcaggggacacttaagccagaactggggttgaaggaagccctggctctgtgcaagtccacagtacagcagctactggggagggaaaacggtgtgtggctacgctgagggtttcttcctggttgatgmgattataatgtgaaaagatcgacatgtgagcccagagcagatgcataataatgctactgcattttgtatttaacaaaacccctttctcgagaaatgtattacttaccttgtgggtggggaattgtctctgaacccaatcaggttagtcactggcccatgactatctmatttttaataaataataattttctcaattcagcgctagccagctcatctgctttcaaaagataagatatgattgctttgtattttttatattaataaccctcagcatgagaggattaactcttgatgcactraaggcaaactaccggaccctgggagatccatttcttctcaccagataggctgacacatctttcagatgaatttaaaggtcaacgccttgtgcatgaaaagcaggggcctgcattagatggctgagctctagtcaattcttggtcatttgtactgaaacagaggcaagagagagatttcaaaaccaccacgaggargcccctaaacatgcaggcatttctttcctttatctgtcgattcaaagagcatctattcagggccaagaaggagatcaggtttatctgacttagtcatacagccataagaaagtttccccctctaaaaaaaagaaaagagaaaaaataaagaggtgccttccattggtgaagcgtagtcattcagaacrcaagctttgcagccacccacagcccacagcccacagcccacagccactgtgggtcgagttatactttgcctcttagcagctgaccagctttgggtcwgagcctgtttcttcacagtggtcagcccccttgtctgcctgataaatgtctgtctgctcacgcacttggctccgcagaagtgagcttgctgggtccatggggatattcactggagattttgcacaatattatgctctggaaaggggtctgcaaactctgatctgagggccaaatccagcctgccacttgtgtgtggacaactagcaagctaaaatggtttttacatttttaagtggttgcatcttaaatgcttatataatggctacataaaatccttaattttgcctcttggcccacaaaacctaacatatttactactggctctttaagaaaatgtttgctcaggcctgctctggagtcctcaaagccacatatataattttaaattttctgatagctctgctaaaagaagtaaaaagaaacaggtgacgttaattgtagtgtgttttctttaacccaatatattcaagtagtatccctgcaacgtgtaggtaatatagaaattgcgaatgaaatattttacattcttttttcataccacgtctttaaaatccagtgtgcattttgcacttaacagcacctcttaatttggactcaccacatttcaggggtttaayaggcacatgtgaccggtggctgccgcattggacagtggcagctctagagagctggaaccaatttatgctccttctgacattcacagggaatgctcygtataaatcttggtctcttcttcctttttaaggtcacatagcamctggatttaaactccaaagctaccccaattttagctggagggaccatattccaagctgcaaatattgtacccacccagcaaatttcctgggatgtgcttcctggggaaagtgaattcagttgctgtagcccttgatttgataaaatgctcctctttctggccttacccttgctcaatcatttccaattccgctgctggttatttaacacgccaggggcagtaggtgcatacagtcctatgctcccagcttatgaggaaatgctctgtccctccacaggcttgatcagcggcctccctgctcctgttctcyagatagaagtttccctagttttgctggtctcaactcatgcacaggaggaagccagaagtgccctgctgtgatgatcaatccatatgcatgtttgcctccagcaaaccaaggacatttaattcttggccagagtctcatcagctccatcagtctatgacaataaaatgaatgtatgtcttgatcacaccaggaagtctctgctaccaacacccccaggagaaaacagctccaggctcttgaggctcctcamgtagcaaagtctcatcgctcargtcycgcatgtcagaatttgccatgattcactcacagcatgtgtcatgtgtatctggtagaatgtctgaaatgcattcttcccatatggcttttcagggccctaagtgtgaatatgaactttgcatgtgaaagatgcttcattttgcattttgtttgyttgtttttgtttttttgagatggagtttcactcttgttgcccagactggagtgcattggcgcccaggctggagtgcagtggcgcgatctcggctcactgcaacctccacctcctgggttcaagcgattctcctcccttagcttcccaagtagctgggattacaggtgcccaccaccacgcccagttatttttctgtatttttagtagagactgggtttcgccatgttaagcaggctggtcttgaactcctgacctcaggtgatccacccgccttggcctcccaaagtgctaggattacaggcatgagccgctgtgcctggccaagacgtaattattaaaattaacaatgttcatctcagtatactgcctaaaattacgtgatatgccaaagtgggtgtatgtatcccactttgaggaatactgatgagaaaggatgttaggcctacagagatcttcatcttcagaagagcacagataagttctggtataatggaaatgacagcgtcttggcattttttactgctgccttcaaacagcagacatcacagcccacgatgatgagcctgctgatgccgacttcctgcattctgtggtacacctgggctcagcttagaaaggctctaccccaactcatacttcttcatggcaagatgaggtgaattcatttctacccatagtcattctaatctgcattttcataacccacctttccattctccaagtgtgactttcatttttaggacagagttattcagtcggtgaatatgcagtccctttaaagggatatttatcacccttgaagaatcttattgccaaatcttaatagtctttsttataacaaaggctcaaattcactatcaagattaagaggtggagcttgaatgagctttgctggagcatctcatgataaaatagattaaagtcttaaaatgggcaacccatcgaggtggaagtcaaacaaatatgcaaaagcgtccctgtattttcctcaggcagtttgggcactgtgggtgagcccagagggtgaatggtgggaagtgggagttaggccacgtggattttccctcaggctcagcggggtgacctcccatgagaagctgaaactatcttaattactttgtctgtaaaatagtggtggtgagcatggggagagcttgcctacctcagaggcttgtggtgaggattacggggaaaagtccatgtaaagtgctcccccctggtttctggcacagaacaaatgaatgaaattcagatccatcatttatgtcagaggtccccaagaccacccccaggttccttgatccccaagtcctaggaagtcctagaggtccccaaggccacccccagtttccttgatccccaaggaggactcatggttaagatttattacggtgaaaatatacaaaatgaaatcagcaaagggcaaaggcctgtgagcgaagtcyggaggaaatcagttacaagatttccacaatcccctcccaatgcagtcacacaggatgtgcttaactcccccaagcaacatatggtgacaccgtgtgtgaaatggtttctacgagggaagctcactggaggctcagtgcccgagtttttactgggagctcatcgagctggtcacrtagacagcctctgcctgatacatagcaacattcctgactcccggaagaaaagcaagagttcagcataaaccgaatagttcatacaaacatgaggcacttggagccactsttaccagttatgggcatgggaatactctccaaacccaagttcccagatgccagccaagggccagcctttcaggcaggcctttccaacattgcagtctgcaatctgcttcgtaactcttttctgcccaggactagaggtcataaggcccctactaastctctggcttcatccccagtactacctgttaaccaacctgacattcctcccatcacyccgcagatcctggccccaaagccttaccttggtgctagcagctgcctctgttttgaaagctcttcccctgagttctccatgaccaagtcctcacccytttcattgcagatgcttgcgtgttcccatcactgagttctaatttctctaatggaagtatcattctaaagttatcctttgtccttcttttattcttrttcatgggtatctccactagaaggaggatatatttttctggcagaagaacatgcccgtcytatttattgtgttatcactagtgtccactatagggatggacaggtggtaggtgttcaatatttgcctcatggatattgggaattactatatttattgttctgtgtcccaaagaacaaatgaagcccccacayccttcctgtttattgacttaaagtattgtctttgaatgttgaaaaaagtttttagaaaatgctgaacttacagggaaattcaccaaagtaatwstaatatcatgaagatgctcattgcttctgggctttccaaatctcatctttcctcaattgtgccttctctgcatgagcctaatttgaaaaaaacctggttcacagagggctgcttaagaagttgatggttttgtttatacycaaagtcattgtggggacctstattttcacsttttttggcctaggttgtcccagtacttctctcattctgtgattgatgtcatasgtgacaagtgtgatgggtcacttcactggcctctccaggcggtttattctttagctgacttcaccttgctctggccttatgtaaaggtccctgccctctggctttyagtgggttcarcccacaagtctgcaaactttctcaaagrgccagataataaattttcagacattgcaggccatccagtctctgggcagctacactactctactctgccattgtagcatgaaagcagacatacacaataggtaaascaatgagcatggttgtgttccaataaaactttatttacaaaaactgacaataggctaagatgtggcccgtgggctttggtttgccaatcaatggtttagccagtggaggattgggacaagaactcagagggagagaggagaataaatctttgcaggctgctstgtccttccattgggggttacagytcttctcagggagccccctccatgtggccgcgtcttttgggtctggaaattgtttcctcccctggccctctaggsttagatgtgggaaaggtgccccattattactggcatgttgctttatgctgtgggccccttttccttgactctgactgtacttttgctggttcctgcgtccatctcttgtcacawagctcaatttgcgtgtgccatcaatttcctgctgggattaagatacctggcagtgcagggtttcctgggatrtgggacctctaaaaccgaaacctagacagtcccagtaaatcaggaggattaatctccctaactggaacccagccctgtctcctcccttggccctgctccaattaccttcattctggccctcagtacccccaasttggataacggctttgctggccagtgactaaatacagtggccagatggggtctgtggccatcgccatgtgcacctctctgctagggcttatttgcccttggaacaaagtctgtagctgatgtttgacaagccaaggagactctagtgtagtcccccagcctactgtagaggctcttcacattatcatattttatactgcataatttttgaagatgatcccttttcttccaaattstagtacaggagaggtatgctatttttccataagaaaaatcagacttactttgaaagagcagtaggattagcagacactttgaaatattacattaatccagcttgggttgaaaatatccaaaggactgactcatgaaatttcaagtaattgaacttctggactcaaacagacatgagaagaaaaagttatgttccttcaaactatttcagctcagatgattttttcctttttagttcaaaacctgacaaaggtttgcttgatgaggagaagagaccaccttccccacaatgaaagttaacgctataatgataataggagggcttatgactgaatctgtattcagatacaccgattttgtttgcttttagtggcaagcaggtttagcaggttagagaagagggtaatgttttgatactgtggtgaagcyraggagggcgatgtccttagtctgaggagaccagcatgaagccacctttattgccctaaaatgtctctgccttcaaacaagtgggctaaagagggagggcctgatgctctgaaaaggaaaaaaaaaaaaaaacttggccgggtgcrgtggctcacacctgtaatcccagcactttgggaggcccaggtggacagatcatttgaggtcaggastttgagaccagcctgaccaacatggtgaaacctcgtctctactaaaaacacgaaagaaacagccaggtatggtggcacgtgcctgtaaccccagctacttgggtggctgaggcaggagaatcgcttaaactagggaggcggaggttgcagtgagctgagaccaccccactgcactgcagcctgggtgatggagtgagaatccatctcaaaaaaaaaaaaaaaaaagaaaaaaacttgcataatggagcaggctaattcaggttcccaggatctagatgacagtaaatatggaagctgctttaaggagatactggagacattttaatggtgttggccgtttcattgtaacacaaatgacttctctgcagctgttcaaggaagactcttttcctatgagtgttggtagatgaagagtggaaactcaggtgcttggcaaggtyagaaagttagtgtcaatgagtgaggaggcttgggtagaagaaaagtctgtatgaagacataagtacaaaccaaaaatcacttttagttgactatgaggcaaacagcagtgcaactgtgatgacagaaggcaaatggtacttgctggggacacatgggatgcatggcctgtggacatctagaaatgaggcctgtccatcaggaggtcaaccttaccatccacggagtgttgccctgtttgactscaagctcaaagctgtcccaaatccagatgctcggtgaaaatccctgatatttgaatggcagcctctgcaagctaaaggccatctagcagatacagtggccatatgggacgtgccagccatgattttttgcagcctctctgttagtgcttgcttgcccttggaacaaagcctgtggctggtgtttaactatcatgggagatactagtgtggctgaaaagtctgtgttctgaacagtactatggcactrtagacaaactttcaaggtcaaattgattatcctgtagtttagcaaagcarcagctccctaattatgtcaggaggcaggattatctctgatcatttgagctaggactccagataaaacatcaaaagcaatatttaaataacacacagccatggttaaggattcattgcattttctcttacyataaaaccaaaattgtggtggcccattttgttccattactggaagggttttccaggctgttttaactcatacatagtgtaaccctttcccttattacaaaatttcactctgggaaagagcaaagctgtactttgtggtacagtgttatgatggtttatgttcatgaaggtcctacaaaaattcagaaacattcttaatccaaatgatctagaaataggaactggaatacctactgtgctggagctgcttaacccatgaaagacagttgtacacagctcttcacaactccgtattcagtgatttcacattagtagcttgaaattagccatgatgggagcatttatgccctggacattgtcaaaactcagaaatcaagtcatttatttcttggggagctggtcattaaacactcactaggatgcccttgggtacccctcactgctagaagaattccctccctccctgtatttctcccttgaaatctgagccagtcttgcattctacatatatatatatatatatatgtatatatatatatatatatatatatacatatatatatatatatatatatacacacacacatatatatacacatatatgtatacacacacattcctatcttctcaaaaattcttgccttttaaaaagttgttatcaaagacaaggaattttttaatcatcagggtagctcagtcttgagacatctgagtccttctgagtagtaaccagtagctgcaccgaagagacagttcaaggactacaaatgatggtagtccttgaatttcaagtccttgggagttcaaggcctatcctcatttgtagttcttcacactgtaccactctttatttgtttaaaatataagagtgcacaggcaaaaatcagctaaatgggagttgtccagaacagtgctttctccagtgaccttactcacccctccatgaggactcagttaattctaatctctattttgctgtttctatgaggtcagaagtccccaactttttggcactaggactggtttcatggaagacaattttcccatgtaccagggacatgggggaggggaggatttggggatgattcaagcacattacatttatcgtacacttaatttctattattattaccttatatwatgaaatagttatacaactcaccagagtgtagaatcagtgggagccctgarcttgttttcctgcaactagacagtctcatctagggtgatgggagacagtgacagatcatcaggcattagattttctgaaggagcatgcaacctagatccrttacatgtgtggttcacaaagcacctataagactctaatgttattgctggtctaacagaggtggagctcaggtggtaatgcaagtgctggggagcagctataaatacagacgcagctccactcatgggcccgccactcacctcttgctatgtggtccggttcctaaaaggctgcagatggatacccatccatggcctggggattgggcatccttgtattagattactaactccacccttaaactttttaagttgtgttttcaaagaaggtatcagcatgtcagtctttcctataatgttctgtgtttcttgaagatagggaccttgcctttttgtgtatattgacaattagtgtatattgtcttggcactgacacacagtaggcagtcagtagatgttacttgcatcaatgcatgagtccttcagaatacatccaattggcattcagtgagcagttgttcaaattccttttaattcaggatggtcaaatgtttgtatgaacatttggggaaacatcttaactgtctaccaggcagttagattttaaagaaaagacrtgtattcatatactccgacccaggggaagatatgtggcattctgcttaacataatcagttccttgctttccacaccaatttgtgcttgatttrtttcttttcttctagaacttttcagagtgagaacctttagcagaaaaaaaaagcttaacaagatagacattttagttcaatagmagaatttttctggtgtgaaaaagtaaattacaaaaaggactttggttctgaaagataattaataaaaaccttyccatgtgatgacaaatctgacatcttgtctaatgtctggcagagaagaaagtgttgagagctgcacagttggaataaaatgttccactttacagcaaggccgggtaggatctgataattatttctaggcaacaaaagttcatagtctaattgttcaattgacacaacaccaggcctggctctgtgactatgcaccatcagtgaggtcttcgtttaggctttcctgatttcacaggtaaatattgccaggaatgtgggtgatcatggaatgactccctcgtggatattttggactacagctgtacttatagaactttcctttccctcttgtaagcttctcatgggctgtggtaggctgagtaatggtcccgtaataagtctacatcctcattttcagaatgtgtcaaggttacctgtatgacccagatgagtatgatgtaatcacaagcttayagaagggaagtaggaggagccagagttagaaacagaagacgatgtgatgaaggaagagagacagagaaaaacaggtgagaagaggccatgctgctggcttgaatgaagaaggaggctgtgaactaaaggatgtagatgacctagctggagaaaacacattctcctgaaggagttcagccctgtggcttcagactttagaactataaggtaataaaactctgggaggctgaggcaggcggatcacaaggtcaggaggtcaagaccatcctggctaacatggttaaaccgcctctctactaaaaatacaaaaaattagccgggcgtggtggcgggcgcctgtagtcccagctactcgggaggctgaggcaggagaatggcgtgaacccgggaggcggagtttgcagtgagccgagatcgcgccactgcactccagcctgggcgacagtgtgacactctgtctcggaaaaagaaaaaaaaaagaactataaggtaataaagtatttttttttttttttttgagacagagtctcgctctgtcacccaggctggagtgcggtgatgctatctcggctcactgtaagctccgcctcccgggttcacgctattctcctgcctcagcctcctgagtatctgggactacaggcgcccgccaccaagccctgctaatttttatttttattttttttttttgtatctttagtggagatggaatttcaccgcgttagccagaatggtcttgatctcctgactttgtgatccgcctgcctcagtcccccaaagtgctgggattacaggcgtgaggcaccgcacctggccaataaagtatttttaagcctctcagattttagaastttgttacagcagcattatgaaattgatacacgsgggcatgttttcctgaaatcagagcctgagaggagaaccaggtacaggtagttttctttgggaggtgatccaggaagcaggagtaaggaaggatgagaaggcaggaaaggagagagaaccaatatattaaggaatccttgagctcactgctgtagacagccaggggccagtgcacagggacctcgagaggcacagggaatgactctcagacgtgtctgtctgcaagaaggcaggtgggagcattcagccagctgtcatttccaatgcactgagggctgtccataggagcattaactccccctcctttcccatctctgctttccctcacattagccaagctcctgyagtgtaggagaaagagccaaagcagaatgcaaagagactgagggcastctaaggggcaagcctgacttctttagaaactcatcgcagcagcaactgagatcagaggttggctgaggtattggctgcagccaccagcatcatcctctattgggctgacccctcagatgacagacctattcatttactgtttcccatcttttgtctctgtggattcaaggtttcttggtgtagaccagacaaggttcccagtgcctgccacatggtaggcattsattattttctcawttgaactccctgaggctactaaggcccacccaagagtacctcatataggggctcctttgtttgacttaagggaaacaggtattatwtggcattcgacatcactaatttaattacaaaaaattcataaatagatgcaaataccrccaaccctgagcaggcacatcctctggtttctcctaagggccagccagcaagccaggcattcccagtgtagtaacttaaattcttacaaaactgtatttttccttttaagttttccaagtgagcccagtggcttaatcctggaatcttaatagtaaagagttaattccatttagacaaaaattgtgatttcactgagtgaattgttcttggctctgttttatccaaactgaaggagggcatgcatgagtcctattttgagacaaaacaccttcaaataatctggaaaacaacccagagtttatttctgccaaatggctccctgtttcttgaactggcatgctatggtgtttgcattgaccaaacttctgcgtggagcctttgttcttagaggttgtcatgtgaaaagtttcaatcatctttctaatatgtccttgtctgtgacatggtcccagtccttattttcatccaaagagcatgttgttccttcttctttatttscacaatactttrtacataccctctatattaatataactataatattaatgtatacttattatataagaaatatatatcagctatcaatataaataataactagcacataacacctactgtgagccagtttctgtcctgaaacatttgatttgtgttkactcattgactcmtacaaccaatgggagtagacacaattattagttgtgttttgcaratgaggaaactaaggcaaagagaatttaagtaacttgctcrgggtcacatagaaactaactggaaaaattgagatttcracccagttagtctagcctgcgaatctttactctgagctactttttaactgattctcaatgtatagtcacataggttgtagtttattatatgtccatgtgtctgtctttccttctagataataagttttttaagggttttattcatttktccatctctagtatctaggccagagcctggcagataatagaaatgttaaattttcactaagaaaatcaattttaaaatgaacctgatgatgctgtcataatggcagatcaaaatgtcccataatttgaaagaggcaattactaaaacaatagcaaaaaataaaataaaacaaaataaaataaaaaatgagagacaatgcttatttatgccaaggagaggagcacttaggacactcattgccacatcctgactctgacagccttgtcaaagcattccaaagccatgaccttcccttattctcccttccttccccacctcgccttcaaattccctctcctattcctttctaactcctctattttgccctcttcattggttttcccaaattatatttacatgttaaaataccaagtaaagggaacccatattttctgagtgtctattgtggggccaggctatagtagactgcattagttcccaatggctgctgtaacaaatgaccacaaatttagcaatttaaaacgaacatagtattgtacagttttgaatgtcagaagttcaaaatgggcttcactggactaaaatcaaggtgttggcagcgatgcattcttttctggagtctcatggggagaattccctttatgccatctccagtttctaggggccacccacattccttgactcctggccccttcctccatcttcaaagtcagcaatgtggggctgagttcatctcataacatatcactctgccctcaccttcatcatcacatctctttctcttatcctttcttccattttcaaagatacctgtgattacattgggtttacgtgattacataatccaggataagcatgctgttttaatgttagctgattcccaaccttaattaccctttgccatgtaatctaacatattcacaggtcctggggagtagggtgaggacatctttaggggactactgtctattctgtttgcgttatctcattaaagcttcccagtgaccgtttctctagcaaagagcatgtgaaggccattcactctgaattaatttaccaaaagccagagaaatcaccacacagccagaatttggacttaggttagttttggctttttgccccatgcttttccttgttttattgttttcttgtgcttcactttttttttttttttgtacttcacagatactgtatgttttacaaattgaagatttgtggtgttgaagtcaaaataaaaatgtagagatgaatctctaaatttagcatttcatttgggaagaaagacttgcaatttggggcatttatgcagattaaatagtctttggtatgttcaaagaacaaagagaaagttggaggttttgtaacaatgaaaaatgttatgtattgctctttgagaaagttcattgacactagtaaggttctgggaagctggcaagcttcagctggtgagtggcatcagtgagaaaattagtcctggagttgcagcaaattatcttgaagctatagataaaactgggttcaggttacagcagccaggcttgcagagaattacattgttggagcaatgctttgtgtccctagtgtgtttttgcctggcttcttgactttgctttagttgggtatgacaagaataacccaatttgtaggatcagctttcaccttgacaactctgcactgagcaagtttatgggtgctgtttttccaacagtatgtgatcactttgtgtctctgtctcatgttttgataattctcccggtttctttcctttttttaaattrttactttgtctattttggtgatgtctgatcagtgacctttgatgttactattgtgatttttttttttttgggtggggggaggcaccacaaactgtgcccatataagatgccaaacttaattgataagtgcgtgttctgactgttccaccaactggccctttactcatctgtctccttctcctccaaacatcctatttcctgaaacacagcaatattgaagttaggccaatgaataagcctacaataaagtactttctttgcctctaagtgttcaagagaaaggaggagttgcatgtctstctctttaaatcaaacctagaaatgattaagctaagtgaggaaggcatgtcaaaagctgaggtaggctgaaagctaggtttcttgtgccaaagagtaaagttgtgaatgcaaaggaagagttcctgaaggaaactaaaggtgctactccactgaacatatgaatgataagaaagtaagacagccttattgctgacatggagaaagttttagtggtctgaatagatgatcaaaccagccgcaacgttccctcaaaccaaagcctaatcctgagcaaggccttaactctattcaattttctgaaggctgagaggtgaagaagctgcaggagaaaagttggaagctagcagaggttagtgtgtgacatttaagtaaagaaacgatccctataacataaaagtgtcaggtgaaagccaagcacagtggctcacacctgtgattccagcactttcggagaccaaagcaggtggatcacgaggtcaggagagcaacaccatcctggtcaacatggtgaagccctgtctctactaaaactacaaaaattagctgggtgtggtggcacgtacctgtaataccagctactcgggaggccaaggcaggagaatcggttgaaccagggagtaggaggtttcagtgagctragatcacaccactgcactccagcctggtgacagagtgagactccgtstcaaaaaaataaataaataaaataaagtgtgaggtgaagcaggaagtgctgatatagaagctgcagcaagtcatccagaagatctagctaagatcattgatgaaggcggatacattaaataatacattttctacatggttaaaacattcttatactggatgaagatcccatctaggactttcatagctagagagaagaagtaaaggacaagcaaactcttttgtctgggactaaygcaactgatgactttaagttgaagccaatgcttattcaccattgcaaacatcttagggcccttaagaattgtgctgaatctactctgcgtgtgctctacaaaaggaacaacaaagcctggatgacagtacatctgtttacaacatgatttattcaatattttaagcccactattgagaactgctgctcagaaaactatattcccttcaaatcttactgttcattgacaatgtacctggacatccaaaagttttaatggaggtatataaggagattagtgttgttttcacacctgctaatataatttccatttttcagcccgtgaatccagaagaaatattgactttcaagtcttactatcaaagaaatacattttgtaaggctacagcttctaaagattgtgattcctctgatggatcargacaaaatgagtcaaaaacctgctgaaaaggattcaccattctagatgcccactaagaacatttgtgattcatgggggggtggttaaaatgtcaaaaataacaggagtttagaagatgttgatttcaatcctcatggatgattttgagaggttcaagacttcagtggaggaaggaagtgcagaagtggtcgaaatagcaagagaactagaattagaagcagagcttgaatatgtgtgtgaattgctgcaagctcatgataaaaatgtgaatggatgaggagctgcttcttatggatgagctaagaaagtggtttcttgagatggaatctaatcctggtgaagatgctgtaaacattgttgaaaagacaataaaggatttagaatcgtacctaaacttagttgataaagcagcagcagggtttgagaggactgctttctattttgaaaaaaaagttctcctgtgggttagatgctaccaaatagcatcacatgctatagagaaatcattcgtgaaaggaagagtcgatagattggmaaacctcrttgttttcttattttaagaaattgccacagcctccccaaccttcrcaaccgccaccctcatcactcagcagccaccaaaatggaggcaagaccctcaccagcaaaaagacaaccacttgttgaaggctcagagatcattagcattttttagtaaaaacgtatttttaaattaaggtatgtacattgtttttagaaataatgctattgcatacttaataggctacattatagtataaacrtaacttttatatgcactgggaagccaaaaagttcatgtgactcactttattgtaatatttgttttattgctatggtctggaaccgaacctgcagtatctccgagggatgcctgtacatgcagcttccctgtttacagtttgaggagaatatgttgggtagcatcttttagaaataaagtctaggatgttggttcaaattttgtgtgaaagcaacaatagggccaggtacggtggctcatgcctgtaatcctagccctttgggaggctgaggcgggcgaatcrcaaggtcaggagttcgagaccagcctggccaacatggtgaaaccccgtcactactaaaaatacaaaaaattagctgggcatagtggcggatgcctgtaatcccagctactcgggagactgagtctggagaattgcttgaaccctggaggcggagggtgcagtgagccaagattgcacctctgcactccagcctgggtgacagagtgagatttcgtctcaaaaaaaaaataaaaagaaaaagaaaaagaaaaaagaaagcaacaatgggaccgacgaaactaaaagcagtctccccttttacctccccaagaactgtaaaaccatttgtaagtgtctgtgaccttaatgaccagmaacgtgtcaggttttctgtgttcctggggctgtaaaacaccaggaacattttaaggaggtcagactcagcaggggcgtggacatgagtacatgcacatgtgtgtacgtgtgtgtgtgtgtgtgtgtgtgtgcatgcacatgtcctggaatgctccattcctccatgctttccctgtaggcagtatgcctttgtaaacccttccaggactctgggtttgtgctccctgggaggataaagaattaatcaaaatacactgctgcgatatttttacatcctgcaagtcagaggcagtatcctttcttcctcacaaatctaagaccctccaaattgatctcaatacactgactttaacaagagtaaaccagagatgttttatggcagggataaagtaactatcaaccaacactaatgacaagaaagcaaaaagagttggagagaggaaagcataaaggatcccagagacactggggtgttggtttggaaaataccttcttggagctggtttaagaggggatggaacctgagagtgttctcaacctcgtgagattaattatttgtggcaggaagtttctctctttatttgtggctgctttggagacagttgtgtcatgtttttcttcagtcctgatatttttcactggcctctgggatatatctgtgatgtcagtggtatcaaagacttttctgcccttgttccatggatgtttagtgtacaatcagctgctgcaacaaacaacaccaaatctcagtgactttgcacagcgttccgtggatgtgtcttgtggggcggttctcccgagtaactgtcttctgtgcaatgactgattctgggctctttctattggatgactctgccaccttgggagtccttccttcctatttccatggataggagaagagaagatatcatgcaggacatycaggggccatgtctagaagacgtgagaatccttccamccttattctgttggccagtgcttagtcacatgtctaaaattgtaatggagcagcagcaccatgtcctattgtgagaagtagccagagactaatctcaatgacagktcttatagcttgaaaaggtatttgcaaaatctaaagcaaaagttgccaactcgaatgcctagatgtccaagcaagtgtttaactgaattgagtgagcagaaacaagaaccagggagtggtgctgagaaggaaagcttggagaggggcactctacataacatgacaatttaacttgatgacagacttctctggctaaactaaccacatctgctggccacatccatcccttatgctgccagttggcaacctacagtatgggagagaaaaagaaaaaatcctttctctggaagcaaactccaaagttgggtatattcttgaatcagtacctgtcaggataaaaaaaaaccctttctttttaagaaagaamgaaagttctgtactacagcaaataaatggaagctaaaaagaaaacctggtataaagagtgtgatttaagaatttgctttctgtgcatacatttagggtagtggctcttgcatggaagagagatctctgagctgctactttaaaggatgcttggtgtcctacagaggtaacacaactcaatcatatcaggcactgatgttctgatggtgcagctgatcctgagatgcaaacaccccatgatcttctgctgtctgattccctgctatgtccctgtrtgtagtctaaacagtctattcactgaacagttttttagtaacaacaaaagtaataatatgttggtaatagtttgtcaatgtctaccctggagaatatcagtgaatcatgaatatggatttaaatataatacatagaaataataatagcaagcatttattgagcaagtactatgtaccaggaactacttaaggctctttacaataattaactcacttaatcctcataacgggtgagataccattactcctgcttttcagcttagaaaactgagacacagaaggttacttgcccaaggatagcccgctggtaaacgagattcacactgaaccaacgtggcttaaacctgtgcttatagtccgtctgaaacgtgaatctttgtagcaggctgatggtaatttttagataatagaaatcttttgttaatcatagaakttgattattgctgtgctttcaaaggtgtcttggttacctctcatttcttaggtactcactgatgcataaatggacaaacatgtcatagagtaagactatgattgccgtggcattaaagataaatttggaatgatgctcagagcatatattctagaaaatttacagaggatttggggaaaactatgtccaggtagtatttttatgcatgtgacatctcataatattggagaaagggcttgcctggttttggagtaatgtccaagttctaattcttacagcaatgaggggtgctgctttactgctttccatccccttaccraagttactgtgaatgaaattgaagagcggatatcggtggcaagttcaagcatagatactgttttgaattctcttaagaaattaaagggcaaggctgggcttggtggcttatgcctgtaatcctagaactttgggaggccgaggcaggcggatcacgaggtcaggatatcgagaccaccctggccaacatgttgaaactctgtatctactaaaaaaatacagaaaattagctaggcrtggtggctggcacctgcagtcacagctacttgggaggctgaggcaggagaatggcatgaaaccaggaggcggggcttgcagtgagccaagatcgtgccactgcactccaacctgggtgacagagcaaggctctgtctcaaaaaaaaaaaaaaaaaacagtaaaaagaaatcagaagacaatagcagtaactagaacattctactattattgactagtaagatatttagcttttggggaagtcctaaattagcctggaatcatttttaaatgcagttttgtaatttcagtgatgtgttacatgaaactcaaagagccacaaaataattcacgtgtaagcgaagagtgtgctggtttaaaagatgagtctgcattcttctccctttatgcagataattcgtaatcatctttgagatcccagcagaaatgtctcttttgtggttttgctttccttgatgctctagatgaagttagacttccctataccccaacttttacatgctcccagagagatctatattttcctttccagttaaattttaatcttggtgaatcacttaaattatgatttgttaatgcctsttttctttttgagaccataattatatttaacaattattgactccttatcctgtgtggcacctttctcattgctttggacaatgtgtagcaaagtcctcactgaatcccaggagtctaataggtatttgtgaatgaggagtgagtgartgaatgaatgatttgactaattcttacctcactaagtcacccatggcccaggagggtactgtgtacctttatgttacaaatcatttaactttaattttgactggtaggtgaagtgtcccaagaatttgtaaagataaaactgtgcctttggggcttctcctactgctcccctcttccctaagagtcagcagctggaaaaggtttatttattttttttattttgtaactgtagaggaatcctgaatgggccctgcaaagtaatctcagagattgagccacacatagacaaagatggagaacacagctcacctgcagagtgctgtttctcatcactaactgtgstttctctcagtcctgactttttatgctgaggattctgggagaaatttcaccttctttacttcctacaggatatccagtttcctggtctgggagctgagagcagaattagccaattggaaggttaacgcataattgtaggcactgggtgtatggaggagacccttgaccatttgctatttaactgaattaatgttggccagttatagattttctgtttgcaaaattgccagcagatttttctgactcctggatctgcatcctgtgtatgtgccacttgggatgccagcattttgattgcttccagagcgatctaaccagagcctgctctcaagacaagggaatccatgattcacaagyggaaccgtacagatgccagaccacagcgttcttttcactttgatttgagggagatgatgttggtcagggtgatgactcccccatttcaatttctctgatgttgttcaggccagccacacggtgaacctcctgagattgattcttgctcccttctttggggttcagtgcatttcagagggctggtatttagagagaagccctggttccacagcttccaaccttttgacactgctttgagttctctggtggggatgataatgaattttcttcaactgtctgtgtgcagtggttaggattttgaggtctgatattgaagttttgttttctaagaaacacacagagtcgaggatttgagtgcaagtaatttgagtgatggcagaaattggtttaagaaaaatactagctggggccgggcacggtggctcacacctgtaatcccagcactttgggaggccgaggygggtggatcacgaggtcagcagatcgagaccatcctggygaacactgtgaaaccccgtctctactaaaaatagaaaaaattagccgggtatggtggcgggcgcctgtagtcccasttactcgggaggctgaggcgggagaatggcgtcaagctgggggcggagcttgcagtgagcagagatcaygccactgcactccagcctgggcaacagagagagactccatctcaaaaaaaaaaaaaaagaaaagaaaagaaaagaaaagaaaaatactagctgggtgcagtggctcacgcctgtagtcttggcactttgggaagtcgaggtgggtggatcacttaagctcaggagtttgagagcagcctgwgcaacatagtgaaacctcctcagtacaaaaaatagaaaaattagctgggcttggtgacgagtgcctgtagtctcagctacttgggaggctgaggtgggaggatcgcttgagcccaggaggttgggtctgcagtgagccacrgttgcactccagcctgggcaacatggcaagactcggtctcaaaaaaaaaaaaaaaaaaaaaaaaaaaaggaaactttaaaagtyaaaaaaaatagaaaaaataccaatagggaatgaggaaataagtcagggaagagaaggcaggtaatgaatrtgagttatcaagctagattctctggtggactttggcactcaatcccaggtggaaactgggagacaaaatgcgtatctccaagtgatctcaccagaggggtgagggaattgggatatttacataccattccccatcagttattggttaaggaccactcccaggatgttaatttccaaacactctcttctggcactatgctcagataaaatacccttccacaagttttagagacatatctcgtacaaagaagaaaaaatgcaaagtcctgcacgttgacacagaaggtctgaggggaatgggtaggactctgacagagttcctttgaggacacttgaacctagattcagatgctggcttcacccattccaactgtatgatcttgggcaagcttgttaacctttctagaatttcgagttcgtcttctataaaatataccttataacattacacatttcataggcctgctgtggagatgatgcatatggtgagtttagcacattaatggccaaatactaagggctcaaaaatggtagctttcatttgttaagtgttacggagcctcttctctgtcccagtatgtgtggtaggtgctcagtagaaccagtggttggttgttggggggaggtaatacctgtttttatggccttatagcctttgygtactaaaccttaagaccatttcttatttcactaagtcacaccttgcccaggagagaatcgtatacatctcatacattatgttccaaatcacgtaacctaaatttttgaccgctggatgaagtgtcttaagcatctgcaaagacagaactgtgcctttgaaagcaattgtaaattttaagttttatagtagccaagtttgcaaaaggaataagaaactggtgaaattaattttaataacatatatttaatttcatatgtaaaatattrtcatttcaacatgtaattaatatgaaattattgactattttacattcttttccttatttagacattgaaatccagtgtgtattttatacttacaacatgtcagtttcagacctatgactgttaaagtactcagtagccaccggtggttcatggtcaccatattgggccacagtgaaggcttaacaggtcctggattccttttagaagtaaattccaacagaatagttccattttctctttcctcctcttcatagatgacaatgcttctttgcttgtataaaaatgaagttggttttagcttaggcatcatggaaaattgacagtttctgtaataaaatttcacacatggaaaccatggtgagaatcttagcaggtgtaaaaatctgacgaagttatttctttaactgcaatttaatggaaactgcagcagctgttccatttgcgtattctccaaatctcagtgccaaaaagaattgttggcagccactggagaagtttcaacttacctcttcatttgggaaatgaaatcaaaacctcagcttgtttctaaaagttgcggatttggcgaaagttagcagggcaaacacataagccgctattaaaatattgatggctttggttttctcaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctacgtggctgacaagtttaaaggaaagacaagaaaaaaaaaaaaaagcacacttgactggattattctgtgaggctgggacacactctaagagtcgaaaggaacacaataatgaagatgcactgttgagcatcaagggagctgtccaaggtgaagcccgtgcacctcccgatgaaatgacgccaatgaaatcatttcaataattagtctgtaatgacaaggtgcagggctggcacaataagtgaattccaatatgtgatttcctgctcatttgatctctgagtgtgactcctgggtcaggccattaggaaccctcctttgtcttttcatttttgtatttatcagaatcaatatatttcaaacagaacttgatttgtgagaaccatttttctggctctcctctcctctcttcctctrtcttccttttattttttttccaagtgattatcccaaatggcatctatgttaacatgcttggaaatgcgaagcgaccctgagtatggaaattaatagagttggtatgcaaagtagacctataaatgtgattgcttctgtaatcttcacgatagcaaacagtttttaattcgctgctgagaagctggaaacaatcatactttggggggatctttttaatttaaagtaagccatactgtacattgcagtatcacagttgtgtgtgtgtgtgtgggggggggggcggcggtgtgcgtgtgtgctttaatcccctaagtaattaagtgggttatggttgttgcttctgggtaagctagtaaatgctaaatgggactaggttcattatcaatgataacacattcagaaaaagtcagtgatatgagaattgaggacacttaaatttttatgcttgtatatgagttgttgggtcagcaaaatttgattagcccctcttggtgaaaccgtatgtccatgtatattactaaggtaaaaaaaaaaaatccaaagcagatctggttaggtactttcaagttcatctcaaagcaatgaacatattatgagtatagagcctgcagataaggttaatggtgcctaaatgaggaagaaaattgtcatagacttgagaatgcctattgaaaatagtttaggaaactctggatttctagaagtagtagcagtgctttgctttattccacttgcaagtagcggttcaattgaataaacttttatacctaaccaaccaatattttaagccagtytcactctcccctctctctcattctcagtttattttgcgtatttcttataatgcaaaacaaaaaccttctgtctctgaaaaacgtgattaatcaagaaaccaatgagtgaagtgtgctatcaaattgaagactctactggcacaaggctaaatctgaatgaaaaacgaaaagaaccaaacagaaccagaaaatgttaaatgcatagattccatttcctgaatcattgtataccaaagatccaggaaatggttagggatgttttagtctcatataaatataggtcagtgttgtacacagtragaaaactagattagtagcatcatcttgtgccctactcatgacatttgcacttcatatttttcctttatctttrcaatatttaagagctttggttaccaatcattgtgaacttttgtgttgcagggggtgtaaacacagcataatcaatcaattgatgtctacrctcttcacttttctttaaagttgtctgaaagtgctgtctctttgcctgacagacatagtatatctacccctaccctagacttgtgttcatccaattgkgtgttcagcttttagcaggttatggggaatgtttattctgtggatggcttcctgctatctttgttcagacagtaatatttccttttatcctttttcatcttcctcctcaattttcaatgacttatctttttctactttaactgttactaatggtcacctccactccttttatttccctaatattttattcactgttatctctgatacatctttctctcagttgttctgaagccttttatttscttcacatctgaatcactctttattctactctcctttccactaactggacttgcttttgtcttaaaaaygccatttttcaacaatatgctgggaccaaaacatagcattcagctatttcttctaacgtaaccagtgggctcttcactgcatctttcagagagtgatgcaaagctcccaactcagggaaacttgggtaaaacttccttggcttcatctcagtcttgaaagtttatctgggaaaatgtgattcttcccatttgtcaatgaaaaatacaagaagaaaggagaagtcagcttagaaggcaaccactcagaaaggaggcatccatttaaggtctttgaattctgaaargaatctgtgaaaagtttgtgggaggtgttttctggaggcctggcacccatatctccctcaaattgcccagcatggtagatcttgcttttccccaaacacgacaattgtgtgatctgggagctgacatcttagtaccaccagaattggacagcaaccctggttacatcatgacacccagaacagaagatccccagtcttagaagaatagctgtcttgggcaactgaccagccacccagctgggatgggaagatcccaagtgataaaatctgactatcctatgttctgcaaaattataaaacaggatagtctgctttgataccatcagctcagacagattttttccagcaaatggaaaaatgtgtggtcattgagctcattaggagaaaccatacccttgacctccagcctctrttagcaggggatgagtgcagtctttggtgtccagaaagaagatcctcattggccacatagccaccattagaactgtactttttttttcttacccttgttcattctttatgrgtcattcctcttaggccacccacatgcaaacatagacacataggtagagacagaaatcacagcatctgaatttacctacaatacaacttgcatcacatgtttaggaaagaacctgcattaacaagagcaggctaggctaggccatggtgtcaaacaactctagtgacttaacacagtgaaagtttatttctcactcagatcrtgcagatgcagtcgggctgctctcctgggtaactctcctcccagtggttgccctccatgcaagaacctgatggccgaggctacttccaacttggtcctaccatcttgtagcttccagcttttatcactgagctggcagacaggggaataagaaagactatgaggaggtcactgcaggtgcttaaatacctcagccccaaagtggcatgtatcatttctgctcatattctaagatctaatcatgttgccaacctaactgcaaaggagtctggcaaacgtagaagaacacatgggtatcgatgcaggatcacagtctctacaaagatcctaacaaaatgatgtcgcctatatcagaaagagacataaatagagacagaaatggaccacaaaggagccagctgtcttggagtaaccaaggcctacataggatgaagttagtcagtttaagcaggagagcaaggtcgtgcacctgcgactatgtcctgctttccttagtagagaaatattcccactgaacagaattagcttcttagaaacactataagctcctctccctgtgccatcttagaaacactaggggagggacagcacctactcatggactccagttgcttcctccaattggttacaatactgtggttaagatcacacagttttaaactcatatcgactagaattcaaatgtgcacacagtcatctattagctctgtggccatgagtgagttattcacatcctccaagtttgaattatctcatctccaaaagaagattaatggtagtccctgcttctagagctaatgcctcaactgatgggaaacatgcttagaacatagtcacaaataaatggaagctgctattattattattattgtcyttataatttctgctgttactattattatcattactttcattcatagacctcagctagatccacttttcttataatggccatctgaaattggctttaagaagaaaaatcatgttggccattaaaaatacaaacaggtgaagaagcgactaaagcagtgattgtagggcatttgaacttcatggaccagtaatttttttaaatcctagattgatgagagtgtattttaaaaaatttgstaagacttggtatgaattttttaaaagtaagtaaatgaagggaggggaaaacactaccgccatttacttttgccaggctttccttttaaaaggtcacttggcatcaaaaataaacataaaagaagtaaagactagttacagaagaaaagtcagttctttgagtaaattttgctttgtgaaaaatgcaccaaatattcttatttacttcgcttttgtggaaaccattgatctaagggattaggttgatgtcaccctttttgctcttcacttttctgatacttttctgaagttttaatatgtcgttgtttctgaagaggcaggggtatttcttaggagacattttcatgaagggactcctgtccatgytgacaaaagagagtgagtgtttctagataatgtgacaatcatatgcatgttaggaggtgtattagcctattttcatacttctataaagaactacctgagatggggtaatttatacagaaaagaggtttaattgactcacaattcagcatggctgaggggtggcctcgggaagcttacaatcatggcagaaggtgaagaggaagcaaggcaccttcttcagaaggtggcaggaaggagaagtgctgagataaggggaggagccccttataaaaccatcatttctcacgagaactcactcactataatgagaacagcatagagaaaactgcccccgtaattcagttacctccagctggtcacccccttgaaacgtgaggattatgggaatcatggggattacaattcaagatgagatctgagttgtgacacagagccagaccatgttattccgcccctggttmctcccaaatctcatgtccctttcacatttgaaaactaatcacacattctcaacagttcccgaaagtcttaattcattctggcattaacccaaaggtccaagtccaaagtctcaactgagacaaggcaagtcccttccacctagaggcctgtaaaatcaagttagctgcttcctggatacaatggaggtacgggcattgggtaaatacactcactccaaatgggaaaaattggccaaaacgaagggtctacaggccccacgcaagtccaaaatccagcagggcagataaatcttaaagctctgaaatgatcttctttgactctgtgtctcacatmcaggtcaccctgatgcaagaggtgggttctcacagtcttgggcagttccacccccatggctttgtggggtacagccccactcccagctgctttcacaggctggcgttgagtgtctgtagcttttccgggagracagtgcaagctgtcaatggatctaccattctggggtctggagggtggtggctgtctctcacagcttcactaggctgtgccccagtggggactctgtgtggggatttcaaccccacatttcccttctgcactgccttagcagaaattctccatgagggctctgcctctgcaacaaacttttgcgtggacatccaggtgtttccattaagcctctgaaatctaggcagaagttcccacacctcaattcttgacttccgtgcacctgcaggcccaacaccacgtgtaatatgcctaggcttggggcttgcaccctctgaaacaatagcctgaactgtattttggccccttttagccatggccaaaatgcagggctccaagtcctgagacggcacaaagcagcaaggccctgggtctggcccatgagaccattttttcctcctaggcctcagggcctgtgatgggaagggctgccttgaagacctctgagatgccctggagacatctccctcttacccaccagccctgttacaccattgacttggcgattaacatttggctcctttttatttctgcaaatttctgtagctggcttgaatttctccccagaaaatgtttttttcttttctatttcatcttcaggctgcaaattttccaaacttttatgctgtgcttcccttttaaataaaaattccagtttcaaatcttctctttgtgaatacgtaaagctgaatgcttttaagagcacccatgtcatgcttgaacactttgctgcttagaaatttcttctgccagataccctaaatcacctctctcaagttcaaaattctgcagatcactagggcaggggcaaaatgccgccagtctctttgctaaagtacagcaggaattacctttattccagttcccagcaagttcctcatcaccctctgagaccacatcagcctggacttcatcgtacatattactatcagcattttggtcaaagccattttacaagtctctgggaagttccaaactttcccacatcttcctgtcttcctctgagccctctaaactgttccagcccctgcctgttacacatttccaaatttgcttcctcatttttgggtatccttatagcagcaccccactctactggtaccaatttactgtattagtctgttttcttttctttttcttcttctttttttttttttttttttttttttttttgagatggagtctcactttgtcgcccaggctggagtgcagtggcacgatctcagctcactgcaacctctgcctcccgggttcaagcgattctcctgcctcagcttcctgagtagctgggactacaggcatgagccaccatgcctggctaattttttgtagttttagtacaaagagggtttaaccatgctggccagactggtctcgtattagtctgttttcatactgctgtaaagaactgcctgagactgggtagtttataaagataagaggttcaattgactcacagttcagcatgcctggggaggccttagaaaacttacaatcatggtggaaggcagagagaaagcaaggcaccttcttcacaaggaggcaggaaggagaagtgccgagataagggggaagagccctttataaaaccatcagttctcgtgagaactcactatcacgagagcagcatagaggaaaccacctccatgattcaatgacctcccccgatctctcccttgacatgtggggattatgggtatgacagttcaagatgagatttgggtggggccacaaagcctaaccatattaggaacatatgttggcatgcaagcttctgtgagtgtggacaagtatggcctccctggccttgataactgacagttactgtgtgctcyctagtgtgttgagggccacctcgaacctcacaacagctcttaggggaaaggtactctcatctkcccattttacaggtgaggacatttaaggctgagctaggtgaaacaatgaacctgagatcatactgcttataattggtggtgtcaaaatttgaacccaggattttagggccctggttttcatccatagttctgtggcctastgtctcttagtttttttgatgttggtggtgatacatcaaggaaatttgccggtgtgttttcccatcacttttatcaaccagggtgagatagagagaactgctgctgctgygtatttgttgcttttcatagccaagctcatcctgtctctgtattatagaagaattagctttttctattctggatggacccagggccagattgtccatgacccttaactctcagctttccaccctctctgttagtttctttcaccaagacgttacttggtcatgccaccatgacactgaccttggttagcagccaggtcctccatggagtgtgtggaatcacattaatcatatttgtacttaacatacatgagtcatggcttttgagggtgcttttaattgactataaatcaagcaaggaacttgaaaaatgaaggcaattaatgaaaaagcatgtgagaggtgttttgcatcctaagggaggaaatacactgtcagtgaattwaatgtcacaacaaaggctcttttgaccctgctgaaaagatttcatgtggatagtaataaatggatgaactttgcagcctcacaggtggagaawtgcctgtttcctgagttcaagctgacttaggcttttatctgtctacattctctatcttgagaacttcctagattcttttacktttgctttcatttcttgtgatttttaaaaataacaatgataattcttttcccattttctggtcattcttcacacatcctttacatattttatacaagcttgtatttactttcaggttgggagactgattaattgattagtgaggttatgtaacgtcmcctgaactgcagtctggacagagctggacaaggttggggtttcaagtagtatatttgttttaatctgttgcgatgtgccaaggaaaattattctggtattgcctaattcactctatcattatgaagttgacgatacatcgggtcagaatgtggactcctatttacattaataagagtttttcctatatttaaacagagctcagtagaaatgttatgctttcacaggttttcccttccctcctaccaatccwtttgtaacaatctagtagtaagtcaattaataatgattagaaacctcataaatgcattatcctacctaacaaatgtgaaatactataataaaatgacgtaagataagaaatgaacatatgtacacatcaaagacagatgtaacaaaatgtttagagatccttccattggacttgggtcctaacttgttctttaaagaatgggaaacacaagaagtaacagagtkagaaggacttctcagacgaggaacatgaacacaggtggagttcccttggcctaagttttcttatcagtagaatggaagagataaatagaccagaggtatcacactgtcagcctttgggctaaatttgcctcacagatacgtcctgtttggctgcttagtgtgagaatttgaggtgtttgataaaaggaatttgtcattaacatttagaatttcacctttagaaattcccaatttctgggtagtgttgcgtcttcagagcagacagagatgccacmgttcagctgcctgggttcaaatctaaggccgatcctttaccaactaagtaactttggcaagttgggaaaaacaaaacaaaaaaactcactgtggttttattttctcatctggaaaattaatattataatggcagcaatctcaacagtctgttttgagggctaaatattaatctatgtgtgataactgctacattgtgtaattattatcattattatttgagatggagtctctccctgttacccaggctggagtgcagtggcgcaatctcaactcamtgyaacctctgcctcctgggttcaagctattctcatgcctcagccttccgagtagctgggactacagaagtgcaccaccacgcctggctaatttttgtaattttaatagagcaaagttttgccatgttggccaggctggtcttgaactcctggcctcaaacgatcgtcctgattcgacctcccaaaggactgggttaggtgtgaaccactgcgctcagcgggaattttttttttttttctttttaaacacaagtcaagtgtagtagtgagaagtgcggaaggggtagaacaaggagtttgatmtgtaactttatccttattaaaataccaatgaaattatttacagaaaaagaaaaaaaattctaaaatttatacagaaccccaaaagacccagaacagcagaagccatcttgagcaaaaagaacaaaattagagttatcacgttatctgacttacagttgtactacaaagctatagtaactaaaacagtgtgatactggcataaaaacagatgcatagaccaatgggacagaatagctaacccagaaatctatgcatttacagtgaactcatttttgacaaaggtgccaagaacataccttggggaaaggacagtcttttsaataaatgctgctgggaaaactggatatccatatgcagaagaatgataatagagccctatctcttgccatatacaaaaagcaaatcaaaatgaattaaagacttaaatctaagaactgaaactctgaaacgactacatgaaaacattgggggaaatactccaggacattggtcttggcaaagatttcttaagacctgagaagcatgggaaactgaaacaaaaatggacaaatgggatcgtaccaagttaaaaacttcctgcatagcaaaggaaacaatcaaaatcaagagacaacccacagaatgggagaaaatatttgagaaccacccgtttaatgagggattaatagccagaatatataaggaagtcaaacaactcaatagaaaaaaaaatctcattaaaaatgggcgaaagatatgaattgacgtttctcaaaggaagacaaatgggtaacaggtatatgaaaaaatgtccaacctcactaatcatcagagaaatgcaaaaaaatgtatatataaacatattctctccctgcagttaaaatggcttttatccaaaagacgggcaatcatgagtgctggtgagggggtggagaaaaggaaaccctcatacactgttggtgggaatgtaaattattacagccactatgcagaacactatggatggtccccaaaaaactaaaaatagaactactatatggcccaacagtcccactgctggatatatatctaaaagaaagggctggaagggtcctggggagggagaataaagtggggttggttaatgggtacacaaatacagctagaatgaataaaatctagtattttgtagcrtaatagggtaacaaaaattaataatttattatatattttacatacccaataagatgaaattggaatgtccctaacacaaagaaatgataaaggtctgaagtgatgaatactcaattactctgatttgattattacacatagtatatctgtatcaaaacatcataggtcccctctaaaaatatacaactattatgtayccataaaaatttaaattactttttaaaatattaatctatgtaaagggttttgaatagtagctgacctataatggtccctgaaatattagctgtcagaaacagcatagggatgattgtagctgaaagcttgctatggccctccaatatttatctttctsatatccagtaggcttcctagttaactctgcctgtcccacatgggcatctaaattcaccttcaggaagtcactattactcctaagactgttcatggagtcaaatgatgttccatagaagacaaaaccatcttgaagtttttgatgctgtcttgtttctgtcatatcagtaacactattgacaatacctgctattcactatcaaggaagcagaatacagtgctaaggggtgagaggacatgggctggctggtgttgatcaaagactttgaaatctgttttcagtgttttgaattgttgatacaggtaatgtatgaaaagggaaccatgtggtcagacagggtggctggctttctggaagttcagaataggaggaaggtgaaaaggatgagtgggcatggctcaggctgccatggagccatttcagaagtcctgagatggggacagtttgtatgtatrtcagaggagagatcaacaagggagataggagtgttattggggagcacttgaacatgaaataagtgaaaggagagccccagggagatccaagggttgacactaacaggcatctaaaagaggttttccgaaagagaagcagaatcactggagtctaatcccagctctaactttgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgcattaatgatatcctcaatatcacccttcatcccccagctttgctttctataatattgatctcaatcttcactctcagagggtttccctccaagatggccaccagcaattccagtcttttattcttctagctaaaagagccagagcatctgttttcccagtgttccagcaaatatctcaaggctraccgtccttggaccaacttggtttacgtgcttatccctaagccagttattatatccaagaaaattctgtacttctcttagccaggcctggggaaatggagatgaaattccctcaaggaaggaaatgatgctgggctggcaaaagtcagacagtccgttctaagggtattgtgctctgttgctaaggtcccattaagtactaacgtcttatgaccgcagactgtgccccaagcctgagaatttttagaacccagcatacacacaaatggaaatgttttttaggtggcaggggataaggacagccatcacaccaggtttcttgctggtgatgctggtgagcagattgcttaattaagactatcaaattctaagtgctgccatatggcctcactcttcaacctgttgagtgtcttcactcacttggttctggagctggtataaatctgtttcatttctgtttttctttaaggaattaagaatacaggaacatacggatgttacaggagcatctcctaatttaaggtattagaactacataaactgggctgctttaataagtaaggcatcaaaatataaattgggaaagattaagcatagctttaaataggctgagaaagcagaagttcttattattctgttacagatcaaatctacacacattctagtaatagaggtgccctctatttgttcttttcaccttaatgttgatggaaatttttttggcttgagagcaaaagggcaagaggtacaaatgcttgccagtcaaaatatccccaaggacttctgcatttgacaaaattcattctccttctggagatagaaatagggaatggaaaaggaaaagatgtatattgagtccctaccactcatttagccaactatagaagaaacactgaatgatcacctagtttttgccagaccctgtgctaagtataagggataaagctttgaatcagataaaaaatgtgcctcctgctgtggagctttgatgatatcrgagagagaaaaaggcaaacatgatataataaacccttgagaacacaggaaaacggcacatgacaagacgatggttaagtatcatgaaggaaataasgcaaggtcatatgatagagatttctgcatggctgctgaagaatgggtggtcaaagaagatttttctaagaagccaagtcctaaactatgagaagaatccagtgaggtaaaaatcaatggtataaacacttaggctgagggagtaactcatgtcaaagccctaaaatgagagtgggttcttcagtttgagatactgtgatccaggaggagggctgtcatttgatacatttaatcatctcaaatgtcttgcaaataggattataaactctatgttatagataggggtataaagattgactaaagagcccaagatctcactaaaaagtgtcagtggtgttacaatcctctgactccaaaccccattatctttccatatggaatgstgtagctggtgttggagtcttctttcacagtaaagtgctcctgtcattgcctctgagaacagactggggtgtcctkgatagtttcacaggacagtggtgtgggctcctaggttatattgcctgtctctgtcactcacaatgggtggtgtttttaagctacccaaacttccagctcctaatttttctcatctgtgaaatggagatagtatttcaaggattaaacaagatagcacatacaaaggagtgacagcagtgcctgctacatgcaatatttttattttaaaaagttggttggttttatcctttaaaagaataaggctggggtgggaaatctctgtgggatgatgctgtttgaatgggtagtgctggatgcccaccaaagatgacccacgaaattttcaatatagcttggctcctctgaaagagagcatattttcttcctacttcttctgagactctcttttaagtattttcatgttctagggatacttgttctcccccacccctgaccacttctcactcatgcttggtctctttgagctaaatgttaaaaacatactctatgaaaaatatttgagaaattagtactcccaattttaggtccagatgtgttctggaatttagaaagataataagatgcacacattgtwttacacgattctacgagcggggtctcgggcagctccctgtattaaaacaggttggcatttcaatagtaaaacatatgaatgtttaccctcagtaggataaataaggaccacaaataacatcatgtcagttcaggttgggttttgctgccaaatgagttataaaaacatgtttggtatgctgagtctcttgratttcagaattgcagattgcagtccttagaacattcccgtgaaaagttgcaaaccttagtcgtgctaagatgttgagttggcstcttcacatcccggccacttctgggagcagcagagtgtggtggctcagcccacccctcaacccctctactacttgtgaacaccttggtaaatgatgtcttggcaggccacccccgagaagtggccaagtgctgcaccagcttttttcttttccatttgaagccaaaacgattgtcagcgatccaggcttctcttaactgtgcctgtcagctgattctgaagacctcccagaggatctatttttagctaaaactggttttaaattttcatatgtatacattaaattccatagaggaaggggggattccaaatgaggaaacattgattctgaataacataaaagaaataagcagtgcttgaaaaacagttcaaaatatgagtcaaaacctcccaggaatatggttagcactgcatttttccatggaaggaagtctgttgaattgaaaacagaatgagagtaagtggggataaattatactaagaaagagactcagcatgaaattctaggtactgaagaggggaaggagaataagaatagggaggactgaacttagagggcagttgggattgccagatggatactcatggggatgtgtggccaggtaatcaaatcgcattgtccaaaagggacatggaggccatgggctaggaccaggcttttggccatactcaagagggagagagaagatacacctcccaaataaaggcctggagtctgcacatgacagctttgattatgcttccaaggttttgttcatttttggggcatgaccaaggtagttctagaatgagtgaggccaaagctgaaagtgtcacaaagtttttgcrtatgacaaaagttgcctgctttgcttttggatgctcaactcagacttcttgttttcatgatgtgcagttttgatcaggacattttagtgataggtatagcctacttctgtaccaaaggagaggttggattatctgttgaaaagcgttttgttggctataattacaatatgatgacttagttaggattctgataaatcctgactaactcaagactttaaagaaagatacttaattaaaatagaaggaagttgcatagtcacaggttcatccaaagacctgaatgacaaggtctcagaaaggacagaaactagagaagttccatgggcttaagcaatgggaactcatagaattaggacagtgcttttcaaacttttacagtgaatgacgatatttgtttcattttgttttgttttaatgtgtcacagtaacatacttttgttaaagaaaaatgtcaaatatagttttcaaaaagtttaaaacatgactcacattcatatctaaagtgaacacatcaaagattttatctatctcaacaatgcaaaaggggaccaataaaatgataagtatgattcaaagagcattcgagaaactagctatttgcatgcaatttaatagtaaaggagtgttagaataagtttgctaggttacatacgaagctggttaatgtcctgtattagtctgttttcacactgctgatacagacatacccgagactgggcaatttacaaaagaaaggtttattggacttacagttccacatgagtggggaggcctcacaatcatggtggaaggtaaaaagcatggaggagcaagttacgtcttacatggatggtggcaaaaagagaatttgtgcaggggaactcctctttttaaaatcatcagctctcatgagactcattcactatcacgagaacagtacaggaaagacccatctccataattcagtcacttcctaccggtccctcccatgacatgtaaatagtgggagttacaattcaagatgagatttgggtggggagacagctaaaccatatcatgtcctacaggacaaaaaactgtaacctctgtggttatcttttctacccatcattacttgtatctctgccagacagaaatctgtgaattaacatgtaatgttgttaagcctgaaaccatcattgagtagtgaayagtacattttcctagataattaaataatctttgaattgacaagttaatgcctgtataygacattgaaagaacatgcaacccacatttttgtcttattttcaagttttgaaccttttttcttagtaatataatgaaaatcaagttttgtaaaattaaataaatccaaagacataaaaggtaagcttttaaaaaaatagatggaacaggtataacattactatgtcacattgctttcaacttctgtactcgtcatgggcccctaacaagaggttgggcattggtctgtggaccacacatttagtgttaagataggaataacttaactccaaataccttccagtttgggatgtctttattcaaattcctggtagagaagctgattggcctggcattgggtcaagagcccactttgtggtctagcagacaggtatcatgtttggaagcccattccctaaactagggactgtaaacaaacaaaaatcagaagcatccatacagttactgagtttggagaggtagcccaaacaaggggaggacttgggcagtgctgagctctgaccatagaaaaaaagtatctgggaactatctcaagcgtcatttaggctcccycatttcaagcatgcacccaaacagctcatatactatacagtaaatacaacttctcaaagtagaagataactggtgttaaaacaagactacatttatgagaactcacttccataagggcaaatactaccttaacagaatmtcagcaacattccagaagatggaagtcagaatagatatttatagggcttgtagggagggtatagcctcaagcaatttaagataggaagatgattggtattgggtaaattcatgacatcttgatttaagattgttagacatagcaagatgagtttactgaaataagtctgacaagtaggttattgtttgatagatgagctatttatctagctaaggagactgttgtcccagataaattgatatgcatggattgtccaaatgaagcagtgaaattgttcctggtttagagccttatgtttcgtggacaaaggtttctgtgaacaattaagtcaggttgacgaaggtgatctcagttgttggtcttaagcactacgccatgttgatttaggtggtctgaattctcaggacatggtagttcacatttgttccatgttagcatttcccaaacttctgtctgtggaacactattctgcagagtggtaacagcaatgcaatggggggaaacatattttgaagttaagtaagtttgggaaattctgttttgttttttaatttaaactgtaggccctctcaagtctttatgatgtgaaaatgcacagtaaatattccagaaagcatgcaaaaataccccagaatctaactcctttccagtctgaagagctcctcaaatctctcctaaagttacttgctttacrcacagccacctctattcattttttttttttwaatttccagtagccagtgtaacctgggggccagggaagacctgaacctctaggactcaaaccctgtcatgattcttgaggagagaggaaggtggaaatacatacatacacatagacacacacacacacacacacacacacacacacacacacacactctatatatgtatatatattctcattctgctaaactaatcgaaagtaagatatagtaaaatgtttgaaaatacatatgtgcagctttgaaatgtcttcccatatcataatggctgtggaatcagcctcagaagccagattgtctgagccccaaggaaacgtcaaacccctctccctctccagtagcattccccagtctgtgtcacctagacgaaaaggatctcagggtgggtggcaatgctccttcactgaaatctgcmgttatctctacccaaggcttacagtaaattttttgcaaattagaaagccctttgctctctcagtaaaccctggctttcaagatttttgttktagtaaagtctttagactaaatgttgaatctttcactctctttgctcctaatcatctctaagacagcaaatgcctctagcaaaaaagaggagacgtcaactgggaaaatttgaagagaaagtcacacagatacatttcagtaaggttgtctctgttacttgaggcttacaagaaggaaagaattccctctctaaacacactctaaacacacaggagttgagaacggggagatttattccagaacccctyctgtgcgttggggcttctggtagcttgcctttcttggtaacgattttctcaragactgggtagattcgagtggagcctggggcatggttgttggtccaatggcgggggttggggagacacaagcagttggcagggaacttacaaatctccaggaggttattgagaataaaaattcagatattgccatcttttccatttcaaagcaccaagagtctgtcatcagcaattgtgcctttctaggtgtcacctgaatatctaacattgaggcattgaaagatagatcaggactgattttactgagcattttcaaaggcagcaggcaggcttttcaatgctgcatgagatcctcaccttctctgaggtgacaggggcttctgttttcttgagtttccctgtttgctgatgtcatcccctcctaccccatgaccatgacaccaactacatccatgatgtatatttccaatgtgtttcaacttatggtcagctcccaccagctccatattctggtgggataagcaagccttgccttgagctttgcaggctgggcccatggttgtggacatcacagctctggtcctcatagtattggtggcaggcagatgcccagctctggcacctgaatgcttggatttggatgccagctctaatacttactagctctgtaacctagaaaaagctccttagcttctctgcactttaggtttcttttttaaggaacactgaaggaaaatctgaggctggtacagtctctgcttggcaaatggtggttatttctatccattaatgtcatctgatcatggcccctcaaacctcactttgagccttgtgagcaaatgatacatactgtttatatrtatattttcctatatatgtagaaaaatatatattaaataaatataaaatatataatttaattaaatatatttaatatatatttatagtatattaatatttaatatatactatataatatatacatatattgtatattttatatacaatattatatattatatttatatgtaattgtatatttatacataatataaaatatctattatatgttacatatatttagatataatatattttacataaattataatatataataatataaccagtatgtatcattatatataatatatagatacatactgattatatatgagtatataacatatttacatgatatataatatataartatataaaatatgaatatatattatataatttataaatatatataaattawgcaaattatatttgtgaatatataatagatttatctaaatatatgttatatttagctatagaaatatatattatatatttagatrttatagaaatatataatatatattataacatcagtatgtatcattatatatagatccatacagattatatattaatatataatagattatattaatagatcatatataatcatataatggattaatagattatatatactatttatgtaatcagtatgtatatatattatttcaaacctcactttgagccatgtgagcaaatgatacatactgatcatacctactgatcagtgtatatttcagtctctttgtatcgccctatatattttccactttgcaatgagaggcctttgcttctcaagtgcagcgtcctcatgcttctcccacctgaacaaattattaaccctgtaaaccggctttcagcaagctacgtggatgaggggtctgaaggtttttagtttcttattagactgtctctcgtttcacttacatggtacccgctgggttgattgcttcatatatcggtggtactaatgtggatattgaatgtttcacctgccgagggccttcatctaattcatactgagcacatagaaaggtgatttgaatgggggcatttgctctgttattttggtgatggatttagggaaatggaaagtagcaaattgctttgtttttggacctttgccaggtccatcctggttatggataatacttgcttggttgattgaagaaggccagctgctactctaatagcccaagtcaatggccaacggtgcctgattagcaagcctgctatgcttactgtagtgaaaaacatcttataattataaattaataccctttctattatacatcaatatgctggtatatttcataagttggccagcccttcatgactaatattgatattaaggtcaactctagttttatgataccaaggcaaagaacatctttaagaaaatttagatacaactcctgactttgaatgagggaattcatactgagaacctcagtgttaccatttgtaaatcagattaaataatgcccaacatctggggctttgaaaaccaatgggataaactttgtgagaacaatttttaaagcctttagacattaccccgtggtgtctagtgtctcttcatattttcctctgggtttatcttgaccctttcaaatggaatgcgtggatgccattagtatttataacatwcattttcagtgctttagtattgtttttttctttattgttgtgtaatatgtatggaaaaggcatatagcaaagggtgatcaatggctgggcttatcctaatctttgtgcatgtgcttgggtgtgtagaggcttccgttcgtgtctctgggccatcttgcataggggttcaagctcccatttggatgccatgggttgaagtctccggaaagctgacctcagatgaggattggtgtgtaggaagtttattagggagtattctgggggtcatctgctgtgggagggaggggaagaaagctggagtctgacagtcttatcaaaggctcagtcaatatcacagggactctgaagccaggatggctgttcacaatggtcctgagttggggcaagggagccaagcctgtataactccattacaatctgtttttggatgygggctgtgggaaggagccatgaccttagaggaaaagactgtctttagccaaggtaacccatagaggactgacaggtgaaggctgtctgcagaacctgggaaacatagtccttccgtcctgaaaaggaatacaacaggcacattacagaattcactacagtcatctagaaaacaaagccatctggtatccatggagacagcttccatagtcactattgcccttggagacagacacccacattcctagtgtggttgcctgacagtggtgaggaggagggggctgactatctgagtgtccccctgcgatacgatagcatgtcacctggttcatgacccccacacccaggtctctttccagagctcacccctttttgaggctggcaccaccctggacccaccaccagcttctgtggcagtgcttactctgctgtttaacctgcagtactaattcctgtctttcaagaactctgtctttcaagttccccattattaactttaatgtatgattatttatgtgtatctattcatgcatctatgtttttattaatttaggtatgagtgagtcctcagctcagtctgattcacatcagagcttttttaaaaaaataaatatcaggaatttttagagcatgtaaattatgattcaattcacacttgtctttttatgagttactgccatggtgtgaataaagcacacaagtgtcacaaagatattaacataataataagcattaatctccactagtagagtgttactaggcagggttccttccagctgccatatcaggaatccttccagcctgggtactaatgtcatcttcctttggagaccaggcatgaagagtcactcacttcctgaagtcactgggactgaaatccaggcagtctggctctagtctccaactccgctgccaatgaccaccagcattgcaaacccgtacacatgcgtatcaggcagacctggccgctggcaggcaagctaaccagctgtgaaccatggtcaccgctgcagggtagggctcgatgatcagaatgtgttccttcatttcttaaccatgctggaaaaagtatgtagagggactaagggtgtttttattttctttggcttttttccttccttccctcccttcctatcacccttccttctttccrttctccctttttccctctctctctccctttcttccttccttttagaaaaaacaaacctaacagtatgtatgtctaatacatacaaaatctggtatttaattttaaaaatttattcatacgcttggtaagatttttaccaagccatttggttttttattcactctctctgatgtggatcatgcctattctccttcttgggatattaggagaaaaaaaggatactatgattttcttaaaatggagctgtttaaatgaaggaagcatgtataagcctacccctttaatgggagggttcaataaatcctagaatttgcctgtaatgtgtagaggtctaaagagatttgtcctatgagaaagttcactaatttcaattatctgggttttattatcaccttctaagggttagagagacaggattttayagaatgccatcacctgaggctgtgacaatggggtttcacaccattaaattcagaaagcataagagaagagataagaaatgagagggcttgaagtgcatgccagttccgttgtggaaaatatgacctactaagcagctatgagaaatgaaagcaggcagtgtcatctcatgatctattgctattgtatgtgaaatgctttctatattagctgttgttaattaccatcatccccaccatcacatcattgtatttaatagcaggagaaaggaagcagctgttgtaggcaaagctctcacacttgagtgtctatcagagtcacctgggggaacgtgtgcaaatgcagattgccaggccctttgcctagtggttcacaatgagtatgatcaggctggaacacaggaatctgcatgttttccatcgactatctcagctgattctgattcaggtggtatgaggattacactgaaatagcaaacccatgctttgtctcctgttagtctagacagtaggcatctttctgttacctcttgggtgtaatgtttagtttaaatttcagttcctcatctctacgagggagtcataaatttgcatcttgctcacagagctgctgtgaggattagctgagctcgtgcccagaatggagcagcctctaatatttgctgtgctgtctctagagagcaacagggaggcatttcatggtcttccccatcttggtcctcactgtatctttctgtccttactctgtgcctgggacagctttagggcttaatgaacataacagaatgctgaagagctcagccactggagcccagctgcttggatgcaaatcttggctctccaacttaatgcctgttcatgagcaagttatttaacctcctagtacctcagtttcctcctctgtaaaatgggcttgattatcakacccccatcataggtgtttttttttgggtgtatgagatgaattattatgactacaacacttaaaaccaataatgaagtgccatgtagatgttcattaggtgaataaatacaaatattgttgattgaatgcatgtctgcatgcacgctgtttctttccttatgctstttctttccaacataatacagatgtattctactagctgacagacttttaaagtagaggccacttttaaaagcctgggctcccaygagaaggaaatctgcaggtataagatgggtttgtcagtcagcagaggcatgctattgagaaaaggaggcaacctggggagggggtgttagaagagagcttgggattcagttcttctaaccaggagagctgacaagtaacaaaatgagactccttctgttgtctgttgcagtagacaaagcaagatgcttagttaacagcagcaacccagtgcctgtaattttcaagtccttggaggcacaccatgtcacccaaggtaagccaggggacacaggagggaagcaagagaagccagggagaatctatttcctgtgtcccctgtaggtgtttgactcacctaaagttaacactaatagaacatttgctcagaaatgtcatcgctgaaataaacgtgttaaatttaaacttgactgccccaattcatctgttatgcaattgaactggaaacagctcagacttaaaaggcatctccaagtttttctcagccaacaagacttaggccactttgttttctcagattkttcagccttgtccaatttttggmtaaaaatcctttttgaaaacttcagcagccatattattttcttctccagtcatcaacttataacgtaaagacaaagctgtggggaaaatctaaagttgcgtcaaatttttattttctagccagctacagctctagtctaaagctctttcttttggggagaaaatcccatttgcacatttcctcttagttgggtggacttacccatatatacttgggtgacattcaggaggctactttgtgttttggctgtgtattckaatttttcttccggtactatatacagcaagagaaggggatgttgttcagctcttgttctacctagaacccaactgcacttttgcaagagatggatacaaagatggatgcataatgcatgatagtatattatgagcactactcttatggctttgcattgtaagtaattttaatgtaaaacatatttctatagtctggttacaaaaacaaaacattttagaaaatttggtcattctcctgaaaacagcaaaaagaagaaaaaaaatcataaaagatctgctgaaaaataatcagttttatgttttttctttcatgacagcttcatccatctatccacctatccattcttgtagctctccatccacccacccatctatatacacctcccacccccccacccactcattcattcatccacctacccatccatccatccacccatccayccatccatccacccatccatctatccattcatccatccatccatccatccatccagccatccatccattcacttatcctgccttgcatcctaccttctatccatctgtccttctaccttttcttctatctatctgtatattctttaatctatccatccattcatcctgggaagaaataatagtatctttaaaatgtagtgcattggttacaagcacaagatcttcagtgaatcaytttgtgcattcaaattctgtctgtatgtatcatgcactttctatgtaaccttgggcacgtttttatgcttctatggccttttcagtctttaaaaaatggggttaataatagtgcctacctcatagggttatgtcaggatttaatgatataatccatataagatacttgacaaagtgcctggcatagaggaagttctcagtaaatattagctgtctttatcattattatcctcttgctaacttaacagagttttcaagatctggtgagaaaacatgtaaaagatacataatataatgtctattaaaattataattataaatgcagtcataaatatacacatgtatatttcatttatgttaytgatatccatctgtttcatcagctcattttaaaggtttctttaatagctgaaaaatattctgtagtacaaatatttataatcaaactgttatagctattcatttagactatatcaaatttctgttgttattaataatgctgcagtgaacatccttattcagttatttccttagattaagttttcagaagtgaaattggtggttacagagtgtacacattgcaaagctgaatcatattgccacagtgcctggtgtttgcatttccatatggttttgatggccaggttttctgcactattgccagtgtatgtgttatcactgcaaacgtttgccatttcggtagacaaacatgggatgttattgctattttattaacttgtttttatttgatcaccagcaaagttaaactttgccatgtgttttttgaccatattcatttctgtttcttaaaattatcaacttagaatatttgtgcaattttttttttttttacatgtggagcttgttcttaatgattctgccagggcttaaaatttttactttctaatgagaaagttttggaatttactcttttccaatttatgaaaattggacaccggctccatgcactgttctaagcctttttctgtgttctctgtgattccttagagcttactaactgtgaccctccagtcaaaaccatgtttaaccaagtgctgatgggcttgagtccattcccaagtgactcggaagttgcttacttccctacctttgagtgggtctcattttatctcygtgatgttttccttgtccttctaagtcatattcactctgctcattgaagaaaaatggttggtaattgtagtggataactactccattctgtatgccttctatgtcttttcttgatgtgtgcacctctttctttatccttatttttaaacttgtgcttattagataggtttctgtacaaccatatctgtgtaggtttctcaccctagaagcctccttttaaatagggcaaagaagctacctaaagatttctctttaatatagggaggaaaccacttycgaacttgtgcccaaagatttatcttcaccaatggtctaggacagaggtcggaaaacttttactgtaaagggccaaataatacatactttcagctttgcaggccagctggcctgtgttgtgactactacacaaaagtartaagagtctaatttggcccaggagtttgctgattcctggtctaaatgagagtaaagaatgggaaagggaatggtgtgggaggaataggcattttmattcattgttgttaatgagaaagagtcttcaaacaccagcatgcccctgtgggttggattaggttagaaaatccttggaggactgccttttccaccccagagtcctggagagaagaatgcagcctgacaggaaggatctgggtaggtgacatgtggggagaggattaaaagaaaggagggccagtggctcacgcctgtaatcccagcgcyttgggaggccaaggtgggcagatcacstgaggtcaggagttcgagacgagtctggccaacgtggtgaaacctcatctctattaaaaatacaaaaattagctgggcgtggtggtgcacacctgtagtcccagctactctggagtctgaggcaggagaattgcttgaaccctgcggatgagaggttgcagtgatctgagctcgcaccactgcactctagcctgggtaacagagtgagactccgtctcagaaaaaaaaagaaaggagaagagtgtctcaagggtttttttttccagcaggtgaacccagcctccctagcaacccaaggttaagaacgtgttgaaaacagcatggaagcccattctggaaagcagtggtgattgtgattctgaacttaaacagcttcccttaaacacactgttacttcagaaaagtacggttttggccaaagggctgtatgtcaggtatttacttgctcatcttggtgggttttgtttgtttttgtctttttggttagccatctaagacattatttttctgagatccaagttccaaaaagcaccgaacaaccttttgggaagaaaacatacatagtgtgtaggtgctaccgatttgtatcctctatgaccttgccatagaaaggcaaatcagacgggcgctcccattgcctcattgcaggctgccattttcatataagcttcatgaaatctgggagaataaaggcaaaaggtttgatctggctgtgacagggaatattgtgaagctgctggactgggsctgtgggttgcctgtgactgtsatcaagttcttcttctctggaggcttcaaattcctcctctgtcaaatgaagggactggactagaaacagaatggcaagtacagggcaaatgccccagtgctctctgtccctgctgcctctggcagccacttctgctcccccacagcatctcctggtcgcctggacagaaagcctcctccatgcagcactgctccaggaactgttctcagccattaaagcagggttcagaaaagcttggaggaagatggccttgtagacctcccctagcactgaagttctgtgatgcttagcatatgtgaaactcaagtttcttctgttcctgaatggggattatttattgccttggacagcagccctgaaacttgatccatttagctgcccctaagtgtagttaagccccgtgaaatgtaaacttcgcaagtaaatggaccattgccatttgcctctgtcttctagatgcaattgttttctayagtctgtcttgtggccggttataaaatgtctgtcttgagcaagctggggaggagggtggatagctttcgatttgcccaagtttgttaatgtttcattgcttggggtgttttaagatcctgtgcctttaakagatttcctgaacyarcagtttgccttatttacttccctgggctataatcattattgtggctgaccatgttgataagctactctgtgaagccttctctaatgaatgagagtcactcttcaagtggttattccccttaaccttattttcaatcacagaaaatcattctcacagaaagtattctttccttttgttcaaaaaatacccccttgaatgttttaaatgtcactgttttttcagttctaaataatttttaattggtttttacatgaagttaactgtagcactcttgattcaggaaaattgtgcttgtctgtctctctattatctctctctctctctctctctctacctacctacctatctaccaaccaaccaacctatctaaaatctatctataatctattagtttttcttgcttcacaaatgacttaaggcaactcrctttcgggttgatggaagaaaaaatacaagtagcaaacttggatgaagttggaagaaacttggcacccactgtgtctggcatgtgcagatatgagtgatggtctataaatttaggatcttattaacagccaaagcaaagagtacaatttttccatgtatctggtttatagtatccacaggatacaagcatgctggttgatcaaatgttgcatctatatctttgtgattaacacctgacagatatttctatgatgcgttctgacagggttacacatgacagagtkggctctgtctatgttgtacttaatattattgtagaaagaaaaattgagtatatcttgtgaaaaatagttccatttgaaagtccatttstttcaaattcaaagaaagaaaacaactaaaatacgtaagtctaaagggcatggttgatttaggattttckagtgggaagactattaaaagagatgcttgctcaagagagtatagactcttctttggaaattggcatgggccacagacctccataggtaatacatttaaaacacaaatgctttttggggtactgtctcccagtactttgtttttgaagatttgtgactacatggtttcagtgctatatctaataaaactggcttcaaaacgcagagcactagcatttycatatgtttcagtaagtctcccagccttcgtgattctagagacaccaatcagttgatgctagctgcagttgctagagattccttcctggaattttgatgtaggcttgtaaggagggaccatacttaacatggaaaattaatgacctgagagcctgtcccaaaagaaatgctccaggcaggagatcttcaacaatagccatctagagtwtcagttatctaggatagaacagtgtataggctggaaagacccagccctttcagtaaggcatgtgagtttgatcactcaccaccatctccagcctcagccttcttggaaggccccagacttaatggtcatttccaaccctctttaaaaacgattcctttgctagagtcggaataaataattgaggcaggcttctccagaatctcattggtgtcagctatggagtcatcaacagatgaaattattccatcaggatagtaaattaaatggcagtcttagagtggagttttcaaggtcttcttacatttgtaacatttgttgtcctacatagtcttcatacaaactataaattgagcatgagagacattcttttttttttttttttttccaagactaacttttgctctgtagcccaggctagagtgcaatggcatgatcttggctcactgcaacctccgcctcccaggttcaagcaattatcctgcctcagcctccygaatagctgagattatatgcatgcaccaccacgcccagctaatttttgtatctttagtggagacagcattttaccgtgttggccaggctggtcttgaactcctgacctccagtgatctgcccaccgcagcctcccaaagtgctgggattacaggcgtgagccactgtgcctggccggcagcaattcttttatatacttggagggtaggcacttgaagcccagaaaggctaaaagactaggacattaagtcatagaggagggtttttttttttttttttagttttgttgttggtcgtgatggtrttattcaattcttttattatctcagaactcatgtcatactgccccagcctctgtatcagcattatgtagcaatgatgttactgagcctgatctctgtaagaggctctgaataaaatgagttccatgctggaacttatgtggagaatctatgttctgtatctctcccttggggactcttaatttcctgggtagtgaagaggtcctctaagaaagaagcagatttcgtggaacccaggatttcccatcctctttttatctgcactgcattttaggagcttttaaatttstgttctggagttgggcatctcttcaaggttaagactcaagggctgtttgtattcctcttggatttgcctacatttagcaaagcagaaactcaacacattgttgaaaatactgaatttcactgggcmtatattttgggttgtctggaagatcccacctattgagtacactgcaccatcacccctccaactgctcatgcacttatcggacatatgttgttatttttggatcagaaaataccatcccagtagaagtaggagtgatcagtgtgacagagagctgtctgtattgcggctgtaaatgccagtgaccatggcattgagcagaccataggttatacttactgtcgtggttctcacctaaagtacacatcacactttgggtttccataggaccaggcaacataatgacccacctgaagatgaaatgattttgaaataccaggcccttatcatgggctagggacagtgtggacattcatatatgtgaatgctccttaaagcttccctataaccttggatactgctggtcacgtgtcccttaaatatagrtgaggaaattacagctctgagacaattgttgttggtcagtatccttttgatcctttgtttgtaaatcttgcccagttggggctgcatgaggttgaaagctcagactgcttcacttccaacctcagctcgtccctttatgaagggaggcagctcaactgtctcccttccaacctcagctcatccctttatgagctcatagccttgggcaaattacttaacctgttggtgttcagtttcctcatatgtgaaatgaaaatgatggtatcatttcctcctaatgctgacttgaggattaaatgagttaacacacataacgcttaggatggtggtggacgtacaaaacactcaataagaatttgcttttgttattattacttgttcacatcyatgcagcatktgtgcctgcatgctcacacmctctagtcttacgcagcttattcaccaacattggttcgggatgacatttgactgtwttcaaaagtcaaatccacttttcatggacaaagattttccttcataagtgttattcaaaagattgtgctgtctgccctgaaaacagttcttatggaggagaccaaaagtatttttggtaaatgacagtctgtgtagagtgagtcatgtcactagatgtgtacttggaagggcaaaacagttatttcaatgtacaaattattgcctcattactttatcacataccagaagagagtttgggatggatctaaraagtataacaaaaccactgcaagttgttctgtcatttagcatttaattaaaaataactagagaaacaactatttgaaatgctcagtgtttttcttctttttttttcatgtaacaatatgtttagtgaatttttcaaattactaaaagcattcaggcagttctagaaatttgcatcttgtaaccctttagttgtttttatttagaatgttggcattttacagtagtgtcaagtatggtaattatttttcatagatattgaatttaaaagagtaatccctaaacacattttgacatttggctctccaagacaaagtttgtaaaaaaattgtgacctgtgaacggtaactttactatatacttgtttgaccattatctaagaaatatgcctttaatgaataagagggaaaaagatgaggtcagacatcaaagtccctgtaattctaatgtgaacaaccatgattcctgaattccatgtaaattagcactacagaatgaaagcaaacaaacaagcaaacctcaaacagagaaacctcaaaattactagagccaattagatattcaaaggaaaagtctcagtttttaataccttataaaatcacacaaatacatacacatatgtgttggcatcagcagttttgatagacatggcttaaaataggagaaatccaaaaatagataaaggcacttttaatatggcctaagccatagcaggaagtattaataacatgccgattttttactccaaaaagaactgagtgtgcaaagcaaaccaagaaagaaatgtggactgggccaactaatgggtttctaatcattgttaatstacaagtgtgatcagtttattataaagtgttaatttttcctgtgggtaatacttggagaaatacagtataccactcatttccaaagtgatgaaatggctttctgtttggcatgcaggaaagtgaacctctttagtttagaatatgggttggatatgcttgccaggtctgggctattccctgctgcctctgagcgaaarctcaggaagccagaacctgaatctcttcgaggaagttctacagctgacttttaatcattgggccatagcacaacacctattagctcgcttacgtctaggtcrgtagaacctcctctggacctcagctactcttcccactctgcatctcgagacacttgccttctttccatgtgacttatcgctaagctcctgactgcatgaacctccttccttccactggtccaagtgacatcaytcccccgtcctcactcccaataccaccacttcagtaacctcccacatgttttcctgctctactttaatccagtctacacagagagagcagccagccactatcctgttttatttatttatttttttacttccttaacagacgtttactggatatgtcctgaatcccagtcactgtgttaggaagtagctcaatccgttgtctgtacacctccatgcatccgttccttcattcaatgatgagtacataggacaggccagttttgttctccaggctggtctcgaactcctgggctcaagcaatccacctgtcttggccttccaaagagatgagattacaggtgtgagccactctgcccagctccagggcaggattaaaggattgttctcccatgttggaagaaaacagagttcaggccccaaggcaactgacattttactgggccagacagtgccttaacaataatagggcaggcgtggtggctcaagcctgtaatcccagcactttgagaggctgaggcgagtggatcacctgaagtcaagagttcgagaccagcctggccaaaatggtgaaacgtcatctctactaataatacaaaaattagccaggcatggtggcgtgcacctgtaaccccagctacttgggaggctgaggcaagagaatcgcttgaacccaggagacagaggttgcagtgagccaagattgtgccactgcactccagcctgggcaacacagcaaaacctccatctcaaaaaaagagaaaaagaaaacaataatataattcaggtagtgaaaacatcccagaaaaaataaaataaaatagagacgatgggaagtaatgggaaggctgtagctagcatggccacggcaggccttcccagcagggcatttgagggagacagaaataaaatgagaggcaagtgacgtgaatatgtgtgagtgtgctctaaccagagaggaagactatggcgaaggccttggtgagtctgagaaatgccaagaaggaaggccaggctagggagtcgtgagcaaggtggcggatgggaaaggtggggacacagaggtagggaagggggatgatcttgtggggccttttatgccacggtaaggaggttggattgtatcagccatgatgttttccttcttcctgtcaaggtgaaatttatatgacgtagaatcactcattttaaggtgaacaattcagtggcatttagcgtatttgcagtgctttgcaatcaccacctctacctagttcaaaacattttcatcaccccaaaaggagagctcatactcattaagcagccgttctgcattcctctacctccagcccttgacatccaccaatactactttctgtctctaaaaatttaccttttttgatattaagaagaaaagacacccacacatatactcaattgtgtccttccctggcttgttaccctccctcctycatcacacttaggctcaaacacaaatttgccaccatcccctcatcatctggtccttttccatttctttagtctaacttcctgctagtcttttcttcactctttaagagtaaaggcccagactcactggttctcctcaagtggtgtgtttgttacaattgatgaacccacattgacacacaattaccaaccaaagatgccatgctttatatcagggttcactcttaatattatgcgctgtatgggttgggataaatgacatgcattcaccatcatagaaactttgaattatgtgaggtagtagatgatgaaacaaacattacatactaggaaagggacgcctctcccttttttttttttaaagaggggtgttttctgcttggttttgtccattataaactgttagattaaccatttgtacagccaatgaaatagctttaagggaggcactcaggagcttgaacaygtccacagaaattccaaggtctctccagtatcaacttgcagtacgtcaagccagtacacatgggagagccttgaaggggtacaagatcagsctcccctctgctctttgaacacactgagcttgtggctgcctcaaagccttcgcaggcattatccctcttgcaaattttttcatgggtagtgcttcctgtcattcagktctcagatcaaacactacctctttaagagctcttcactgcctactttaaggcatcaccctgttttatgttgtttatataatatttcacaacctgacattctctcattcattcattcatatcttacctgtttccctgtagaagtataggcttcatggtgagcaatagccttattttccttgttaacgggtgtatttccagcacttcttacaacactgccaggcatattgcagattgagatagtctgagtcttctgagaactaggattaggattttttttttttttttttgaaacaaggtcttcctctgtctcccaggctggagtgcagtggcgctrtcacagcttattgcagtcttggcctcctggactcaagtaatcctcccacctctcatcctcctgagaagctgggactacaggggttccccactatgcctgggtaatttttgtattttttttttagagattgggttttgccatgttgttcaggctggtctcaaactcctgggctcaagcaatccgcctgccttggccttccaaagagatgggattacaggtgtgagccaaggtgcccagctccaggacaggattaaagtgtgaaaaaattattaggggatatacctgggagatcaaatgaggtgggagttgggagactggaagagctgtcagaccagatgcaggtctgactctcagtaaataagagacgaaagaaagaaagattgagtggaattattttagactgctgtgcaattctttttttttttttttttttttttttttgagacggagtctcactttgtcacccaggctggagtgtagtggtgcagtctcggctcactgcaagctccgcctcccaggttcacagcattctcctgcctcagcctccccagtcgctgggactacaggtgcccgccatcacgcccagctaatttttttgtatttttagtagagatggggtttcatcatgttagccaggatggtctcagtmtcctgacctcgtgatcttcctgcctcggcctcccaaagtgctgggattacaggcatgagccaccgtgccctgccacactgctgtgcaattctaaagaattctgggagtgctgtcagagagtacttgagccaaagtygcccatcaaaaaagttttaaattcacaggagtgggtttgccttagcatagcttttgaactaagtaactggccagcagcagcatgtggaagcatgaccttggcaagaaatgtggccacagatatcagcacacagcagctggggtagctgatcaatgtacttccttcaatgagagatctgtgaggtgcatttccatggccaccacagagatgtataagaaatattagttcaatgaatgaataatgaataaatgaatgaatgaaagaattactccttcatgttatgtttataactggctcttcctccaggttttctgcctcacttttggctctctcagctactttattactgagaatttatctgtactgtctagttttacagcaacgctgggagctgctattatccatccccattttatagatgaggaaaataagcctccagataggttatgcaacttactcaaccaagctcaacaactaataaatgactcagctctgtcttctgaagttgacacttaaagcccatacccttagctattaatgctgtacattgccaatgcaaggtggataaagacgtggagaaatactctgccctgctgagtagagtcctgaaactgcaaggggtggggaaatagcaatgaatcctaggcttaggccaggtaactaagatgtgcctttatgagtttatcttgatcatttctttattcattcatttatcattggccatttattcattgttcactagtcggcaaacatttatcaaactcctttgcatgccagtccatggactaagtgttaatctttatgcctctgatgcttatcatctgcaccgtccaatacagtaagccacgtggagctattgagcacttgaaatacagttggcctcaattgagatgtgttgtgaatataaaacatatacagttctcaaagagtgaataaagaaaaaattatttttaaaatctcatgaatagtttttatactgattacatattaaaatgatagtttttggtcatataatgttaaacgaaacatattgttaaaattaattccacccatttctttttataattattaaggtgacattagacaattaaaaatgaacatggccgggcgtggtggctcattccagtaatctcagcattttgggaggccaaggtgggtggatcacccgagatcaggagtctgagaccagcctggccaacatcgtgaaaccccgtctctactaaaaatacaaaagttagccgggcatgctggcatgtgcctgtaattccggctactcaggaggtggagacaggagaattacttgaacctgggaggcagaggttgcagtgagccaagatctcgccactgccctacagcttgggcgacagattgagactccatctcaaaaaaatgaacatatggttcctattataattctcttgaattatagcactggtctcatggatgatatagatagtggtctaaaagtccagaggtttctgaggtcacagagcccggagcaaatgtctgtggggaatgtttacagaggtgggagatttcacctgggccttgatgagagcactagattttacctgatggatgaagcagggaatggtcttcccagtgaatgatggaagggtggagtagtggagagaaaagcttcatccagttatttggggctggaattctaagtgaagttgtctcaagttgggttttctaggaaacagagtctgagctgcagtttagcatttttatttattaaagtgcttgtttattaaagagtatgcttaacttcactcagtatgtagatatgggcttccctggaaggggcaaaaccttggatgaggcagctctctgcagctgaggtaattcccaagaggaccagcattcagactgtcccccaagatcacactcatcaactaggatgacaagtcctttttgaaggaccatctgaagggtccatcacagtgtccacttcagttgtctagagaaatagagggcacagtgtgccttcctttactgcaagctcagtccacagggtctcacattagctgagtgtgtgggaggaagaccaagtgtctgtgatgtcaggtgggtatttcggagtgtatataaattacagtaagggcagtgtcaaatgagtatgtgtaatgcatctacccatggtccctagagtccactagaagacaatttcttggtgtttaagagattattcttttaataattcattgatcttaacaatacaatacatcaatggtttacgcaaaagccatgttttatctgcaatgcacttctaaattgaaaggtatcataaaatggcacttaactttcagaatccttatgttatctaaagctcagtttcagatttgtttgatgataacgaatatcctgtctattttattatctagtacaagccctagtttcggaactcagaaataaatgaggcaatgcctgcaggtgggtggcacgtgtaggtgcctgtgtgtgtgtgtgtgtttgcgtgttttggagtatgcatggatttggccttatagtttattgagagcatttttgcactggtttatagtcatgcagtgaagcacctctgcatttctcacctggcccatttagtgtggacacattcctttgtcaacaaggacataaagccacaatctcctcctccaaacaaaacaaagtgaatcgctatgtgttcggtataatgggattgagaagtagagttctctttgctgttatttctccataataggcccatgatttcctggcccctggcattcaggatagtgagcatgtgcaagtgattacgagggcagagcagttgccagttttccctgtagctttcagaatgtcatcagaaatctacacgtatgggcagtgaggtctggctctcccatgtctcccctgccccatcttgattgctctctctctctcttgctttctatttcccagaaacatgaacttactttgacttttccaaatataccatgttccttaccacccagtgtccttgcagctgccattccctctgccaagagtgattcttgctgggmcccttttagatcacatctttattcctggtggacagaaagaaccaggacaacaagcccatgcctgtcccaagtatagctgagtgcttgacacttagagaatgtgaataagtgaatgagcacagcataaatgaaataccacaaacaggccaagccaaataaactctgaagttgagttttacttggttattaatgatctttggcacaagagtttcagtgacttgataaggccacaagccaagtgtggcctggttcaagaagtacagggatgatgatacagacaagacagaaaggaaataaattctatcaaaaagctcagctgtcttgaaaaagcaagagataagaaataacttcagaggtgggtagaattgagaaaaggatttctattttgttattttccccgaataaataagccttaaacatgtttgtaagctgctgtgaagtaaccagcagagaggaagtgattgaagatgagagagagaaacagagtaattgatgaaccaacgtccccgaggagacgggagggatgaaatcaagagtataggtcaagaggcgagcctgggagaggccagtgctaaggcaggtgatatttctgcccggccgttagcttttgtgcagaatagtgaaggaagaatcaatcacttcctttctggctgggtaaatgccaagaaattctatggcagaaacttccccaggcaggagactcagaattaattgttaggattaagcataaaccaaaacgagcagggaaatcccaagcactaaatcccaggaatggggccttcatggataaaggaacttcatctgtgaatgatccaggagcccagaatgccaagggaagtttctaggttcttggagatcaagttaatgcccctcataaggttgtttcacatgagccaaaatgtatattgatttttttttttttttgcctttattacacttccagaaagagagcatgatctcctggaatctgtttagggaataaaaatgtccgtacagaagaaaaaggttgttttttgaccttctgctgacactgtcttcttgctctcatcacagcttattttctagcaatatgaggcccacaaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagctaaaacagaaatacttagtgaacaagcaagtgtgtgagtgaatagatcaaagaatgaatgaaactaccctctgcactctaggttctagaaggcaccctgaaaaaggcatgttgcttggggtataataattgctcaatatatttttcagtaaggaataaaagaaccaacaaatattgattggattaaatggattaataactgataaacacttacagggctgcggcatgtgctaggtataatgtattacatagataaaatggatacgaaccatataccaggccctgtgccaattgcctgcatgtaactcaaaacaaaagacaaaggtcttgccctcatggagcctgaagtccagtgagggtttcgttaaacttgtaggacaccatttccatgccttccatcagtagagcagattctctgtgcagatacttttcacacaaacaatgcctaaccatcccagaaaatctgagcggtgttagcaacctcactttctctgagataaagctgagatttcttttagtgacttgtccaaggtcacatagctattacgtggcagagtcaagactcaaacacaagtctgtctcatttcaaaacttgggctgtttgcctatatcaaactgcctttaatttgcccattttaaagcaggaaagaactaaaaggcttgctttgatggatgtgaggtgatttgttaaaagcttaagagactgccatttttcatgatatgcgtaaatgtgccctaacctcctgaagcaatataaagtggttctttatgttcttagggtattccccatctaaggtaaaaattatcaaaactactggggagaaagcttctctggagatttgccttataaaataaacagaaatcaattttgacttgttttctaatcatgataaatgaagccaggttaggagaaaaaaaaaaaaaagtcccagcattagttgaggatcattttgccaggatgcattggtctttgacaagcaattaagaagtcctgtgattgtgcctggcagtgccacagctcagcacactcctgattaattctcattttctttctttcctcgggatttatttactcgtttcacttggaatgtgtttagcttcttaacctcccccacccctcttttctcacgtgcttctttgcttggccccctacaactctacctatacattaatcagtgtcatattcattactgctggtgaaatgccatacaacattggcattcattcatttttgtctcttctgttgagccattcatggtagatttccccawcgaaacctaccatgtttgttttctgtatttcccaccagatgttcttttaaaagccagaagawgtctgccttggtctggttggtataaagagggttcatccaatataaactgccaacagtaggttggaaatactcatcagtatggaaagggcgaagtctgggcaaattggatgggtcttggagaagctctaagagttggaatctacatcatcatctttgtcttcatggctagcaactgttgactcctttctctagttcaggcattctgtctgactcttacattatttctttgaatccttacaacaactctataaagatggtaatggaaaaagacaagatgaccaagattcagagactttaaagcacatgagcagtaagtggtgaaaccacctcaggcctctgcctgttgacttattcataggataacccacagaaacactaattcaaacatggtgtcagaaacagcagcagtaatgaatgcctcaatgaaaaacatttggcccagcaccttggttaggttgagtttgcatggcaaccctattgaatcatgggtttctcagagctgggagctgcaccatgccatctacctgcacctgtcctctttggaggctgggttggtgtttgaccctgtgaagagctttggattgctttgcctacccgcagtggacttgctcacacataagtgggagccctagctcatggtctccaaatttttatcctcatcgtttcttcccacctagttttttcctaattctggcccttcctggccacccaccctgccattatctttctctgacgcttaggacttgaacccttttttcatcctttttgttttattctggtgttttagtcgtgagctaactggaaaatgcttctcacagtttaattgccgtggaaactttctacttggaatcagaccctaacgggttttttccctttccttagggggctgtgcatataggaaaagggaacatatatgttatccctcatgtgttaggggctgtatagtaacaagcctggaataacccttagagcaccttcatagggaaggtagggtttattatccatgtttcgtaaataagagcactgaggttgagagaggtgatgcagattgctgaagtgcctatagctaggaagtggcaagtcacaatggggccccagttctgtctgctctaaagcccagtctgtctgtctgcttctctgtatgtctctctttttctctctccctattcttctggaagtcatagaatcctgtgattctcttccaaactgcttttttttctattaaaattataacccgttattaaaatatttaagcacacaaattaactggtgctaattatgatattttgaatggtaataagcaattagagtgagatttaaagaagaaaaaaacacctgtatataacttggcatcttttgtaataaatacaarcacctaaatataacttggcatcttttgtaataaatacaaacttttgtcaatcatgacttgatctaaccgatatgcctcaggtctgcacagaacggaaatgttttttggaaatcctagtacttcagaaggctttggcatccaaatccattgcaagtagctttctatttagtctctcattttctctctaaagagagattgatatgatgatttttagcttaatttgagagatgttgagttttctccaagacaccctcgttggttcaccttgctctgaatcctttgtcttctcaccctttgtggcaaattgagacgggggaaaactattaggttggggcgaaagtaatttctgtttctgccattacttttgccccaacctaatacctcccagcaaaatgcaggggttgcggagagaaagggagtgatgtatggagagtcagtcatagtacatgtgcaattcaagatacctgggtgggcatagtagtctttcccctggagttctatgtcattgcagcctccyctcccatcacagcataatttaagtgaagcaggtttaacgggtggtcagtatttaccagagccagccttctgcttctggccagctgggtgacttgactagcagaccattactccatgtgggccaccgtttcccatgaatagagtgcgacatttgaactaaatgaacctaggtttstcccatggagtgcagtttctccctaaatgaacctaggtttctcccatggagtgcagtttctccctaaatgaacccaggtttctcccatggagtgcagtttctccctaaatgaacccaggtttcttcaaaattctagaggctctgactctagcagctgcaattggactcttccctagaagcatctcgctgagtctgagaaaggcacgtcaatgattcttcaagggaagtagggggaagcagaggcagtgccattcacaatgagccacggctgctgacagcagttctgtaaccatccggtgtgtttagacgggagaaagagcttgagaatcgcgattatatggatcatctctctctagatggacttcttttatgggagataatactgaggttaagaggttaagcaacttgctcaggtcacgcagcaatttataatataacaagatatttatgagtaaaacatatatgaactaattatatatctgatagtcgtttttaaggaggaagaagttaccataagaaaaagaaaaacaggacttgggtgttataccatgaatcacacgtgtgtgtgtgtgtgtgtgtgtgtgtgtgtgtgtgtaagataattttttcagcaaattaaaaacaaagcctaagaaaaatgagaacttcctgaacaaaaatattcaaaatgatgactaactagaaagtatcagaaaccacattttccttaaccagtactgtctcatacaaatataacataagtcacacaagtaagtttaaattttctagtaggtgcatcaaaaaagcaaaaagaaccaggtaaaattaattttaataatgtactttaacccatatctaaaatgtgacttcattgtgtaatcaatatgataaattattcacatatttgacctttttgtactaagttgttagaatccagtgtgtatttattttgcacttgtggcatgtctcgattaggacgagccacatttcaaatgcttagtaaccacacatggctactggctacagcattgtacagtgtggcaaaagtttctctcctttttctcttttcccaggctctgttgaaatttttctttcagaaaaatatttaaataggatatactctgactttgaaaaaatacacatatgtgtatgtttatataagtatatgaatatatacatgcatatttctatctatctacctgtctaatatctgtcatcgatctatctacctacctacctacctgtacatctatctctctagagatcttctccacaaaagcaaggaaagagaatctctgacactatattttcttaatgaagwtggagaagtttttgcagttctcattatttcatttcaggctttcagatgttcaggagccctttactagaaggttgatagattaataatctccccactaagcttatagcttagcagacctccatggtggccatgatgaggattcctttaacacrtgattkgcccttagtccccatttctctggtgtgagttttcagcttttgttaccacatcaaagctccggcaatttgtgcaggaarccccttgaagcaatcatgaacccacttgtactgtaagagttcttacttccatgtcctaaaagaataataaccacaaaaggatatttccttgctaatggactggggagaatggactgtgacaaaggctggtttctcattgccaggattttaatgaggggactcacctgaaaatgtctagtgcacattaggctcttctaatagtttccgagagctggagtaacagattaccactaactcaaatggcttaaaacaacagaaatgtgttttctcacagttctagtggttagaattccatattcatggtttcggcagggctgtactccctccgaaggctccaggggaggatccttccccaccccttcctagatgctggtggctcctggcagtccttggcattccctgcaggtgcatcttgccaacctctgcttccattgtctcatgacctcctcttctgcctctctgtctgtgtgtcctcatgtgtttttgtaaggacaccagtctttgagtttagagcctaccctaatctaaaatgaccgtaactttgtcacatctgcaaaggccttatttccaaataaggttgcattctgaggttctggrtgaacatggattttggggaggcatcatttaacccagagcaactgtcactaaaattttcctaccaagatcccttactctagtttaattggcctcttattcaaggcctactccataagttattttggaatatagaatttcagaacagaaatgggatctgatgattgcctagttcagtggaaccctttctttaaatggaaatttagtcacagtaaaggacagaaaagaacgcgaaccaaagcttaggtgatatgtttgcaggaggaaggggtggcccacagtgacccccgctgccccctcctctttacccctcactaggctcccggaagacttccagagcatcccaagggctccacaaacccctgtttaatcataatccctttactgtagggattaaaaactactgtttagggagatatagtgaattttcccaagtcacactgcaacttgaatctgaggcttgacccatctatgaaatatccaaactgtcggtccattcatttctgcattaccaacaatggtcagttatatatttttctttgagaagagaaaagcaaaacagtccatgcttgcaattcttttcttcctttttgtaaactatgacagaaaattcatggtgaggccaaagccatgacaacacctgtgttgcctcacattgattttctgtttccaactggaggaagaggttcccggaacagccacttttgagtcaagtgtgtgagkaaggagtctctcttgccaaggactgctgtagatgattcctgcatagccagcgctgtgcagggcctccacttgagtgagyrctctgttcccattctatttctcactagtattttgagtatkttccccccaaagtagagatagtatgtctttgaatgcaaaccatgggctgagccytccaaattacttttaaaaaattagcttcttcaaaaaatttttttccacttccctactgtcttaaatatactggtgcttctgccctaagacctttcaggaaaggtacatgttctacctgatttacaacaataggttattctgggtaaataatatatctgttggatttattgtgcttattattttattggaccacactatccttaacctagagaagaagcttgaggaaaggagctagggtcaggcagaagacaggtatgttttgaaataagaaaggaaaaggaaaacgtctggaaccttgacattccacaggatattgtcccatgaatacaaaaggtgatgggtagctagaacctgagggaggaggtgccttcttttggaattaaaattccagaatgttctggaaagtgccagatgcaakaccaagtaggaccagctagtaatgraaattcctcccatattgacaaggttgatgaacacatggtgggtgcagctcatggaacactgggaggtcaaaagcggtctcagttacctttgtacaatggacatggcaccccaggttaacacaggggccacctgcccagcaggcatgggcatcagatgaaggcattttttaaacaccttatttaacaattcagagtctagatacgagtacattctcattttaaatagttcagaaaaacagatattcccttttcctccttccaaacatattcttcccttagaggcaaccaacattattagtttaatgaatcactttccagacctttctctcacatttaggtacatacaatcacccctcggtatctgtgggggccaaaatccagaaacctctgtgaatamcaaaatctgcagatactcaagtctcttttataatatagtgtaatgtttgcgtaaaacctaggcacattctccctatacggttgacccttgaactacatgggtttgaactgaatggctccacttatccacatgtttttaccaaatggcaaattgaaaatacagtattcataagatataaaacctgcatataaggagggtcactttttcatacacaagggttccacggggctgactgtggggcttgagtatgcatgggtcagggtatatatgtgggggtcctgaaaccaatcttctccatatacagagggacaactatactttaaatcatctctagattacttatgatatgtaatacaatgtaaatactttgtaaatagttgtactgtattttaaaatttgtattatgttttatagttgcattgttatttttattgttttaaacaatattttcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactactatatgaatttttctgaaatttgtgttttaacattttaagttgtttttaactattctttggtacggacattgtattagtctgttctcatgctgctgataaagccatacccgagactgggtaatttataaagaaaatagttttaactgactaacagttccacatggctggggagacctcacagtcatggcggaaggcaaatgaggagcaacgtcacatcttttgtggtggcaggcaagagagctcatgcatgggaactcccatttgtaaaaccaccggatctcatgagatgaggggaacagcatgagaaagacccaaccccatgattcaattacctcccaccgggttcctcccacaacacatgagaattatgggagatctcatcttattcaagatgagatctgggtggggacacagccaaacgatatcagatgtacttcgcatatcatgtatagatgagaaaacaggcatttcttcccaatttttgcccatacacatgtggtggacatttttcatgtgcaccaatatctggtccttttctgcttcctggttacaagaggttttattaataccttccctccctgccttcttggagttagctgtggccatgccactggatctgaccactgaaatgtasttggaagtagtggcatgcgacccttctcagccaaagtatacaattgccggtgttcaattctccacccctctttacgcatcccatcaaatgccgatgtctgagtcatctgtgtccctgggtgtctatgctcatcagaatcctgctgctgacctgcatgcagcatgtggcacaggcaagaattaaacccttgttgtttgacatcatgcagactttggaactacttgtcatcactacataatccagcctattctggccgatactcatagctatgagcagccttgtacatgcttctctctgcacctgtgatgacatttctccagtaatgaatgtctattgaaaagttaaaacattaaattgcttttaaagtaccttcttatccctccagcccctaccttttgtccctaggctcctctgcatctgttgactttagattttttttgtattatttattcatgttttattagataaatatcttccccagacaaaccttgaactccctggagtcaaccgattcccttgcccaagcctctggtgttagtgattgtttcattaaactctagtctcaaggctaatccttgttggaaaattcgttctgtcctataagaaggctcccaggctcctagtctcaaaccactaaacaggccgcacaggtgtttagtggtacttattggtggccatgtgacattgttatttctctttgcatatttctcatatgattcacagtgtttaaaaggattacctttttggttttggaggtgcagatttagagaatgggatttccaaagccatattgtccctttcagagcacagtgagggtgttctttcttacccagagggtcaacagtgccacaggcttgccagtggatgagtttaatcaactctgactgtgtggccagtgagcaaagaacatgacaggggtttctttgaggtgagcaatgccctccgccagaacctagaagtagggtaatgatgctgaggttggtgtacactcagaactcagtactgccgcagagtaaggcagacccatcccacctgggctgtagctcccacgatggtgagtccctagatcgtaagttgatgggaagcataagaaggtcagaaccaaaccagagctttgagcgttctctcactgcattccatagtttccccgagcgctgaaattctttgcaacttccattcatttgcacatctcatctggctgtaaggcataatgtggtctgtgtgaaaaagaaacttctgcaaaagagtcagattcagagtttatggcaacatcaaggaatagtttatcagttcagctgagtataaccacttgatttagcacttccttttcatcatgcctctcccctcatcacaaaactgcaaaggctccctgtgacatccaaagcctctttgtctttccctgtttaggaaaaagtgacctagagggaactctgcaggggctacatacggaatcttgatgttgcctcctgcctgctgtactgtcctggttaaatccttcctcttctctaactctgtgtctccatctgtaaaatggggatggtaatagagcctatcctgcaggataattgtcaggattaaaagagttaacccaaaacagataataaggggttctgaagatccaccaggagcctcactcagacaccttgatgcagacagcacctggtaaacatgggtgttcagaagtatggtccttcccttacggccccttactcaatggccatccattgtctgctgagcctaggtccctcacacctatgccccaggctcctgtcctggaatcctggcttttaccaccaaattccccaaaagccccgtgagtggctgttttgagctgagggcacctgctcctactggcttcctggagccttagacgcacccagtgctctggacctcccacaccttgttgaaccacccggcacttsctgactcctctcctgaacctcatgtgcttgtgacccacgattcagccactgtctaaccagctcttccgtgtgcagccctcagagccccagctcccacggctctaattccacggccgcccctgccgtctcytcagccatcccatcccgccatcaccatggaaacctgtgggaacagcagcttttcctcatcctcttctccccttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagccagctaaatatcctttcctgctccattctaaacctttatgggtctccacaataaccagtaactccatggttgtagagttcagataatcatgacataaatgtaggaatgaaggcaaacaggccggcccttcccccagatgactggggtcttcccagctggtgtaaaaccctcttctaggtcaaaacatttcttaaagtaaatgagtgatgactatgacaggtgggaaagtacataaaataatgtgattgaaatactcttagttggttctgctccattgaccctagggaggaagaaacaactaatttgtgctttctgttattgcattgaaagagagtggtgactcgccgggckcggtggctcacgcctgtaatcccagcactttgggaggccgaggtgggcggatcacgaggtcaggagatcgaaaccatcctggctaatacggtgaaaccccgtctctactaaaaatacaaaatattagctgggcgtggtggcgggcacctgtagtcccagctacttgggaggctgaggcaggagaatggcgtgaacccgggaggcggagcttgcagtgagccgagatcacgccactgcactccagcctgggtgacagagcgagactgtgactaaaaaaaaaaaaaaaagagtggtgcttcaaaattgtgtctttttcaacgtttgttgtctctacatggtaaaatctgaatttaggcctaattcaaaatccatgagattgggaatgggattgggaatctcattatttgcattaatgtatgagactctctgagtaagtgttggtttaagtaaatttttttcttaaaaaactcagtagaaatggaactcagattttaaaatggactttaaaatggtctaaaaagtgtttctaggtacaaaatgaattggastttacctattttttccaaagsgcaggtagcaggtctgaagtgagagagggaaacgttcgatgctgcgttgttctgggagatgtgagccgccggctcattcagaatgtgcagggatgtccattcccacaggrgcatgtgtcgttcagccaggtgcatgttttaccttgatctactgtgcttggagccttttctttcccagatctaggtctgatacctgcccctcctccttaccctggactgtaattaaagggaatatgtggaaatccaggccacaactattttacyttctgtgaataaggccatcaagttgatggcttgttactgtgggtcgatgggtcaaacatgaggcaatttggggaaacagcctaaggtggctataccacagaggccagcagagcaggtaaccaggcacaagatgygatcgctgacgagagagctgctgtgacagagtaaggagtgcatggggaggagggaccactgaggtttgtctgcgtgtgggtaccccatgcgcagatcctcaacagccgttccaaggaagtagtcatttgggagatgaagggggtgcaggtagaggagtgggggattgagacagggaggggaagccacctagctagtgaggtttgtgtagcaagaaggtaaccactcggagcacctggagtttaatccttaaggagactgctgagaaacagagtggtgcacacttagggttattttactgagaggcaggagatgtagacagcgctgggggatgtagacaccacttgttaaaatctggcagaagagaatttagagaagaaaggtattgctgtgtggtaagagcaatgacttggtcaggatgagggtgggcatggagctctgaggaagggacgtacagaaaccaggacagaactctagccattatctcctttcttctagcgatctgacaaggtcctgctagatccttcactagactctagggcaggcttctacttagtacaactgataccaccgccatgcagccatcatggcccctcccagggcccatttgttagtaataataataataatgcttaagaagcattgagtcctaactgtgtgtcctataaactatcataacccgtatagtcttcataaagatgccttcaaggagacactcttattatccccattttacagggagaaaaaaatgagcctacgttcagcaattttaagcaaattttctattgtckcatgactagtaaatagtggaataggccagttttgttttttcaccttgactgactgcaaatgtctcagtcatgattcctgaccatcttctaaccctctaaggacccagacactcctaagtagttaaagagtctgacgttatcaatcaatggaaatattttcaaaaggtaaagagaaaagaaattaaagttatgatgatcttttaaggcaaatcctgctttcttgaagcttggtcagccctggcacaggcaaaagtgcatgtcatttcaaggcatggggcaggtgaaatggaacacggctgtcctggcgtccacaactcacaggagagtggagaatgtggaagttacatgctccatttagacatcagtgttctctactacaaaatcgtttctgcagttcattaatcagactctccaaatttgtttaactcattatttataacagcattaaatccagtgacaccaaacggtgtcaccatgagtatcaggaagtctgattttaatcctcagaaaatgtgttcaatgtctttccctccctcctccacacttaacagggacagtgaatggaagccagtgttaaatttgcacgatgtgcagtggtctaaactttcactgaatcctartcaacttaatatcctgttgcctttttgaaatccagtgatgaaatgtaaccctgagacagcttaaacagaactcaagcctggatgctctctgcaaaatggtctaatttggtggttatagcgctagtattgtatgtacaatgatcaaatcctgtgttttcaattgtcctttttatggtcaatcaaggcggtcttaggatatagatttaatatcgcaagagtctaatgtaacaggctaatgcatgccctccagttacagggagaatgtctttttgtgacagtggttctctgggtacgtcttacaggcttctatttttgaacttgactccaagggccaaagcagcacattttggaaatggttttgtaaactgtaacgaaggtatctttcttcagcagcttcctgcccaaagacgccagagtgctttacaaacttatcaaagtgatatacagggatcgttttagcctctgctgaaatacaggggcccaggggggaaattacagtcattgktgaaaaatcttagattgtcaggtcgacaggaggagggagagtgtacagcacctaaaatatcctcccaaactggatggcatgtcccaagggctgtggtcttatctactgcctgctgcaggtgacgtttgtgaaaggggtcctgtgagttttgatgattgtctctcttagacatgctggtaatacagctccttgtaaagctgattcttcccttggatttgctcatctcatatcagagactttaaggtaccctctgrcatacaccctctacaaaataggcatgttgcattttttggcatactagaccatcagaaggggaactgctatatcacagcctctggaatcctggctaactacagggaagagatgtctgaattatagcagaacatgaaagaaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaataaataaataaagtaaaaataaaaaggaagaccttgataaatgccatgatagatacattctcataaagcccagtagcatattcgggaggtttatgagaacatatcaataatttttatgtttgttaaaatattttaaacaatatttttatgtttgttaaaatatttagttgtagtttatcttaattttaattttgaagtaacagagcaggagacctaaaaaatattccctactaggagatagttgtggaatatatagcatttgtatttctacatttttatgtgacacatttaggtgttccttaaataaaatgaarttgaccaaagttctggttagtatgtagcaaactaaaattatgtgaaaatatccaaagccttaacagagctaggatattcccgcatccacactcacacagctactcactgtaaaagtgatcgttgacaaacataaggaggcaaataaaagggcatagcctttgtcttttaaaccactgtgacaggaaaagttatggggagtgggtcagtgaggaaggaagtctgaacattgctgcattcaacagagaaagtaaatgaaaggaagacgcttacaaataagagagaagaaaggaccgcattaactctaaagaaggggctagcaggtcctgtggagccgatggggcagtgcaaaagcctgaccatgctgrtctccattgggtgggtccaatggaagaacgctcagggttacgtcaggaaggtgccctagttttggggaaagaacatttcaactcaggttcagaggaaaatttagatatgttaaaactttagataagttaatagacagggcagaaatgaaagaaagaaagattcttcacagggaagtcctggctatctaactgtgaaaacctgaaagatagttgagaaaggcaagagaggcaagaaggagtggaaatgagggggattcagtgagacatacgcaaagaaagggagagaataaaatgatacattcaaagaagcgtattgtgacaaaatgtgaacttctctaataaactcagtttaaaagagaacatataggccaggtaccatggctcacgcctgtaatcccagcactttgggaggctgaggcaggcggatcatttgaggtcaggagtttaagaccagcctgaccaacatggtgaaacctcggctctactaaaaacacccaaaaaattagccaggcttggtggctggcgcctgttatctcagatacttgggaggctgaggcgggagaattgcttgaacccaggacgcagaggttgcagtgagccgagatctcactactgcactccagcctgggcaacagagagagactccatgtcaaaaaaaaaaaaaaaaaaggcatgtaaagtaaatggatgcacatgtgaggagcagcatccatgacccatcacaagtgtatgggatcctaaagcttcctgacaattgcaaatgttaaataagccaaagatcacaaaaagaggtttgttttggcagttgtgcacaaacctgctgcgaggcagctggtgccctggtaaaaggtggcagagcaaatgcagaaccacacaggtgccgggtacctcctttctgtggtcaaagaaaataatcatcaccctgcaaaagggttggacaaatataaataggagaaaattgaaatccaagatagttgagaagattataagtgtatcctactgatttaaacgagttcacacctatgaaactagatgaattatttctcacagaagacmcggagaaaatggtgattagaatctctgcaccagtttctgtgatttttttgasacatcmtgaagatgagaggtgagtagacagcagatgggcagggccagcatggtttttgtctggttatttatttctgtggaataagttcctagaaataggatgtctctctgggtcaaaaggtatgyacactttcacttttttttttttttttttttgagacatagtgtcactctgtcacccaggctggagtgcaatggcactatctccgatccctggaacttctgcctcccaggttcaagcgctcctcctgcctcagcttccccagtagctgggattacaggtacccactgccacgcctggctaatttttgtatttttagtagagacagggtttcaacgtgttggccaggctggtcttgaattcctgacctcaggtgatctgcctacctcaaccccccgacaaaatgctgctattatgggtgtgagcccctacgcctggcccacactgtaacttttgatacatattgactaattgctcctctccagagtttgtacccaaattataaagccacccagagtatattagaggaccatttattatacctgtttgataaaactatgcatttttatcaaccaaatttttaaaaattaatgtggctttattgctcataaggtttaacttttttcatgtatttattggccatttacatttctttagtaaaatacaagtaatgttccttagtacatttttctgtttggctttttgttttatagtactcatagtaattgatatgacaagaatatcaattttttgttggcctatatattccaaatgtgttttttaaatgttatatttcaatcttactttttacatctttgtcatatggcatctttactttttaaactgttattttagattcaggagaatatatgcaggttagttatataggtaaactcatgtcatagagatttgttgtacagattatgtgatcagcctcgtactaagcctagtatccaatagttatttttttctgatcctctttctcctcccaccctccaccctcaaataggtcccagtgtctgttgtttcccctttgtgtccatgtattctcatcatttagctccaacttataagtgagaacttgtggtatttggttttctgttcttgtgttagcttgctaaggatgatggcctccagctccatctgtgttcctgaaaaggtcatgatcttgttcttttctatggctgcataatactccacagtgtacttgtaccacattttctttatccagctcaccattgatgggcatttagtttgattccatgtttattgtgaatagtgctatagtgaacatatgtgtgcatgtggccaacattttaaaagaaatggagaaggtaagttctggaaactggtagcagaacttaagccgcggtataattctgaacaggtccatctgttcgtcatcattcatctactctaaatccatgcatctctgttcattcagcaaatattgattatgtgcagtgtgctaggcattaggaaatatgctagaaaacaaacagaaataatagtccttgccttattgaaacttagagtcaaatgaggggaattattaaacacgttttgtgaattttaagagggcaatagtgagatttgtttgatagaaagagtaatatcgagatcaaaatgtgtgtgggtggggtcacgatctttgtgttagtcagggcctttgctactgcaagtgccagaaacttaaatcaaagtggctgaagcaaaagaacactgcatgcctcatgtatgcgagaagtccatgaatagggctgscttcaggcctggctgggtgtataaattcagatggcaccctccaccaggacttcgtcttcatctctttgcttggcttttgtctgtgttggctccattccccatgcgtcaccccttcccaaacctcttacatgtttttattttcccataagttctcccctcataatgcaaaggtagttgccagcagctccaggctcacatccatccttcagagaaactccartggaaagagtctaacacagttcaaaccaaagcacaggatgaagttcacttaaatgaatatgggtcctgtgctcgtccatgaatcagtgatgtggccaacaaagacaacatacactggtgatcatgacctgggtcaaagtcaaatgcccctcctacaactaggaatggagtcaccccatctgtaaacagactgagagtctgtgggaacaaggcagtttcctatggaaaagaaaagaatgctgtctggtgaggctgtctccactgcaggccccactgtggatggtgctggtcagagactatcaggggtattaggatccattttttaatcttatattctctctcacacactctcttttttccccctctcttggcttgatttcactagttagagccttctttacaaaatcagacagaagggttaagaatggacatcattgccttgtttctgatgttaagtggaaagtatttcatctattaaacatttataccactaagtatgatgctccctgaaggcttttcagatgtgctctttatcatattgagtgagccccattcaatttcaaatttgttaaaaatcttttatcatgaataagtgttagattttatcaaattttttttctgcatcttttgagatgattgttgtttttgtcctctagtctattaattaagcttattgtattaattgattcttgaatattaaaccaaccttgcatacctttaataaagcctagttggttattttccttgaggtgtacaatccttttgataagttgtattagttttctgtggctgctgtaacagattaccataaatttggtggcttaaaacaagaaatttattttcttacagttctggagcccagaagtccaaaatcggcatcagtgggtggaattaagtgctggcagagctacactctctccagaagctctcggggagcttcatttcttgcttcttccagcttctggtggcagctggcattcctttgcttgtagtcacatcactttgatcctcaaggccactatcttcaagtatcccttttctctggtgtcacattgccttctctatctctcatagaatctccttctcaattccatttataagaaaacagtgctggcatttagggaccacctgaataacctaggatcatctccccatcctaaaatatttaattcaatcacatatgcacagacatttttttccaattcaggtagtatttacaggttgcagggstcaggatctgacatctttgggacccattatcagtctactaactatgttattaaatatagcttgcaaatatkttgtygaggattttgtttttatattcctgagagatattggtctttttttctttwgatatctttaaatggctttggtagtaatgtaataatgtaatagtggcctcatagaatgagttgggaagtgttctctcctcctatattttttgggagagtttgtaaaatactggtattatttcctctttaaatgcttgataaaacttacctgtaaatctatctgggtctgagcttttctttgcagaaatattctaaattactgattcaatttattattattattatttgtttttaactgttttctgctattaagatttttaatttcttcttgaaccagtttggtaatttgtgtcattctagaaatgttttctatttcatctaaatagtctaactgttggcataaaattattcatagcatttccttataatcatttaaatttctgtaagatcagtggtggtatgccctttgttatttattaatttggygatctgtgtcttctctcttttatcttggttagtttaggtaagatttgtcaattttgttgacattttcaaagagcaaatttttggtcttattgattttctctratgcatttgtaccttttttgtrtacttcaaagaagccattggcaaattaaatatgactggacaacttttcacataagtaactaggaaaggtwaggaaagacacagaatataattcaagtccctgaaggcctgtattacagaagaagacataggcagattctttcacatgccagggagtagaactcagattagtgtatagaagtttcgaagaagcaaacatgagtgttgttgcccccatcctagaacacagactctagaatcaatcagatttagaccctaattctggccytgcccctcttcttgttgtatgtattaattaaggtaatgtatgctgctataacaggtatgccttcaaaactcaggatcttaacaagttggtacttatttcctgctctggagagaaaagctcacagagaagaattttatgacccatgcctgaaagtgagaattctacttatgtgcacattctgttgactagacctaagggaggctagaaaattagtcaaatcatgtgcccgagaggaaaataaaatctctttggtgagccactagctagtctgtgccacactgtataacctggggtttaactactttttgagcttctgattccttaaatgtgagaagggtatacaggcctaccttgttgatattgaggatttgattccagacaacggcaatcaaggaaatattgcaataaagcaagtcacacatattttttgtatcccagtgaatatgagtcatatttatactgtagtctcttaagtgtgcaatagcatcatgtattttagaaagtatataccttaaagaacattttattgcaaaaaaaatgttgacatagagactcaaagaacacatgttttaggaaaaatggcgccaatagacytgctcaatgcagggttgccacgaagctgcaatttgtaaaaactgcaatatctgtgaaatgcaataaagggaagcataataaaaggaagtatgcctgtaataatttctgtcacatgggtgtgtccatactgctcagtatctggcacaaggtgggaatttgatgaacatttgttccatgagtgaagygagtttaaggactggtgtgcatggtatgctcagaactacatttggtttatagtaagggttcagtacataagcatatttactgctgttattgttcttaagactttagagaggaataaagccagacaagaacattttaagctgaagtttgaagagtgaagtttccatctctaaaagttttcaggcaaaggccaactcttagggaggtcacagagtcctacttttgtactctgaggctatggaatctagtggggcatcagacaaaccatagtttcatttactatcttgtaacttcaaggaagccactttactttcctgagtctgtttccttggatccaraaacctacttagtaggatagccatgaaaattcagtgagataaatcatatgaaaccagaacacagctgatacatgcagtgaagcggctcttaaatatgtgcttctttcctcttacttcgcttcctctttattttttcctggtctatgatacagaaaatcgtctgaattaattgcatttgaaacgaacattggttgtaatttaagataaagagaaaattcctaggttgggaattgggatcctggttctgcattttcccagcccttcctctctgcaaatgatcacagaattacatagtctggaccccaaaagcaatatcttctgttacttaggattcaaggcacacatgtttgtaacaattggcttctcaaaacttgtaagaactactgatgggtaaacaagtcatgaatcagttttttatattcaatcaaagttgatggagattacccaattaaataactggtatataactagtttccctatttccttttccctgtttcatagaaaaactagttatacattgcttttctgtaagaaggtggtaaatgtaaattgagaagctcgaggttagcaaaacagaagataatgatcaaaggactccatgtctatgtggttgctttatgataatgctgaatagcagccttgttcatgcagagacaatataaaagccttyccccaacttctccccctcctccaattcgtaaaagtcaacrtaatgttaaaacaaaacaagaagtttagaattaggatgaaacccatctagtaatacagtaatgtcaggaggacaatatcaaaacaaatatttatttactcaggtggtggttgcggttttcgggctttttctcagctgcggtgcatttgtggcttttatttstgcactgccgcttgttacttggagccattacttcctatctgtgttktcaatcgtgtcttgaggttattctagcaccttacraaaagccaccatccacctaattttagagcttttaagataaagcccgggagcactaggaaggtgrgtgagttaccgttatcaatctggaatgtgaggtttccagtgcagtagcaccacctcttctaggtcaccatggccagcccttctcagaatacagaatgatgtaataaataatgcctgtgtgaagtgaaagctttgagcaatggaaccagctaacatctagaattttattaggcacaaactttctcagatgttctcagtgctattattaccccctcgttaaagctggtaattcttgtttttaaagcactttggagacactcattgatacatgcctgaaaaaaaaatagatgtttattttttccttaaaaacttcgcatgagactttagaaccgtatacgaataatactctgattactgaagtgggtggattttccagtctttatttttcttccattaatcatcttaagagatccaaactttccctgccatgaaatgccagacttcatgctgcaagattcccctagttgaggggaagggcagagccaaccagagcccctggccctctgtcaggggctgcctcctttagctctcagtaataccatcagctcctggcctccttatcaaagagggaggaggtgacataaaattagagaaatggcccagagaggtggcccctcagagcacccctagctggtgtttaaaggggagcagttatgacgttgttactgcagataattgccagttgagtgtggaggccctgtgttgccagtcccacccactgatcaggaaaagctggtaatcagccatggcatttgtatgctgggaaggaagaacaatgggctacaccagctttatgtcaatcagcattgccctgacatcccctatcagacttctgcttaaatctttttggctagaacaggtcatgcactagctgcagaggaggttgacaaagtgagtattcgtgtccccagccattgtggcagatgaagatcaggggaaggtttttaggaatgggtatggcatggccaacctgaacactgcctaccaacatgtagacatgatattggctgggtattaaaggaaacaaacatgtcagacagccagaaatggcccacagcccatgaatttaaaacctctacctaagagcagcccattsctagctctcgcaccctctctgcccttgacctcaataatataccatatcttgattcactggctccaggtctcctaccaccraggacttgccttamtttttttttgttgttttctccatggagtccatctgttggaacattctgtctacaaactccttttgttaggtaataatgagttttcccattttaaaaaattcagcaaagactagcagagctgccaaccagagcctctgatcaacacaggataaccagcaggagagttggtggaattccagacagtggtaagaaaaaaaataaaaataaaaaagacattttaattagtctgtgcagctttatcttgcataaatggatacattccactaggccagggattcctaactttttctataaaggtccaggtagtaaacattttagactttacaggccacagggtctttgttgcaactattacttcttgccattagtgtgcaaaagcaccctagacaatatttaaaatgaatggacatgacagtgttccagtaaaacgttatttccaaaaaaaaaaaagaaaaaaaaaggccagaagaccattgttttgcagayctcttgcatgaggcttttaaaggtattaaaacattttcgcacccctgtgcctgttttcctgaaagtttagagatcctgagttggaacactgatttgcattataaaccttgccctgaacaattctcagcctgtccagattgctaagttctgcatgacattcttagtaatgatgtccccactttcttccctctgctctgaagctcattcttgttgagcttgatggcattttaggcttgactttctctagaagtcttcactagattcctagaagagggaggcacagaagctcacaagctctaggyacaaaagccttgaagctttcgagaagacagataagccaggaagtgattctagctctgctgtatatctgtgtaaccatagttattcacccaacctctgagcagtgtgaggcatggacaggaggacttcaaccaaactggggttttcatctcagccatgttcatccaggggtatcattggtccattagtgatgaagatgttgtattaatactttactatgtgttttattccagtgtccggttataattgtataagaaaccatcataaacttaccatcttaaagcaataacaatcatttgttttactcacaaatgtgtcatttgtgagggctcaatggggactattcatctctgtttttcacggtgtcagttagggtagcttgaaggctggggtaactcaatagctggaggttgggctcctttattcattccttaatgtgcttggtggttgattctggctgttggccrcagtatccacacatggcctctccacgtggctgcttgggcttcctcacaggatggtagstggtgccaagagtgagcatcccaagggaacaaggtagaaatgagtgatattttatgactgaggcttgactttaccatattttatagcagttggggcagtcatagattcccctgaggtcaaggagacagaaaataaactcctactcacggagagtcatgtcaccattaccttgcatcgtgagcatgagagatgtaatatgatggctattttgggaaaattcagtctcccatacagaatataacttgagctattttcagcccatgttttaccatcttcataatgccttatagttgaagtaatataaggatacctcacgtgagtagaggctgcgggtatttagaagacccaaaacagatgttaaatgttcatatgtgccattttctcttcctataactatttttcttcttctttctctgggaaactccagcttacattttacttttcggcctagaaactgttcctcaagaactcttccctagtaagtgatcccatagaacgccatgtttccccatcatattcctcatcacactgtaytgtcattgccagcttatgactttggtcgtgagtgataacaggtaaggaaccatgcctgtgttactcaccgctcagtcctcagcccaggcaccctgcctaacacacagccgatcatcaacaatgtacttattgagtgaatgagtgaccagtgctaatgagttactgaatattgagagaattggttggtacttcataaacaattcttgaacccttcttaaatagcagtcattgtattagatattggggctataagacatggtctagttggggagatatatggttctaataataatttacatttagtagctatgtttttgctgtgtatctctcatgcttttcatgcattgtgatggggatggtgacatgcctctcagcgagagtagcagattgttttatttcagaactatgatcataccatttgtactatttggtcatttttctccattcaataatataaagtaggcagtcgtgtatgtgtgtgtgtgtgtgtgtgtgtgtgtgkatgcgtgtgtaatccacataaggctttttgatgactgcatattatttctcatcattgctgtcttctaattcatttgaccagtcctgtaattgatgggcatccaggttgcctctaggttttcacttcttataagcattgcataaatgatatttcttcatgtggacccattgcatgtggcattgaattatagaaatgatactgttgaattgaagataggcccaattaaaattttgacacagaccattaactgtcacacagatttatattgccaccaggagcatttgaaagtgttctattcaattccacacaccagggrtactatcatccttactcaatatctgccaatcctttgggcaacatagaatattctactgttgttttcatttgcatttctcttaagaccttatctggagaattatgttttttcaacataaataaataagaattgtccaaggtaagagttgtrtaggctctgtaaaaactccccaagtttcagtaatttacagatttgaatggataaacatccttattgttcttaaatactaaagtaagagcagatgtaagaagagcttacactttttattatatctgacattcaatgggaaaccactggaaaggttggagattggggtgaccagtgtttctgagatgaasygaaaacacttagcctcttttcttcttatgtccattcttctgtgtattgataaagcctccatttttctgacattggaatgggaagagatgtttcagtctcagtctaggttcaatattaccaaagtgcataacattatattcaatttttgcctggcactttctaagagatctctgatttgtagttgtagtgatgactttcataatctatttttggaaccattgtttgtattttttaaatgattagatcacctttaaaaaatatgctatcattccaatcaggttgataccatttgtttttaattgttcactaaagtatagcatatatcatagaaggaatgtttgtgctccccagaattcatattttgaaacctagcttccaatgtgatggtgtctggaggtagggctttcatgaggtggtaaaatcattaggactttacwctcaggatattatgagattagtgtctttataaaagagaccccagtgaactcgctcgtccttttctactacatgaggacacaatgaaaagacagccattgcctgtaatcccagcactttgggaggctgaggcggggtggatcacaaggtcaggagatcgagaccatcctggctagatggtctagccaggtgaaaccccgtctctactaaaaatacaaaaaaattagctgsgcatggtagtgggcgcctgtagtcccagcgactcgggaggctgaagcaggagaatggcatgaactcgggaggcggagcttgcagtgagcaaacgtcacgccactgcactccagcttgggggacagagtgagactccatctcaaaaaaaaaaaaaaaaaaaagaagacagccgttgatgaacctgaaaagaagccctcacagacaccaaacttgctggtgccttgatcttgtacttccacctccagagctataagaaataaatttctgctgttaaaaagccacccagtcaatcatatcctgttacagcatcccgaagagaccaagaaacatacctgtagaaaggagtagtcataacaaatctatagattgattagttttcacaaaccaaacacatacacataacaacactcagagaaacagagttatgactggccaccggaagccccatgccctctcagtcatattccacaagggaaatcactatcatgacttctaataaaatgcattagtttgtctctttttttttttttttttttttttgagatagagtcttactctgttgcccaggctggagtgtattggtgcaatctcagctcactacaacctctgcctcccaatataacctttgtatttttaagagagatggcattttgccagttggctaggctggtctcgaactcctggccttaagagattcacctgcctctgcctcccaaactgctgggattacaagcatgagccgctacgtccggcctgttctttatgtaaatggaatcatagagagtgtactcttgtgtgtctgtatgggactctctctttttgaatactgtaatagatcaacagctaacatttaacagagatgcaccaggtacttttctaagcactttatatatgttatattaaacataggtgtcttaactatggattatatgggaatgttttaactttttyttgaagtaactttatggtttgtatacggatgccaaatatagatacatatctaatttatctattttmtttttttagaaataatttcttagaattaggaacctcttcagagccataattgcaaaaagagctccccgtcagctctctttgcagtcgaggtttgtaattattcttaaaaagaaaacatattaagatgttcttaggactctgagtagttatgccctcagataaatgatattaaactaagcacttaaaattaaagctataaagcattggtgatgcccagatatatcagtactccagttcaccctaggtgagaagggcagtggggattaatagccccctctgtccatttcctttttaggaaatgatgacctatcagagaggacataaatcactcctcttcccaaattagattaaaatcctgagctttaaaacttgcttttacctgcagactctaatgttmgactygtggctttgtcatttccccacaggggcagcttccgctggttttacaggacagaaaagttctgtttctattactgaagaggttgaamcctctgctgaagctaattccaaacaaagtaggcaccatatcttctttcaaaagatcccttagggaataattgcaaagagatgctgtgattaggtaattacatgtgtgactctgcccaagaaacctgctttctacctaatttatactttgatttccctctctcgtgtcaaaaagcatatctagccttatttatctgactaccctgcacagaattttctcatcatgtaattgaaggtcactagaaaataatacttttttgaaagcgtgtctgataacaaacaaacaaaaaatggttagaatcactgctaaatatgaataattctattttccaatgctaaaaatgcacatctgttccagaaagacttggactcacatcctacttttcaaaatgcttcagccattcaacccttgatgctatgggcataaatgaagtctagaagttctataagcagtggggaagctagaattggaccttgaggtcccccccttttttttttttttgatgtttgttaggaattaagatggccttaggtattagtctgttttcatgctgctgataaagacatacctgagactgggtaatttataaagaaaaagaagtttaatggactcacagttccatgtggctggggaggcctcacaatcatggcagaaggcaaaggcatgacttacatggcagcagacaagagagaaaatgagagccaaatgaaaggaggaaccccttatagaaacatcagatctcatgagacttatttactaccaagagaacagtatggaggaaaccatccccatgattcattatttcccayatggtcccacctacaacatgtgggaattatgggagctacaattcaagatgagatttgggtgaggacacagccaaaccatrtcaccttacaagttccatgtctagtacagagcttgaccctaagtggatgttcagaaagcatcttcagaatgaaaaggggggcacagttaagacctctggtaaattgtacgatagcttgtggggggaaaatcactgtagttagtgggaagaatgtggcttctttgcttaggacagttgtggatttactggctgaaggaatcactcacagaagtcattctacattagtggtcaaaagcatatgcttttgagtcatatagatgtaggcaaatcattttaaagattgttgctatatttttagtataagtgtgtcctgcccaacattgacacacacttattctaaaaaattgtttatctgagattcaaatgtagctgggcaccttattattgtatttgtttgtttgctttgaaatcctaactcagtcccactagtcccatttttgtaatgtttagctttcaggcaacaaccgctgaagaggtaaagagattatttttsaagagtcatgtgattttggctgctcctagctgacctactagagaaaaatcttaacattttccacaaacttttccattaaaatagaggataggtcattgctaaagaactggcagagcttcccaagacaaaacttgtggatagagtggaaactatgatctagcccgtccagtgaggtagactcaagatcaggtacataaactttactgaaaaaatgtgttttttctcatgggacgtatttacttgaggaagtatttaatcccttagcatagacctttaggttttcaatgaaaatatgatgagttgaaacatttgatatgctgatggcattctgactgatacttttcataacaaattcagaagtgaaaaataatttggtatgctgaaatggtggcctaaagtgtgaacgattaacttaataggaacaaatgtaagattccgtacttgwttctaaacaatgaactttactagtagagaagttgactagtagagaatgaagtttactagtagagaaattgggaagccatgatttagtagaggcataaatgaaagcaagggttagcattttaatttaattttaatatcagtatattgacttaccaatttcatatttttttatatttttatgacatatctttgagaaaggggtttgcatgaatctttaggaaggctgaatcaaatgattcagggttgggggagtgatattggcagttacatgttgtattagtccattctcatgcagccatgaagacatacttcagactgggtcatttataaagaaaagaggttttaattgattcatggttttgcatggctggtgaggcctcaggaaagttacagtatggccgaaggggaagcaaatatgtccttcacatggcagcaggagagagaagtgcagagcaaaggggagaaaagccccctataaaactatcagattttgggagaactcattcactatcatgagaacagcatggggagactgccctcatgatccaatcaccactcatgaggtccctcccccaacacgtggggattacaattcagattaccattcaagatgagatttgggtggggacacagaaccagaccatagcattctgccacttgcccctctcaaatctcatgtttctcacatttcaaaacaaaattatgccttcccaacagtttcccaaagtcgtaactcattttggcattaacccaaaagtccaagtccatagtctgatttgagacaaggcaagtcccttccacctatgagcctgtaaaatcaaaagcaagttaggtacttcctagatacaatggagatacaggcattgggtaaatatgctcattccaaatgggaaaaactggccaaaacataggggctacaggatccgggcaagtctgaaatccaacaaggcagtaattaactcttaaagctccaaaataatctcctttgactctgtgtctcacatccaggtcacattgatgcaggaagtgtgttcccatggccttgggcagctttgtccctgtggctttgcagggtacagccctcctcctggctgctttcawgggctggcagtgtctatgacttttccaggtgctctgtgcaagctgtccatggatctaccatcctggggtctggaggacagtggcccttttctcacagctcaactaggcagtgccccagtggggactatgtgtggtggctctgatcccacattccccttctgcacttccctagcagaggttctgcatgagggctctgcccctgcagcagacttctgcctggacatccaggcatttccatacatcttctgaagtctaggcagatgttcccaaactccaattcttgatttctgtgcatctgcaggctcaacaccacatggaagctgccaaggctcgaggcttgcaccctctgaagccacagtctgagctgtaccttggccccttttatccatggctggagaagctgggacacagagcactaagtccttaggctgcacacagctggggggccctggctccagcccacaaaaccattttttccatctaggcctcagggcctgtgatggcaggggctaccatgaagatctgtgacatgccctgcaatttccccattgtcttggtgattaacatttagctccttgttacttatgcaaatttctgcagcaggcttgaatttctccccagaacatgggtttttcttttctattgcattgtcaggttgcaaattttccaaacttatatgctctgcttcctcttgcaagctttgctgcttagaaatttcttccaccagataccctacatcatctctctcaggtttaagttccacagatctctagggcaagggcaagggcaaaatgccatcagtctctttgctaaagcatagcaagagtgacctttgcttcagttctcaacaagttcctcatctctgtctgagatcacctcagcctggacttcattgtccatatcaccatcagcattttggtcaaagccattcaacaagtatctagtaagttccaaactttaccacattttcctgtgttcttctgagtcctccaaactgttccaacctctgcctgttacacagttccaaagtcacttccacatttttgggtatccttacggcagcaccccgctccctcggtaccaatttgctttattagtctattctcacactgctacaaagacatacctgagactgggtgatttataaagtaaagtggtttaattgactcacagttttgcagggttggggaggcctcatgaacttacaatgatggtggatggggaagcaaatacgttcatcttcacatggcagcaagatggagaagtgcagagtgaagggagagacagctccttataaagccattagatcccatgagaactcactcactatcatgagaacagcatgaggggaaggctcccatgacctaatcacctcccatgaggtccctcccccaacacgtggggattatgatttggattacaattcaagatgagatttgggtggggacataaagccagaccgtatgacatggtgaaatagttacaactgttttcatgaagcttttttggtctcaagatctgtgtgctatttgaataaatgagatgcagctggtttccaacgtgttttcctagcattggggtttaaagaaaaaagtaaaaaggacctaccttggaaatcatttcagaaaactgattcttaagcagtgattctcgaacttgagtgtatatcagaatcacgtatagcaggggtccccaacctctgggctatggaccacagcaggagagtcagcaataaccccctgagctccacctcctgtcagattggtagtgtcattagagtctcatagaaagtggctatgttgcctggggtatataccctggggtttcttgttgtgtaccaggaaaatttaggtcatggacacacacgaggagtttaggagtggaggtttaacacgtagaagagaagagaaagagaaacagcttcctctatagaggaagtggtcttggagcagaaaaagaccagcgggtggcagctgtgctgaattttatagtcaggtttaaagaggcagtgtctgatttgcatagtgctcacccattggttctgtcaggtatgatgtttacacagggcatgggcaaggctggtcaccccaccctaatcttatgcaaatgggctttccagttgattggcaccatcttgtctgcttcttactgtacatgtggctggcagagaaaggaagayggagctgccatcttgaacatgtctagtccttagttcctgccagcattcacctgtgcaagtctccagcttgcttgtctatgtctgcagctcaactttacattttctttgttagaaaatkatttggggttgctttttattaaaaagaaaagccttaccaaggattcccatgcccttaccatctgcctgtgtaatttcttcttaactcctgtatcatcaggaacgtgaaccctattgtgaattgtacatgccagggawctagattgtgtgctccttatgagaatgtaatgcctgatgatctgaggtagaacagtttcaacccgaatccaccccacccaccaactttccccatcccatgaaaaaattagcttccacaaaactggtccttggtgctgaaaaggttggaagactgctgatctatagggtttattaaaacagtaggccccccaccttcagcatttttaactcagaagttcagggatgaggactgagaatttgcatttctaactagtcccccgagtsgtgatgctactttagatcgtaacgttcatattgaaacatttgtcctacctacggatgccaatgaccaaggcatatgttggacgagcactgtgagaataggtagaatcaactctacttgagtgcattgcccacacaactgcttagtcttgtgtgcgtttagggaaagaacaggtggggagtgggggaggtacacttcgcccaaccatttgcttgtagatcttcatggactcctcccagagttcacctttgaagactaaggtatggtagtgccaagagtggagatactcctttatcagggcctctggggtcatggtcctgggctgtgacctcagcacgacatcagcacaaccaaarcaaaccacaggctggtgtttaggttcttgtcaagacctcatgcatcattaaacagagggcaactgcagagctctccattctgttttaagaaaatagaaatagtaactagcattaaactaaacccacaaacgcctgttccctcttgatagggtggtcacgctactgctgcattgttttgctttttcttttttttctgatgcagctatagtacaagccgtgactcatgctaggtgctagcctcacagatatacataaacattcacaatcaggtttccaaagctgtttccttacttccctttgttgctattttacttttcattggaggttgggcgaggcartctttaaatgaagctattttttctttgtctctctgtccctctgtgtctctctctgtgtctcacacacatacacatgcacacacasacacacacagacacacacacacacacacacacagtctagctgaatcacgaattccgtgagaacagagtcagcatttgtatattttctcagagatctattcctaaccttaatgccatacctagcacatagcagacacacaaaatttgtgactgactgaatgaataaacatgtatattattgcaagccagttgcaaacagatatattgttgcaaacagaaggttacctgttgatccttcctatgttatctctgaactgcaggaacttcattttttctatgaaccaaatgtaggtcatcatgaatcaagcgtccataatatctgtttgtccacatataacctattttatagcagagcttatattctgatgatttgtagatttaatgttgtttattcatcatatctatcacatttgttttttaaatatttctaaacagctgattaaagtacaattggatggaggtaaaaatatttttaaagacgtataatataaaaggacagtaattggatatagttattcaaatgtaacacttaatttactttgagtttttacttaaccctgtaacaatggaattgtgttagcttacataattttcattgtttaattgaaagaagaagaaaaagaaaaagcagctgcaacagcggtagcaacaacacgccaaaaaacggaaagataatactttttccacttggcatttatttctgggaagaatgtatcttaagagcctttactgaaaagggcattgagttacacaggcaatagctttttcaacagctatttttccagaggtgtaaaaacagcctttgcctggttacattgtatatcttacctcagtaaagwcatgaaaaggaatcgtgataaggtgaatgcactcctacagagcgctaagcttcctggcgatttgacttgattcgggaatagaactcagtaaactgagcagattaaatgatcaatgtttcttttagattagccctctcaaatatcaatggtctctgccagccttagatgagataatgaggtaatttcaatactgagcttttgacagagtgtctgaagtgtaaagagtctgtggtattagaaacatgtctcagcatggcactgcccagcatcagcaggggccttctgagaggccaccgttgtccagagtctaagacactggtccagtggggacacatgagatgacatgggtttgtgtgtgtcttaattgcagtcctcgagaagagacaaggatgtgagtgtgtatagtttatttaaaaggtgcaggaagcatcagtactgcacacaagacaaggaaaaagaaaggagagtcaacgtagggtgcagtattaagctatggtaggcaactaaagtttaatcctgtaagaaaactctggaagtaatgtagaagacacacttcagagttatccatcctgaggagggagggagttcccttcagctggaggtacttatttcagtgctcttggttgaggactactcccagaaaaagggtgttgatttgggaacacttccaaccagaggggcatcacacctgccacatacacaggaagattcatcttctgtggttctgggaaaagccttcaggcacagaactgcacatcctgcaatgggaggttgtctggagcacagtgaagtggggtgcagtctgaggaatttggcaagacactgacagcatctcctctggtgtggaaaatggcattagaaagcagtggtcacaaggctgggtgcagtggctcacgcctgcaatcccagacatttcagaggctgaggcagatggatcacctgagctcaggggtttgagatcagcctgggcaacatggtgaaaccctgttctactagaaatacaaaaattagccaggtgtgctggtgtgcacctgtagttccagctactcaataggctgagacagaaggaatgcttgagccagggagacggaggttgcagtgagctgagatggcaccattgcactccagcctgggtgacagagtaagaccttagctcaaaaaaaattaaataaaagggagcaagggagagggagggagagggagagagggagggagggagggagggaaggagggaggcctgttgacagaacaatgaataattacgcacatacctaaagcgaatactcaggtgagatccccaagtacactctttcaagtatgggttagatattctaactgaagcaaatgtaaaaattgaatgttaacagtgggtctcttctattagtgtggttgtttgctgtcttctccagaatggatgtttttaagaagtcctttctcctcaccggttcccactagctgcaaaggttacccttacatccttgaatctctggattttttaaacccatttctctaatgctgcttataatattgttgataatatttgtcaccccttggcttgttcaaatatatttcattccactataggtatattcgcacgttttcacgctgctgataaagacatgccctcgactgggtaataaggaaaaagaggtttgatggactcacagccctcacaatcatggtggaargtgaagaggagcaaaatcgtgtctcatgtggcagcagacaggagagaatgagaaccaaatgaaaggggtttccccttataaaaccatcagatttcatgagacttattcactaccatgagaacagtatgggggaaastgcccccatgattcaattatttcccaccaggtccctcccayaacgtgtgggaattattaattcaagatgagatttgggttggggacgcagccaaaccatatcagtaggtcaaatgcaaagcctgaaatatggagaggaagacrtcagtataaatcctggttccgtcacttgaatacgttgccttgagcaaattattcccttgcagaatctcagtttttccacctgtaaaatggagacggcaaaaattaacagtcacctcrgggagtaattatgacaccagaatgagctaataaacatcactgttttgctcggtggtgaggttgagtccaaaccttagcagttatgattgtggttgttgctgttgtccttactaattactccatagattgatttgagttttgcaatcagtttgatgccttgttccatagtttcttttttacttccagatttggttcaggtaaagttggcaaagcaaggagagctggattcttcttacctgcttcaccttagctggttcctgcttcatacatctttcaagatgtttgtagaaaactaatcagcgtctacgtttgttttctaattttcttttgctcacacatactgtggccacttgattaccaatcagtgctgtgttggcaggcacatacaggccctattcctactaatcagagatgtgggaagcaaatgctggtgtttaaagggaacccttatttgagctcttgtcccatgactcctaattgttgtatttctcaaactcaacccagctgcaagctttattagggaaacatttattcagataaaagcctcagttatgaaagaggggtaattattttgcaaatgtgtttgaatcactgtatgctgtagtgcaactcatccccaaatggagaaggtgcacatttgggctgaaatgttgctttgtagatggacaatacracaagcatatgacggggaacttctggcaaacgataggaaaatggtcaaatgaaaagacaccagtaaaatgagagattggatgaaaagtgatcaggaagctctgaaagctgaccagagtgaacaaaatgcctaaattccgttcatccacattcatttatttattcattcattaaccattgaatattttggggctcctatacatagtttgctctcaaagaatkttaggttttagttgggagagagcaatgaaaatatgttaactgcatgccaactgggatctcccattcagtgaaatctagatagcgttggaccaaaaccctgttctgtgccttgagaatgctcagtgatatccatgacatttctggaatttcacgggggtgggtgctcacctaccaaaggtcccctcctagctckaagatcagcttctgcttatttcgttgttttgcttcatcatctttacattgcacaatccacgtgtagaaaatagcccttcccttycctttgtgcgccaaaatttacataaagcattgtgtggatagcacactttattgaaattctagaaagttgtatttggagattgtatcaactcccagtggaatattaaacacggctattcttaaatgtcctccaggcaccaggcacattttcttttgttgcttgtaccgagctctctatctctaaccacctccgagttttctttttccatccctgttcccatctctccttctcttaatgttctgcccagtatatgggggctatcacatggcatgattattctatattcttgctccctcattgagttccagtctcaagcacttatattcatacccaggaagttgttctccagaatataacagttctcttccatttaaaagaaacttccctcagtggtaattcaaggagttcttcatatatcctgaatataagtctgtcagatgcatgaattacaagtctcttccctttgtgtcttgtctttcactttcttaatggtgtcgtttgataaacagatgttctgtattttaatgaaggctaattatttatttttcctatcaggcttattgcttcttgtgtcctgtttaagaaatatttgcataccccaaggtcacagacattctccactaggttttctaaaagcttgcttttcgtaggtttcatgattaattttcatcttaagttaattttgtgtatggtgtgaggtagaggtcaagatgtatgatttttccagttgcygccgcaaaaygtattgagaagatcaccctttccgtcactgaattgcagccataaatcaaataaccaatatgtgtgatctatttccgcactgtctttccctggtctttatatttaaccttgtgccaatatgagggtggtaaattttaatcatcttcctttttatgtaggcatttaaaactatcctgttataagtgctctggtaatagaaatacagactataacacacgccagaggatttgacctaagggaagagggtcagagttggctttctgagyggatgtgycatttaggtggagaagtactttgtgcgtctgcattctagggcatgccctgcttggcagttttctcattttatgatgggtcctgtgatgtggccaatgtgaaccatgctgtatgtgcactggcctggaatagataacaacaataaaagaaggaagatgcccaagaagaagtsaaataacctcattgtaaagatgtgaaattgaggtttaaagagaacatgtgatatgcccaaggtcacagagttgatgagttacaatgctgggattggaactcaggtttcccaatagatccaccctcttcccatgaccctgcattgcctgtaggtacaaatgctcaaagttgctgagctataatgtggtgatgcttggactcgtactcagttctgtttaacttcagagtctgtgctctaccccgtatccttgattacctccttggaaaagctgaatttatttgtatgcctaactaagaatgagctaattgattcccattttaatatgacagctctgccttagcactatcaatatgtgtccaaaaaatcttatggtgcatgactaattgcactttggaatcgtatacatttaattatatatttgatttgagagtttagcatttacaattattgtcatctcccacttactgagcttccattcttccattctgattgtctctgttacagactttttttctcatgcatagagaagaaataaaggcacaatttcctttttccatatttatgtgttatatattcctttagcatcatgagccacatatgatagtattgctagatcagttctcataatgtaccctttgcaggatagactgtgaaaatctaattttggcaaaatgactgaaatcccagtgaatgattttttcttttcttatataaasctaagcatccaatagtgaaagtttatrtgactcaaatggaagaagaattcatgacaaaaggtgtgattattcgcataagaccctgaaattcctttctgggtgaaataggccctttcttccttccataagaggctctgactgatgagttggcttttattaggcaatgtatgtctgrtgcaatatctgtggataaaaccaccagcccctatcaagtcaatcaaatatttactgagcacttattawgtccaagacactttggagaacaaagaaatayaacctggccttgcccttcaggctgtatcaattgagatagaatttggactgctgcaatcaattacacagatgtctctcaaggtagtgtcttgatgcttgagggaaacaagacaaaatgckattaataatgacttagttttctttgtcaagcaatcggcttgccacatcattgaggtaacttcacattttcttgcatcttttacaattagcagcttcagctgactctgcaacctgttgagaaagagggcccaggcaatgttgtccttggcatcttattcaggtctggcttccactgcagtgaatgcactcagatakccctttatcarctgagtccccttgagattaagtatttaatgtctcttgatctccagccttaggaaataacccaattcattactcagccattatgtaattcattactgtcattagagatcaggagaatcgtcttaggagaactgagaatacaaggcaaaccacacctttctttgtccagcatgattaacggactgtggaagggccctaatttggagttccattcatgggatttrgttttatgacatcctccagtcccaggcttctggtatgacttgcagaggcattggttaacctggtggaaaatggattactactcaacgtgtttaccgatactgtgtgtctgtagtgggctttggtggactcctttatgggattgttgatctctcaacagaacagagaagttggtcaggaaggttattaagggagaatgcataagggagctgctttttctagactggagtgagggtcatggattgcttcccagggaacatttggcaatgtctggagataattttttgttgtgacagtgtggaccaggagtgggaggagaacatgactagcatctagtgggtgaaggccaggggtggtgktaacatcctacaatatacaggactgcctatcatagcagaattatctggcccaaaatttcagcagtrccactgttgagaaaccctgggtacctgcccattactgctcccttctaaaacaacacatatttcttcataggcccttgtgaatttatttgttttatttgatgagagagagaaagagagagagagagacagacagagactgatacatttgtacctatctatctatttacaacttctccattccctacttcatttcacaaggtattaggtaaagcaggtatataaataacactcaataaagtagttaagagaaattttaaaaaaatacacagggggaaatacaaattaaagtaggcagtagcaactgtagaaaatatattatactggtaatctgacagtctgacttataattgctgtcattttctttgagcttcctgagagccaaaacaaaaatagaaacagtcattatactttttgttatccatgaggagaaaacagtgtagagaaagcttttaataacacaaagacatttctcaagtagaacttaatgtaaataagtgttggcaaaggacaagatagtaaatattttcaactttgtgggccatgaagtttctgtggcagtcactcaactgtgcccgtgtagtccccaaagtgtccacagacaatatggaaacaaatgggtgtgactgtgttctaataaaacttaatacaaaaaaacaaagggtcagatttggctcttggaccatagttggtcaagcctcagtgtaggtcttcagaaacactcctggatcaagtacgaaatggatattaagatgatgtttcctaggccactgactgaaaccgagagctttcccttacagggtgctaaacgactttctgcaccatcggtagtttctacgaggatggaagaacaataacaataataacaaaatatcttcttagggcatttactgtggtgcatatcaaggattttgtgttttttttcttcgcggttgtttagttttgctttgggtgacaccccttctcatttgctgtgaagataccgcaggatgataaactccctsttctatactaagtcccatctgcaaggaaaggaaacttcactctgctccttccatcttgctgaatatttaaagggtattgacacaaggcgttttgataggccaaaagtattattatcctaaaaaatatttcctgtgatttaggcacatggagaggcaccgtgttagagagtcaagataaaatacctacctaaagactcttcctctgagtcatttcctagggacactctcagttcctttggtggccacagtttggctgtcatttcctctgtgaattcttctacgactctttggaggaaggatgtggtcttcacctttgtccttccgtatgttttgtaattctgaattttatagcacttctcctggcgtcttataactttatatttctctttcccctgatcaactgagcttcttgaggggacagtataagtctttctgatcttttgccctcccctgtgtcttttgcaacatgtagaacatactagatttccataactatttgttgattaaattaatgactagatggatggatggatggatggatacatggatgaatggagggagggagggaggaagagagggatggataaatggatgtgggagggaagggtggaaggatggaataatggaaagaagaacatcagcagcttctcaaaaatgtaagttctaacataagtagtaatattacttatgaaatattttattgatagtcaagcaccctgattaaacttgtcctatttcatcatataaaattaagcttaatcttcatttaggccaggtgtggtggctgatgcctgtaatcccagcactttgtgaggccaaggcaggcagatcacttgaggccagggagttcaagaccagcctggccaagatggcaaaacctcatctctactaaaagtacaaaaattagcctggcgtggtggcctgtgcctgtaatcccagctgcttaggaggctgaggmgtgaaaattgcttgaaaccaggaggtggaggttgcagtgagccaagatcacaccactgcactccagcgtgggtgacagaatgaaactctgtctcaaaaaaaagaaagaaaaaacatactcattcagtaacaaaacaaaatctcaaggcaacatatctgatttatggttcactaacataaatacatatgcctagaaattcactgaacgtcaaaatgatttatacatacaatcactagagtgaagttgaaagtgttttaagcagaatctgcatttaaaatgcatatatatttattagaaaggatgccataacagattggatacatacaatcaaattgttgctaataacactaggccaaagtctttataagtgcgcacgcctgtgtgtgtgtgtgtgtgtgtgtgtgtgtgtgtgtgtgtgtgatgttgtaagaaagtttaaggctatctcccttccttattcctctctctgattactgtcaatgctagctagttgatgtcagtaatgacaagtttgtattttaatttttaagmttgagtgatccatcacacctcaaccagagtaggtggttattcctactacctgcttggatgtcaaatgcatcagttggcaatttgtatttcttcagctttctctccctcctattttctgtgtttattctgtctatctacttatttcttacacaagagtgaccaagagtgtgtacccaggaggtgacggtcaagagtataacgtttcagaattaaaaaatattatagttgcaaactggatattttggataatactggaaaaacggaaatattagatcatgaaatcagatattatccatacttctgtgttaactacgataattatcttaatttgatgtttcggtttttccatttgcttattgtatgtaattttgacacatctgccttaattaataagaatggtacaaaattaagtaaattttacaaaaagacattttaaaagaactctttattcaaggaggaaacttaacaaatttaattttctttgatataaaatatcaaaagccataactagatattttattcaaatattaagcttgcaagtttgggagtaggggtgggaatcccactacagtcaaattattttgatgttactttccaggcttagagtttatcttccatatttccaatgagaatcarttcctcaagtggaattttatgataaactgctgaaagtagtatttaaaatggaaaccctgacaagaatgagtgtcacagggagtaatgaattcatgatggaactagttgggagtgtgtgacattttaagtgcctcatcactctgaattcactgggcatttattgtaatagaaaggaccatattgaattcatttggcattcatgtggacttcacatgtatttatggagatgtaacatggtaatttaatatttattctactaagcattctttaatggacattgaaagatattgtcatacaatgcttagtaaagccggtaactctaacgttattcttctatcaaaacaaagaaatgaaacaccattttgattcccaaagcacccgagtaagttatttggataagccaacattatgtatttactcccccaaatctgctttctaaatttttaagccacaaggttgactctaggaccaagacaataaagcagaagttcagtttaggattctttatattctaaaattgtctgcaaatacattaatctcagtctaaaaatattaggggaagattttcttggaacatcagcagtaaatttaacacatggcatgccttcaatagatttctcttcttccccctttagagttcagtttgytgtcttcatcacagtcccaaaaaatacatttgtgtttcttccttgaagaagaattatttttagaacaaacacatcattatttgggaacaatcaaaagatcaaaggcataagaatctttgctggaaagtgaaggaagagttcttcaaccaaccaaaatgacaatcttttatttttattctaagaacagagttgttccaggacacagcctaatgcaaactctgctactagtcactttcaaaatgttgtctagaatgccttgtttttaaattttctctcagttgccttctttacaccactcaaaagcagaacctttattacaaacacaccaaaaggtaccatataactaatcttcctggtttgaatgtaaccaatgttcaartatgattgtagagtattaattattttgacatcaatttactgaacacattttaatgaggaccagaaggaaagacaaagtttacttactttcgtgatatatatctggtccagaccttgtaagtaatagcactttcaaacttactatagaaaattcagtgactgtaaacatctttcaactctacattgtgagagagttttcaaatctttggcaaattaccctgtgtaaacctccttatgacccaaagagatattttgaatgaggggatgtattagtttcttagggctgacatgaaaaagtactgggtgacttaaaacagaaactacttgtctcatagctctggaagctagaagtctgaaatcaaagtgctgtcaagggccacactactttcagagtgtctaggggaggattsggcctcaccttttttaggttctggcagccccaggtgttccttggyttgtagctgaatcactgcaatctctgctttgttcctcacacagtgttctccctgcgtctctgtcttcacatggcattttcttatatggaccccacgcatactggaataggtccactctaayggcttcctcttaactcgatgacatgtgcacarattctattcccaaataaggtcacttttgcagatwccaggggttaggagttggacgtttcttttagggggacacaattcaacccctaaatggggatctcctgacagttcttaatagggtcaatatttcaatgcrtgcatttgttttttataatgatcttttctatgatactgggtgagataaaaaccaacttatttgcctttaagagcttctttgttttctgccatttgtgctagcaacagtcagagaaaactttttttttatagcaaattgtttttctcaacacattctgtctggaaaagaatgttctctagttaccacctctttggtctaagggcatctccttggtttctgtgttacagcctctttgtgttaattataagttgctttgctttacagactcaaaatgaatgttacagtgactgataaaagccaggatcctgagttcaagatcctgaccaattgggtgcttcatttgaaatcagaatctgtgttcactgtggtttacttggggtatgtgttagatttctcttggttgcaagcaaaaggaattcacaatggttagtatcaagcaggtaagaaaagggaagaaagaagattgttgaggtgtgtcttagttcactagggctcctataacaaagtgccacaaactgggtggcttaaacaaaataaatttcctgtcaatctcttctagaggctggaagtctaaggtcaaggtgtaggtagggctggtttcttctgagggctgtgaggggaatctgttcatgcctctctcagcttctggaggtttgctagaaacctttggcattccttagcttatagccgcatcatcccaatctcaaccttccctttgcatgccagtctccctgtgtctatgtctgcctctgagtccaaatctcccattttttttggtaaggacgtggtatggtttggctgtgtccccacccaaatctcatcttgaattgtagctcccataattcccacgtgttatgggagggactgggtgggagataattgaatcatgggggtggtttctaccatactgttcttgtggtagtgagtaagtctcaggagatctgatggttttagaagtggtctccctattcgcttggttctcattctctttttcacttgctgctgatgtaagatgtgcctttcgcctttcaccatgattgtgaggcctctccagccacgtgtaactgtgagtccattaaacatctttttctttataaacatgtctttatcagcattgtgaaaatggactaatacaggataccagtgatactggattaaggtctacccatgactttattttaacttgattacctctgtaaagaccctatctccaaataaagtcactgagagttagaactcccacatcttttttttttttttttttggtggtggttggyggggacagtgaaacccacagcagtgagagagttgtatgcacatggacacaaaagagcatctgatcataaagagaaggaaaccaaacctgtctgggcactgcaatgtgtgaatctagaactctccaactgmtatgcttcagcttagatgttgcgcatcaccatatttctgtgtcctgaatttcacatcttcgagaagaattttattggtccagttgagcccagataccttcccttggctcaatcttcaatggccagggagtgagggcacaggtcacaatggccatgttttgagggatgtgcaagtttgtgtgtgtgcttgtgtacatgtgtgaggattttgtcctctacaaaagtcagtggaatcattgtgagactgtgagctggcaagaggatatctccttcccccacatccctcaccccatcccaatctctggagaggaaagactgcctgtgctctcaaagaagaagtggcttttcattgattcagaaagaaatgtcagttgatatctgcttcctataaggtgttctgtcctgagctggaggtatagatacaagaaatgggtcctgatattcagctattggcatgggtaagactgaagtaggaaaggacttttcatctcctcccaagccgaggacacagctcaccatgaggtcgttgggtacgctggcttcatctaaaagaaccacatttaggttcttatgcgagaccacggcatgagctcagtccatggcaatgagtcctattttgttgagatgcccaagcaggagtttccttactgccagcatctacagggctgccatgtgctccccacaactctcccaggcttggctcaagtgcagggaggcccaggtaactccaaagagagggtccattcatcatggacccaggctttctctgatgtccataactgtctccccctggggattttgatgaatattcaaggacataaattcacacacgggctcagctgttgtacacccatgggaatcaggaggctcagtatatcttcctaagtgttccatttctttcccaggagccacagaagtgcaacaaagagatgagccccataaaccactgcatgtgtgtgtttgtcatttttctttagtgcaaggtttacaagactccctcccaacagggtcgtcatctcaacacatgtcacttggctatacgcttcactggaacattgtgttgtgctggggctgaattaaatgtgcaattactgcacattttctcgaaaggagttttgacaatgataaatgcatagacatttttccacactcagacaacrtgactvcttgctcatcaagtggctcaggattcactttgaagaactggtctcttgttaacaggagaacgtgggtgctgcccgagaagcgcatgggcctgagttcaagtgccacttctacctgtcatgtaccatctgagcgtgggcagctttcttactcctgctagcccgagttttcaatgagcaatcattgcacctctgataaacctcattggctatggtatttctatatgcaaagctgagacaacacttggaaagtaattaccatartccctggttaatagtaagctttcaatgagtgttggctagcattcatgcmsgtaagttatcctcttgcctagagcagtgatggctctaatgtgagttcagatccctacaayaggagaaacagtgcttgttgcttttcaaaaagcagagaataaccataacttttctacagatccttgaatataataacagtagctaatatctgtttacttattacctgctaggcaatgtgatcaattttctgtggatcagatgattcaattctcatacaaaccctgtgaactttttggtatttattttacatattaggaatcctggtgggccaactgcagcccactggcccctccaggtccactgtccaccattctctactctctggtgccacaagatgcttatctgtatgaagccttaggaaggaaaccagaagaactgacaccctgtcttgttctccctccacctctgattcctcactagtgcttctaatttactgaagccagctggaaaccagaagacaaggctgccaggtgctctgacaaaggacggagcagggtatagaagggagagtaaattcagaggactaagcaaatgtactcagcacatctgcttgtgaacatactgccagcaagtgccatttgttttaagcgatagagaattagatatcctstttgctgtactgttccaaactgcttatttctttctccttctttttcctcatagactatgatcttttgatattatagcaggaaacttggcgtgggctagcatcttggtgtaatccaacctctcttagatttgtggatatttcattgtgaaaaggtcaagataaaaaatacattactaaatatccatttatcctttattttctcatcatatacagaaaggttattgccaaatatggccataaaggttttattgctccaatttttatagcaaaaacagatacacttcttaatgaattttggtttattagatcascartgaccaacatggggtttctagctcttaggagaccctgatggtggcaatgaaggtctgcaagctattttaaatatttcagaaaatctaatataatcttacttttacaaatgataaagcttcacaaacaaaaacatcaagatgttttgcttttkactgaaatgatattagctctgcatggtgaacttagtaatttaattctgatcagcagctctgrttggcagttatatgtgcctttgattaataaaacatgggtgagaaaataaattattacttaatctgtgcagtttgctagataaagtctttgaaaacctggagtcaattggatggaaaataatgaactgggtgctcagtggtgaaataataagcacaataccagcttggcatgtctcacatatgtaggaaagccaagacaggcttccagatgggccgagatctgataaacaattccagtcaattatttgtttttagtaataacaacgacaataataatgatgatagtaggtaacaattattaagtggccagacatagtgctgaaatgctctscatgtaatattttatttcttccttccaatagacctaggaggaatgcactctgattatcccttatttcaggttggtctccttcagaagcagactcagacatttatgggctcagatagtttatttgggaggtaatgccaagaagcactgtagggaatgaagaaagtcagctggggaaggcaaggaaggcaacaccaggatgcactgaatggtagattgtctctgtgggcacctgggatgccaccccccttggcacgtctggggacagtgtagaacacacctttgagttgtaccacacaatcagtgaggaagctgggtattgctcttccgactcctgtttgtaattagttcagagcggctttcagggaagtcgacttcccggaacttccagttcaccctgtggaagggaaggggctgagcatgttctggtggctagagaaagccctcaggtacagagatacaggggtttccagaaagcctctggtgacgcacaaggatgtgagcacacacgaacagtacctgctgcacttccgtcctacaagagaggaagtcaagaattcatgagttgaaataacttatccagagtcacaaagcgcttgtgatggtgtgctcttccaaagaatttttttgctccctgtgtctgaaggctaccaatgtccaataatgtaccaaatgagcccttgttcttagagtttttttaaacaacagctttattgagatataattcacataccatactattcactcttttaaagtgtagcactccatggttttcagtctattcacagaattgtgcaaccgtcgccacaatgaacttcagaatattttttaaatctcctggaaaaaaaaaaaaacactatcctgagtcatacctcattttccaccattacatcctcagctcctggcagccacaaaatctcattctgtctctgtttcattcccttttatggacattttatagaaactgaatataatatctgatcttttgtgcctgccttctttcacttaggatagtgttttaaatgttcatccctgttgtagcgtgtatcaatacttcagtctttgcattgccaaataatattccattgcctggatatatcacatttgtttatccacttattgctcaatgaacattttagttgtttccactttggggcgattttgaataacgttgctgtgaaaatatgcctataatctttggtgtggatatgcacctacctaggattagaattgctaggttatcggcaactctatttttaaccttttgaggaactgccagattctttttccaagcagtcttagagtttattgatgattttaatttgctgtttaattaagcaagatgcctgccttacactgtttggcaaaggagaaaaatcagcatcaggcacttgcagacatagatttccagaattcstaaaacattcaagaaggrtgttatcggtacatgatcagagttgagtaggttctggattttaatgcctgtacttgctttttacttataaatgattawtactttagcttcataattatccatttagtttatgattatgggttgcctggttaaccctactgggtgtagtgatgcatgctttcatcagaaacatttttggcctgcagtttctaagtagccagattttaaagcatatacaggtggcagttcattaaacatgcattcgtttttgtttttatttggcacctactgtgaatcagtcactgtgttaggtgctgtgaatacagtggggggacaaaaacakatacaattgtgttagagaaaaataaactttgaaggaaactgcactagaagatacagcatttagtcattgctgggattctcttcattgcaagcagctactgcattccgattattcaccctgaatctaaggcaagctctgctctaaaatgtcacacaagaaagaagtggaaaacctcttctccaggaggggtttgcaatgtaaataargagacaaagaatgccttaggtgtttcctctacctagcataatcaaatactactatgaaatatgcaagagtctgtgtcatcactgacattcagtcttggatttattttttttaactctgtgtacyagacactgcctcttggatgtcccatagttcattgaactctccaagtgcaaagttaaactcaatctccccaccaacctctaacctcaacccagccccagacttttttttccagtgtatgctttctattttagcaaatcaagggtgctactcaccgtgctgttgccaaaaccacaaacatgggcatgattctcggtgtttctgtaggcttctctcacctaccctctagtcaggcaggtcttcatcatttaaccttctacttctctctgacagatttgcttctgtctatcctcatcttcatcctagatctaaaccaccattatctcttgcytgcaaccttttattcctaattctagtctttaatmtctaatttctgctccaaatggcagctgaaggattattttcaagctcagatgtatcctgccacaccctttggaactcctcatggatcgttattacccccaggtttaagtccattttctttaacatatcagagccttgctccaaatggcagctgaaggattattttcaagctcaggtatatcctgccacaccctttggaactcctcttggatcatcattacccccgagtttaagtccattttctttaatacagcagcgcctgtccttcatgacccagcccctgatgccatctctggttttatctttacccactcccttagcagatgcttgtgttgagcagagccaaaccaaatctcttactatccctagaatgtgccaggttctttcacattggaaagtttgcataagatgagctttgaaaagtactttttcaataacttgtgtctcagtggatttctattaattaggatatgggtttggatgccatagcaaagattcaaatgtcagtggcttcaataagatagatgcatattactctctcaagtgatggttcaggcaggagcagttctagattgacatggtggccccactgtgtcacttagagacaaagtggagacaggggtggagagacataaatctatctgagagatgtgtaggaagstgaatctttaaaacctggcttccctcttattttatggcatttgtggaatgtatcctgtgtcctcatggccccagacaactcaccaccacatccacattctatcccagtcagtgggaaaggggaaaggggagccatatcccttctcttgaaatacacaagtggaaagttgcatctaccacctctcctcatatcttcttggcgagctgttgaccatatgactaaatctagctgcaaggaaaatcaagagctattggtctttctttgggggacaaataraagtttctggtaattattttatgtaaaactaatccgaagaaataagtacattttccttccaaacatggcaatcctggcagggttgtgggcactggaatcacaccattttttgctaactaaacaaatttccaagtcaacaatgtcagatattggaagttcaagatagataaaggccactagtatgttggcaatagcatgccctctttacaaatgataaaatttagagaagtcaggtgcctcccaagtacccataacatgtacacgcccccctgctatcttctgaatccaccctctgtgctgaacaaacatgcagggcagtatactttagtgattaagaacaccagctttggactcagaaaggtctggatgcataatcacttattattgtgatatttacaaattccctaagttttctgagctttattttcccacaaggatgttatatgcattaaatgggataatatctagaaattacctaggaaatatctggccaatgattagcacttaagaaatgatctctagtataactataatgaatrtctcttaaactttttctgctatgaccagttattgcttcttttggagacatgatagctggaaaatgtgcactcataattttgccagtgtttatttcttcataaggcaagacaaaaggagtcctgtggaagacgcctcttcactttcttcttaatgtacttggtctaaggtatccacacttgtctgagagatggcagaggtgggtgaggcaccacagctctgtctttctcttagtaaactcacagattcctaactaagtactcagagtctgctgtgtgccatacctaacctaaaatcccaattctacccattcctggctgtcagatcttggaaaagattcttgacctctcttagcaccaacctctgcttctaaaaatgagaataacttgaatacctacttaacaattgtcctcggaggaatagctgagacgcttcacctagaagtgcttaaaactgtgtctgatatatcgttcatgcttgataaatatgagctgacttaaattcccccatttaagcatgaatttcagcagaggcagtaggggtaaaaaggagaggatgcggtgaagaaaaatttagaaggcataatggaaaggacccagtgatggtccagtgtcagggagatggcccagatagaaatgtagcaaaattatcctgaaaaatttgattatttgatagaatggttcaccaagatggaaaacacagtcggggaggagagggcttgagaggaagacaatgagtaaaacgttaggcatggtcaatttgagtggtcaagggattcaccatggagatattaaacaggcattagatagccaggtctgaagctctgtagagaagtgtaagttcaaaacattcatttaggagtcacttgacccaggaggcaccagccgcaggtcacaggctccattgtcttcagggaccagtagcagtcatgtgaaaagcaggaaagagagacggttaacttggggtcaacaatgcgatgcacgccctgcccaaaggccttcaagtgcattcacctgggtgagtactcagcctgaggtctgaatggaaccttccacctgggaagatgttaaagtggttatgaacgaatgaaatctacccccamggttttcctggtgcagaaagagaagactgaagatcaaatttacaacgtgcttagacttctacagtgttgctgaaatctacatcagacagtattttggcgaggagcaaggcttccccagcagtgttcatgatctgacagctgtaaccaatacctgacatttcccttttggatataaataattatctttcacagttatggcacatacacaacaagwaaatttccccttttatttggaaagcctctactttacaattcatgtttaccttcctgaatcttttctacatttcaaaytcatgttttgtttaaaaagatgacagacacaggaaagcgttggttatggcaatataattaaaggacattcatttcactcaaacctgcatggtgatttttggcaggggagggggctggcaaatgatgttttgcctcctgtattagttttctatttcttctgtaaaaatttatgacaaaatttgtggcttaaagyaacccatggatgtctgaatggctttggttcctttctggaggcccaagggcagaatccactttcttccctctcccagtttctagaggctcacagccccttccttcattttcaaagccacaaaagttggatctctccagccattttctgagtagttacatctcctttgcactcttttcgacctccatctctaattttcaggacccttgtgattgcattgggttcacctgggtaagtgrgaagactctttttaaggtcagctgattaacaacccaaattccacctgcataggttctgtttgccatataagtttataagttcctttatatctccgagtagtactgcgtggcatggatgtaccacacggttgttgttgtttttaaccctctacctgctgaaagacatctggtttgcttccagttttagcatttatgagtacggcagctatgcacaattgtgtacagatttttcttttaatggaggttttcattctctgagatgaattcgcccaaaagtgcaatgtctgggttatataattgcatgtgttgttttatttttwaaaaaaacattgctaaactgttttccagagcggctataccattttacattctattgaagagttttgagcagtaaggtgatgcaatcctattcatgttttaaaaacattctctggatgatggatcaagaatgccagtagggagggcaaatgcagaagcagggagatcagaagggagcctctgcagtggttcaggtgagaggtgagagagagagtcaaagcatgggtgggtgtggctgagatgatgagaagcagtaggataagggacatatattgatgatataattgacagttgctgcagaattgtttgtggaaattgggagaaaagattcaaggaggatttctgtgctttgggcttgaggatggtggttcatgatggacctatttgtcttgataatgggaggacaggggtgggagctgacatgggaaagagatgagtgcctgttaaattctacagtggaaatcttgagtgggtggttagaaataagagtctggagccaaggggagatgtgggaagctggagagaaagtggaaaaggactatgtctataaataygcccgatgcaaagcgtggcatagtcacaggcaaaagctatccacttgatctcaagaacaatcttttttcaccttctgggcttcacaaacaaaatagcaccttcagtttccatttcggtatagcaggtacggtaaccacaagaacgtgcaaagcagaaacaaagagcacttggcacccaagtcttatagaggctcatttctgatatcttctagggaacttctttgtataaggacrtcatagagaaggtttgtctttcatttgtctgtagcaaggtcgtaattttttttaatctttaaaaaaaattattgttaatacaaataagtctattgtgatttttaattctaggaagaatgccatacaaatcttttttagtacacgtttctgttttatactgtgatttggaggggtaaaaagggtaatacaaaatatggatagttttttcattgctggaatgttccacattgggttctgccttggcaacgtctcctgtgagctacagttgagggccaaagcagatgctccgtttttatggatctgtcgatagccacatgactctgcaactgccactgcctccccacaccccctgagctggcgccagcacggagcagctgaatccgactcaggcttcatcccagctcacattccaccttcccgacaaggacactgaggcccagagatgaagtsggacttcccaccacaagtcaatgaggagatggggtagccaggcctaaaaccccggcctttggcttacagccgcccktcattttcccaggtgcccacytcagaggccatccttggaaaaggaaacgtcactaacctatggttctggggaaatggagacgagagaggaagtaatatgttgttcttcttttctttaggcttctttccactgggtaaatcttctccatacataataaaatgaaggccccagatgatttgtgaaagagttgaaatgaacttcctgcarttgaacaaactattatgaagcccctactgtctttatcagcaattcacagtcttttgtccataagaataagcaggggacttaaaaaaaaaaaaaaaaaamaaaaactactggtacttgggccttaccccagactaactaaattagaccctctagggtggactttgctctcagtatttttcaaagttacccatgctattccaacgtacagccaggaatgagaacaaactggtctatggtactgtgctaattgatcctgtctttggttctcaagttggggtgatttggcctctgcagaggataaaaggaaatgtctggagacttttggttgtcaccgttgggatgggggctgccgttggcttctagtgggtagaggtcagtgatgctttttaacctcctacaatgcactagacarcctccaccacaaagaattatctggccccaaacatcgatagtgccaaggtggagaaacmctaggcttatggatgccatgggaaacaccasttacctggatgtaaatccatggtaaaataacatagatgctatgacatgtggcccactggaagacacccatgtcaaatcccaggagccagtgaatgtgagcttatttggcaaaagagtctttgcagaggtaattaagttgggggtcttgagatcaaataatcctgaattatctgagygtatcctaaattgaatttcaagtggccttgtaagagtcatagaggaaaacagatacacaggggagagggtgatataaccatagaggcagaaattacagcaatatggccccaagccaaggattcccagagccaccaggaggtggatgaagcaaggaaggatccttttttagagacttccaaaaaagcgtggccctgctgacaccttgatttaggtcttctggcctccagaggtatgagagaataaatccctattgtttttttgccacaaggtttgtagtaatttggtatggcagcaataggaaaccgatcagatgcctgtgcctttgtttgcaaaattcaacaaagcacattaggagagatggggtccatgagaagggataggatgcatgcaactcataaggctgaagacagacgggagtgggagtaggaargtctagaagagaatctgacaaagatgcgggtgaaactctgaacccctggccagggcagggaagtcatgaaggccaagcaacacatccagtgatgattcttctgtcgacatttcatttctgaaaactggttgtttcattaaattttttggtttttcagatctcaaggtgtcagtatcttgtaacagtaatgagcttgattcgctgtgaaaagcaagacgtgtgaaatagaaacaaacttaaacttttaataatttcatttactaatggtcactaatgacctagaacccaagacacatatctttaaaaaaattagattagggaaatgatatataagcaaaataataatttagtaaaaggtgtaattatttttcttccttttgtaaaagttatttgtaattaacaaatgatcatttgtatatttttctagtaacacctaaaacttcctgatctttatccgtttaaccaacatgtatggtgttaaagaaacaggccaggtgtggtggctcacacctgtaatcccagcagtttgggaggctgaggcgggcagatcacctgaggtcaggagttgaagaccagcctggccaacatggtgaaaccccatctctactaaaaatacaaaaaaaaaaaaaattgccaggtgtggtggtgggcacctgtaatcccagctactagggaggctgaggcagaagaatcgcttgaacctgagaggcagaagttgtggtggaccaagaatgcaccattgcactccagcctgggcaacaagagtgaaactctgtctcaaagaaaagaaaagaaataactggaaagaaagtaccagcaaggaacgtcctttctcaatacctcttacatgatccctgtcccctacgtcctatggtttcaccgtatcacatcctcacacactcccctctaactccactttttaagtgactctgtttcctcttacattttcccatagtctgtcttccccttatataactgtcattatataactcattctgtaatgatttacttaaacctgacttccccattaggaagtatgctccatggggagagagcgcatatctgcttcgtatttcccccctaaatcctcaacacctgttacaattcccagtgtacagtaagcagtccataaagctggatgattactctgcatgtgttagtgacatgcatgaagtacccatttccccttggcacgggaagcccaggggaacagcattttcctgcctgacttctgaagccctcatactcatgatcctacgggagcaatggcaagggcaccggaaagccaggtcggagaatagagacccccagcctgctctcacagttggactcagcagtgcaacatcagtgactcctttgtgggagtcccacacaccgctgttcacacagggaacaccagtgcccggtggagctgcgggcttttgagacctcccgagtcgctttgtgtgcacaatgccgtgactctggatttgtacagtatgaccctcagacgctggaacaggagcacacgccaaagagaaaaaggagtggagatgactgagatctcataaatccataatgggcctgctctgtattaataaaacaatctcaatggtggagctccataaaagagaggcataggctgatgtaatttccttgaagtcccctataaagcattttactctgtaatacagctacatttatgaagtggttttatcttgaaagatcccaaagggcttactagactgaaaaggaaaatatcaagtacacgacatctcaaaacaccaccaatgtacttcggtgataacagttggggattctgtgacagcaggtagccctcttaaaaagcagacagcggcttagcccattaaacctccagggagaagtaaagagaaagaggagataattgtccacattggataagggccacacaggttttctttattaataaaggccatggcttgtttccatccgccacgtggatttaagtgggtgagctttatcaacatcattctccttatttgaaataaaagaaagaaaccaacttataacacttcttcataaagggactgagaaaatatatgtaaagcttccagtggttaatagaggtcaggtgtagccagtgtaatttagaagctgtgcattttaaaaagtaaaatataacctacagttataaaatatatccgacaggaaaaatatcttttcccagccaaattttactgaatccagtcctgtcgaaatgactgatcctgggtttttttcttccttgttgctgtcctggttaggacatggtggcactaacttttagtgaattagccgaggatataggggaatggttggcaggggccagaagtccttcttgattatcctccaagaatatcaccccactgggagctaagaaggaaggtggaagcaccaggtgatgtaagtttagcaatcgctgagtactgtcaaagaaagcagtctgagacttcaaagtaaataaaaagtagctcccctttcttcaaaaatgttaaaactgatccactctctaaccaggaatactgttgtctcacattccctctgcagtttctctcatcccacttctgcttccagcccaaacccctcacccgtctcgttttcccaccagaaagtactccttgtctttttactaatactttgcttcttccctccccacacgatctctccaaagcctgggaactgagctagcaaagagaatgctcttctgagcttggagctgaacaaggagcccctatggaggagacaaagatgcaaaatttttagtttggttttattctcatttaagttttctatggagtatttttcttgtgatttaatctttggatgagactatcaatgtacgtttcttctaattttatttttcaaatattccattgcaaacttatttagcatttataattgaatactgataagtgaatttatttattcatttatttattcatttattttgagatgcaktctcactctgccacccaagctggagtacagtggtgtgatcttggctcactgcaacctctacttccaggttcaagggattctcctgccatggccagtattattttttaaatttttagtagtgacggggtttcaccgtgttggccaggctggtctcaaactactgacctcaagtgatctgccagcctcagtctcccaaagtgctgggattacaggcatgagccactgctcccggccagtaaactttattttattttaaaaacctgttttggagtattagcccactggtttacattgtcttccttacatacatcacacccatatggaggagtactttaaagacaaagttgcaatctggtagcatagctgcccagtggagaaaaagtgcacatgtaaagcctgagtaattcagggcatgaaaatatccctgtcagccaatcagtcaacgagttgaccaagcgtcttggctagcctcagaggtaccttggcaggcaggctcaggcattgtgcagccctgtgtaaaattttcctcatagtaactacgttgtctttacatcaacctgagaagtagatactatttttcctatttttgtttgtttgtttgtttgtttgagacaaagactcggtctgtcgcccaggctggagtgcagtggtgcgatctcggcccatggcaacctccgcctcccgggttgacgccattctcctgcctcagcctcccgagtagctgggactacaggcgcccgccaccacgcccagctaatttttttgtatttttagtagagatggggtttcactgtgttggctaggatggtctcgatttcctgacctcgtgatccgcccacctccgcctcccaaagtgttgggattacaggcgtgagccagcgcgcctggcctatttttcctattttattaatgagaaaactgaggctcagagatgctaaataacatatctgagttcatcactgccagtcaatctgggctcaaacattccgatccagattgctctgattctagagcctttgttctggaaatctgtcttttataatacacagggattttatttttaaccttttattttgaaatgaattcagacttacaggaaagttgcaaaaagaatgtaggtaattcctttatatttttagttcaaatttttcaaatgttaacatattatcacatttacttaatgattcctccctcccccaactattgaagagaaaattgcagactcgatgccccttttcccctcatcttcagtgtgatatttcccaaaaacaaggatgttttttctctctcatagaatcacagaacaatgatcaaatcagcaaattaacgctattaaaaattatctaatcaacacacttwatttggatttatccaattaccgcactaatgtttttttattgcaaaagaaaatattttggcccaggatctaatccaggatttaatattgcctcagatctcatgtctctttaggttcctttaatctggaaaagttcttcatctttgttctgtctttcgtgaccatgacatagttgaagattataggttggttagtttgttcggtgtctcccatgattagatccaggttaaagaaacagctggaaagaaagtacaagcaaggaacttcctatgtcaacacctaaataatctctgccacccccacccccatggctttaccccatcacatcctcacaaactcccctctacctccacattttaggtgattctctttcctcttacattttctcatagtctgccctccctttatagctctaatcacaacttgaattgtataacaaattctataatgatttttttaaaactgacttccccattagggtgtatgctccctggggactgagctcatacctggttcgtatttgcgcccgctgaatcctcaacacctagtacaattctcagtaagcagtccctaaagctargtgattactctgtatgtgttagtgaaatgcattaagtrcccatttccccttggcgtgggaagcccacaggaacagcattttcctgccttacttctgaagtccttgaactcacgctcctactggagtgatggcaaggccactggaaagccaggtcggagaacagagacccccccagcctgctttcacagttggttccggcagttgttgcatttgtggcaagaacctcatggcagtattgtgtccttcacaktgctttgtatcaggcagcatgtagcaggcttttgtgtccttactggtgacattaacttggaccacttacagagggtggtgtctgccaggtttctcctatataaacttaatttttcctcctttgtaactaacaagggtcttggaaggagatatttccagactacacaaataccttgtttcttttcatattttcacccactgattctaggcttctttgataatttttgccctcctgccccaccaaaaaatattttaccattatggttaccaaatggcgattctctaatggcatgagtccttctacatttatttgttggcattctattttaaggaaaagctccccccarcttaagaatttatttccaattttaaaagtttcattactatggttttatgggttctttttttattctgtagggtaacaatctgttgctacccttatttattcttgtgcgccaattgtccaccgtttgtccagtgggaagcctaacatgcagtttttatattsaagtatcctagcacgtcaacttttattgcttcacttaaaatctgccaccttccaccttcatgtcctgaatcctttatctagaaaatgtgtaattttccaagaaggcctcagaccyagtggtccagttactgtctgtttttgctgactaactcttgaaataagaatttttttaaaagctggtagtagggatgaagggggttaagtgacagttctcctaagaagcatactcatggccctgccagcggcttggagacataagggaggtaaactgaaatctttcctgaacacttcatgctttttggtttctctccactttttaacacactgcagtgtaattccctccactatcctgaaaacatggatttagattccaagacccatctctccttctgtgaagccatcctccctgccccacccaggcaggatgaattattctcttcttggcagctctagaagccctggtataggcttttgttctagcatcagtcatatggtgttataactatttttgacactccgttcccctcaataggctgtgagcctttcacaaatgggtttttacatatatctgtgttaagtaataataaggctgggtgtagtggctcacgcctgtaatcccagcagtttgggaggctgagtggggatgattgcttgagctcaagagttcaagacaagcctggacaacatggaaaaaccccatctctacaaaatatacaaaaattagttgggcatggtaatcccagctgctcaggaggctgaggcaggagaatcgcttgaamcctggaggcagaagttgcagtaagccaagatcgcatcactgcactccagcctgggcaacagaatgagactctctctcaaacgaaaaagaaataataaacatttttaattatttaaaaatgtgttagaatcgatatctaggtcattgtgtaaaccaaaggccagcaaactttcctgcaaagggccaggtaggctttgtaggtgatatagtttctcttataactagtaaactctgctactgtatatctaatggccctatacacgatacataaaagaatgaatgtggctgtgtttcaatagaactttattcatataaatagacgtggggctgaattttaccctagggctataatttcctgacccctgatctctcccacctcaaggtcttcctattagctgaatacctgccttaggaaatccctcattttctctggctattttctgcatattcttttttttttttttttttttaagcagctttctagcttctctctggaagagtggaaagatgatggggctagcccatagtttctcaacctgggcaatattgacaatttgaactaggtaatcttttgttgtgagggagtacattatagaatgttagcagcatgcctggcctctacacactggataccactagcagcactgcagtcatgacaatcaaaatgtctccggacatcgtaaaattacccctggttgaggagaatcaggctagtccgtgcacaatatatttttaaatttttctttagttcttcaagagccttccaggtgaaggaatggactgccacagccaaaaacaagatggctagcaaactcttctctccaggaaacgtcttcctaataaggcatattttattattttgtcagaaagtccatttctacacctttcttaatcctccatttagtatttctctttttttttttattatactttaagttctggggtacgtgtgcagaacttgtaggtttcttacgtaggtatacacgtgctatggtggtttgctgcatctgtcaatccgtcatctacattaggtatttctcctaatgctatccctcccctagacccctacccatcgacagtgtggtgtttccctccctgtttccttgtgttcttatcgttcacctcccactcaggaatgagaacatgtggtatttggttttctgttcttgtgttagtttgctgagaatgttggtttccagctacatccgtgatcctgcaaaagacaggaactcatccttttttatggctgcatagtattccctggtatatatgtgccacattttctttatccagtctatcattgatgggcatttgggttggtttcaagtctttgctattgtgaacagkgcatattcttttttttttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacccgcctcggcctcccaaagtgccagtgcatattcttaagggctcagcttaaaccttacctgtttgagtgtaaggcagagctccttgatctgcataatagattaagttccagtgctgtatttaccaaagtcccctctattatttccctattagagcattcattagtattaactataatgactataatgacttgttttacctttgaaattttattaaaattattgcaagagcacttttttaccttccaatgcccagtgcttcagtacttactcagagtgcaggcacatttaaaatatttgttgaatgtacaaataaatgtttaaaaggtttcacatagactaggttgcaaaatccatagcagacactgtaggtrctccacctatatcctttccttttaccattctggggcatactggcctaatttacttgcagaagaacaaacacattctgagaacagycaggcctcaaccaaagaccagcaggagcaggtgcataaataccccaactccctcacccttcgaatgcgatgastctaaggcttatgttttaaactggcttccataactcaccagcaggattcagttctagttatccacattgacagctgatttgataacagccgttttgttggctgctttccctgccttatctcatttcctattctcactgtcactctcattcctgttctcttattctcatgtagtgctcccatcaccttccacatcaaccccgcacacttgaatccttgttgcaaggtctgttcctaggacagcaaagcataaggtttccaacaaccctgtgagatgtgtatcatcacctgtattttaaaagtaagaagtgcagggcagagagattatggccatctaccaagtgcatcgaagaataggcatctaacccagacctctggctacaaactctggacatcatccagttcaccatgttgtttctataaggtgttcaactagtgtgcgttaaatgacaagatggctgggtgtagttctgatataaactcttcccaaattcaaccttgaattcaaatggtttctttctagtcgtagtatggtaccaaatagataagtctgtttaggtaagaattaaatgtaaaaaaacacaaacatttaagttcattggattgtttccccttaactgcctgtgccccttaaatgctaccttttcctgatcctatttgaggggggaagtatcttttgaatcccagacttgcagggacggattctgcatggcctgtacccttgtttgcagcgattactctgctcagaggaggatgacctgtgtggggagcctcttcagctacttgaggcactaaccctctagcccaggaagtcccwttattgctgggccctgccataagcttatttgtatttcacagcgacttgcacagatgtgccagatatgtacagatggatttttatcagaagagagtctacccaagtgaagcagtgkagggtgaggctaaatcccaaaattgaaatttggggacactgattaggcacagagcaggaccaggggttaaaaccatgtgggaaacagatcaatagaatggaggaaaacagtccctgaggaggaccctatgacagaaatctactatagagaaacggcctgggcagaccaagcataatattcagtggagagtctgggtgtgagagctgtgtttgggtgagaagcagggaatgattgaaaggtaagacaagagaaaacatttccttttgttcattccatttctgcagaggctcttgtatttctgagtcccattttgaaagtcacacagcccagcatctcatctcttctttagccgaaaaacatactgcattagctgagtctccagagcaagttgttgctagccttgggacctggggaggttatttcagctgtgagtacctcacttccctcacatgcaaagtgcagtagtaacagcacttccatcctatggtagctgggacggaaaatgcataactccatgtgaattgccaaggatagtgcctgtcacgtggtaagcatttaacacatagtagctgtttttaatattatgtgtggtagattggcaccattccatgaatccaagccatttgggtatgataactgaactggttgtcaaagcaagaatcagccttgtgtttacaaccactgagaaagagcttgtcaagctcttagctgaaatctgtacaaaatatctgctgcaggtctctacctttttaccatttaaggtccatgaaggaaaccaggtcactcaggcacaacctgattttaatgaaccctcgtaggcgtctaaagaatcaccactttatttttttaaagtgttcaaaaccattactttaatgatttgttctggagtctcgacccagaacaatgtcagtctcgttacagaatctcagaatttactgccactttttgaaatagttggagatactttctatcctctgtctcagcatttctgccactcttctggattggatttatttagaacaattaaatgctgtcttacaatctctttccccaacttggggtttctcttcccttctaccaacgttcactctgcattttcattctgatgctcatttttcttggcattttgtctggagaagtttgaagcagagcagatgctcagacggtctgcatccctcctctttgccgtccttctcctttgctcacctgcaagaatcaggctttacgwttcaactttctgttccaaacatagctttaaagcctgtttgggtgtccttagaaatttttctaagtgtcagctcatatgagacacccgctccagatgtcttgttttcccactgttcactgttcaatttaacaaaacacatattaggcacctactgtgaggcaggcattgtgctgctcttgaaagatacaaaggaaaacaaggtgtagtccctactttcaaggcgctcacggtaaagctagaaatgtaaacaaaccaacacaaracagtgtgcaagaatcctgttaaagacctgccctcactgaactgtgcccctccacctggaggctgcagcgggtcaaggatggcttcactgaagggatgatatttgaacaagavttatttttatttctttttattcttctatcccatgacatttccttttctagtctcctaggcagccatcaacaaggtgcacaaatatgtctttttgcttatacagtagtcatacaaaatgcatgttgcagttttgtactcagctgtttcattgatgtaaatgatcctgtgtcacatactcacacaccttattttttgctttccctctctaagcatttttggtttttggttttttttgaaacagagttacccactgttgtccaggctggagtgcagtggtgtgatagctcactgcaacctctgcctccccggttctagcgattctcctgcctcagcctcgcaagtaatccctgggattacgggcacccactaccatgcccagccaactgttttgtttgtttgtttttgtattttcagtagagacagggtttcagcacgttggccaggctgattttgaactcctgacctcaagtgatgctcccacctcggcctcacaaagtgctaggattacaggcgtgagccaccatgcccggcctaagctttctttgtaagatgcattcatgtcagggtgcaaacatccaggctgttatttccattcactgtgtgtccttgcatcttccacatccttcacttttccattgtctccatgtagaatgcccacattgtctctggttcccaacaccctgaataactgcagcaataccctttacgattcacatgcagatgggtgtaaaaggttccttgscttatatttgcccagaaatggaatttctggatcacaggtatgacaggcagaataatgaccccaatgatatccacattctaatacctagaaactgcaaatatgtgaccttgggtggcaaaagggactttgcagatgtaaytagattaaaatttttgagattgagagatcatgttggacgatgtaagtgggcccagtataatcacaagggtccttatcagaaaaaggaggaggcagaagatccagagttggagagagatttaaagatgctctattgctgtctttgaagatagaggaaggggccaggagtcaaggaaagtgggcagcatgtagaacatgtaaaagaaaaggaagcagatttgtccctagagccttcaagagtctccatgtcagacttttgacctcaaggactataaaataatacatttgtgttgctttaagccattaagttcctggggatttgttacagcggccgcaggatgcccacacataaactacgcccagactgactttgactgtaatggcgctgggtcagtctcagaatggctgtccaggcccacatttctgatagccgcacatgaagtcctcacgtctgcacaccctcggcatcacttggcccaactcgtctttctgatttctttcagtccgatgggtataaagcataaacaagtcttgaataaagagtcagaattccttccaataaagtagggtggttgaggtgagatgggggatggccttggggccctggctgctgtggttggatggtctggtctttgggagaggatgcacaaatcattaggaaagcagagataaggctcccaaggggctacatggagagtaagtggagacaaaacccgtgcgccttgtgaggacacagggctgtgtggactccatggaagagagggccccagacagtggcaggcagtgtggggtcacagtcgtagtcaggcctgggtgtcagtcacagttctgcagctgccgtgtgaccctaggcatgctcttaacctctctgatccttggcatccttctccctgtgacagggataataatactatctgctcataggactgccatgtggcttacatgagatcatgcatgcaaagcccctaatacagtgaatggtatagagttggcacccaacaaataatcatcgtaatgatactattttcattagcacaataattgtaataataattacagtttcttacattcctcaactccaagaaaattggatttttcttgtaatctgcaggatccattgctgaccttgctcttctatctggagaataatgtattgcaatcagtttccacatatttatatgcaaaggcctttatatattattttcaaggagatcttcccctccttaaccattgcccttgtctatacccccatccctgaaaaatgggggtttccttttagggcttttaacagcataatgcagttgaatacaacttattttactgacatctctcctccaagcrctctcccccagcactttccaggactaaataatgcatgaagggagagaataacagggattgcataaacgacggaaaacagcacggtaaggattctgtgttgtgaagagatgaaagcccctggtcagaaggccagtaacaaagcaaagaagaaatgcaaaggcattgacgagggagacaagaaaagtatttttcaagataagatttgtggagagttaaaaaggagatgactcaggagacagtcaaagactcttcattagacaggaactccagagtgggtacaccagggggcctgggcttttgaagggctggggctctgaagaagttaacaaacaccagctccacttcctgggcctctgaagccttctttgacgtgcccaggtgggggccgattcttcttgcttggtgtcctatgcctccctcttcctacctttattagagaatgtatctcactcaactgtaacggtggattcctatgtcctttttcttcactgtgctggagctccaggcgcttttccagttatcctcatgcttttccatcttagatgcttttccagttatcctcatcatagattaaaataataattgttggtcatttagtctgtccctgtgctaagtgctccatgtgcattagataaattatgcctcaagacagccccagatacccattttacaactgtagaaactgaggcaggaggagattgagacttgcttgcagatgtgcaaatggtggagaatgtaggtgagattggcactgaggggttcagactcccaaatagggctgttgagtttcttttactcccaaaaccaagcacagtgctgagcacgaaaatgcactaagcaagagtttgatttgtgaacacattattctgcctggaactcagctagctagccaggtggtactcggagttggcatttctgttgctcaggccgggctgcatttggtgagttgcgggaaggggatgatgacatcttctccagttracaaaagacaatggcttgttctgaggagagggcctggaactcttggtccatcagtctggctttgtcctgtctattatacacagtctaatcacccccaacaaatggtgctaggaaaacgaaaacaaaagctatatatttcctcttatagaatttttaaaacaactaaatatacctctggaatacactttacaaatttatgctaaaggcttccacaccaatgtggctcctaagttcccaaaattgagctccattttgaattgcccttggccctgctctctctgggattgctagagagttccagcatggacccagtgtcctttgtgggctgcagagctggacaacactgggatgagtaaggcagccaaccctcagccctgggaggcacagtgagggccagggtattaaccagaagcttagtagtcattttaccatcagcattaagtcacccacatgcacactgatatggtttggctgtgtccccacccaaatctcatcttgaattgtagttcccataatccccacgtgtaatgggaggaacctagtgggaggtaatttaattatgagtgagttctcacgagatgtgatggttttatatggggcttttcccccttttgcttggcacttccccttgctgccaccatgtgaagaaggacatgtttgtttccccatccaccatgattgtaaatttcctgagaactcccagacctgcagaaccgtgagtcaattgaacctctttcctttataaattacccagtctcaggtatgtctttattagcagcataaaaatggactaatacagcaaattggttctgagggagcagggtgctgctctaaagatacccaaaaatgtggaagtgactttggaactgggtaacaggcagaggtaggaacagtttggagggctcagaagaagacaggaaaatgtgggcaattttggaacttcctagagacctggaaggctcagaagacaggaagatgtgggagtttagaacttcctagagatttgttgaatgtctttgaccaaaatgctgatagtgatatggacaatgaagtccaagttggggtggtctcaaatgaagatgaggaacttgttggaaactggagcaaaggtgactctcgttatgttttagcacagggactggtggcattttcccctgccctagagatctctggcactttgaactggagagagatgatttagggtatctggcagaataaatctccaagcagcagagccttcaagaggtggcttgggtgctgttaaaagtattcagttttatgtattcataaagacatggtttggaattggaacttatgtttaaaagggaagcagaacataaaagttcagaaaatttgcagcctgacaatgcaatagaaaagaaaaacctattttatggggagaaattcaaggctgttgcagaaatttgcatcagtaatgaggagcaaaatattaatcaccaagacaacagggaaaatgtctccagggcatgtcaggggtcttcatggcagcccctcccattgcaggcctggaggccttggaggaaaaaatggctttgtgggccaggcccaagtctcccctgctttgtgcagcatgggaacttggtgccctgtgtcccagccactacagccatagctaaaagaggccaaggtacagctcaggttgtggcttcggtgggtgcaagccccaagccttggcagcttccacatagtgttgagcctgcaggtacacagaagtcagtaattgaggtttgggaacctctgtctagatttcagaggatgtgtggaaacacgtgatgtccaggcagaagtttgctgcagggacagaacactcatggagaacctctgctagagyagtgcagaagggaaatatggggttggagcccccacacagagtccccactggggcactgcttagtggagctgtgagaagagggtcaccatcctccataccccaaaatggtagctccacygacagcttgcaccatgcacctggaaaagccacagacactcaaagctagccatgaaagcagccgggaggggggttgtaccctgcaaagccacaggggtggagctgcccaagatcatgggagcccacctctagcatcatcatgccctagatgtgagacatgaagtcaaaggggattatttttgaactttaaggtttaatgactgccctattggattctagacttgcatggggcctgtagctcctttgttttggccagttactcccatttggaacagatgtatttatccaatgcctgtacccccattgtgtctgggaagtatctaactggctttggattttacaggcttgtaggcctcktctcagatgagactatggacttggagttttcagttaatgctggactgagttatgacttttggggactgttgggagggcagaattgtcttttgaaatgtgagtacacgggattttggagagtaggggcagagtgatatgatttggctgtgtcctcatccaaatttcatcttgaattatagttcctgtaatccctacatgtggtgggagggacgtggggggagacgactggatcatgggggtggttaccctcatgctgttttcatgattgtgaattctcatgggatctgatggttttataaagggcgtttcccccttttgctcagcacttctcctggatgctgccatgtgaaaaaggatgtgtttgcttcctcttccaccatgatcatagtttcctgaggcttcccaagccgtgcagaattgtgagtcaattaaacctctttcctttataaattacccagtcttaggtatgtctctattagcaggatgagaacagacaaatgcacagaccaacaaggagtatgtggtgagctttttcctgccttgcttttttgaaagaggaaaacaataagatcagaacagattatcactaaaattggcagggggaaagtgtggcacagtcattagaaaaaactggactttggagaccattttaggaaatcttggaatactagcattgtttggggccacttccttgggtcatgtttaagtaagatttgcagcagcccatagatgactcactgaaatttaatcattaatggaatattttataaaggggcagtttataaatgcatagttgaagtacagggaaaccacaagggatggcaccacccccaggggctagtgatggcagggacagttatctgccctggtctgaagggttaagaggagaggagggagccctctctgaagtggagacagtgaggtgtgtgtgcagaaggccacctgacgtgtctgagaccttcctttgagagatacagccagccctcagtgacccagcagggaagaagcaaggataaacacctgattccttttctccctgccttccctctgtaatgagttttgtctgttggtcaaaactagagactcacagagtgctttggctgggtccgtaaagaccaatctccagggaccaaagaaaggtggtgaagggaggagctgggtaaacagaagctatccagcctggttttcatctatccagagctgtacacaagatggtggattgaagatgattaaacacaacacagtattataagttttagaggaccaaataatgtactttaaaactaatgcaaatgtgatttttttgaaggctcatttcatggtaacactgtgcggagctcttaagtcaaacatctctttcaatcctcccaacaatctaggaagataagttatggtctccgtgttctctagtagaagaaacagactttaaagattttggtgacattttcaagcaaactaccatatacagagtcagagccctcaaactgtgaactgtatccttttggggttgcctttgtccccaagaacctccttgtcttctctggtcctcatttttcaacacagtcaagaaaatatctgtttgtttcatgactgagcattcatgagagccaaaaggaaacaatgatttattaaagtgtctatgtcaggaagttcttattggctgctcccgttgttaattgagtgtcttgaaacccttctggtgctttgtaattagtgctccaggacaaaacatgctgctgcttttttctcatcccctaaattttgccatttcagcacaaagggagctcaggtgcatcaggagccccagcctcctgcgactggmctgcatacatacaaatacccattctaggtggtttccaaaaggactccatttctatgggaatattttccattgagctgtttawgaactttcacttagtgattaaaaaattattcaaaaggagggcaatagtaataaacttccactttccgtttcaccagcatatctcaaaactaaattaattatcagcctgtgtgaataaagtttgtgtcctgataaatgtattccctcaagaatgctcaattcacctttccccaggtctccagctcacacactgcagtccaatttcaaattcttccgtctcaccatgaatctccagtcttgaagcmctctccttgamcccctccttggagggtgatgtggtaaatcaagtcagctctctgtgaatgtctcatcattctccacctgccacagcaattttgccccctctgctctcctcctggggtaaagagtctttccttgttagggcttaaccctttaaactagtcttcccctgctggtccaggcaaggagcctgttccagcatttggttctttcttctccatcttcttcaggtgttctccttccttctttaggtcagaaaagaaattcatgaaaaacaccataaaataaaattttaaaaaatccattttctacctttcttgcaagtgcttttatgtttctatgcatctcctcacatgggatgctcacattcagcctttgctgcaacattgtgccttcctttttgaatgttctacccaattttctcccgtaagcccttcaacagctaccagtggcttcctaatgaccattcacagtgtatgcttctcaatctctgcagcttcgaacactgttgactttcttcctttcctaccccagccttgaaataggtatccatggcaaaacattcagtccctactcttaaccttgctgtctgaatgctgttgcttgccattggactattctggaacaggaagtatagcattctaacagcatggtatatgaagccmtatttccctgaatcaacttctagttttagcacttattagctaataagtgtatgatcttaggcaatttattaggaaaaaaattaatctcagtttacccaactataaaatggagataataatgctttgtaggaaggtatatgaattaattcatataaaccaatttcacaagctctgtaaaataagaatttcttcttattttataaataatacttatcttataaataataagatgttatttatgccaataatatctacaagttgacattttccaatattctgcttttagaactgtattaggttcctattgttgtattaaaaaattaccccaaacttagtgacttaaaataccacaaatttattatcatacatttctggagctccgaagtcctaaaaaatctaaagtgtcggcagagccatagcggagaatctgcttttttgcctttttcctgtatcccttggcttagggactattcctccatgttcaaagctgcatttgcatggcttcaactatcagttctatgtggaagattttttctgattttcaggccagtctcatatccccagagaaatgcattcttatccccccaactatttgccattgaaagtaatggcaaaaaccaccattagttttgcaccaacctagtagttgcaggtcgtctccctgtggctgcactccacacaaatacaagtaaacgcatcacaatcctataactaattctgttccttgtcctgatgagcttccttctacaaatggccctaatattccctccmtttcccagtatttattgagggatgaagagtctttctgtcaactttcagtgagaagaagtaaataaaacagctttgatggatacccccatgaacckgagtgaaagggatactcctttaaatcatagttatttcgtttgctaagcatggtggccctgagaatatgcctcccagagcctccaccacagggaacacgactgacatgtgaccccagatgctgtactctgaagcccatgacagtatttgggctgacgctrtggtttttattatctttcctcaccaaagacttcagcaagggagggatactaaggcaaatctgtttctgggaatcttcaaactcattcaacagctgatcttggctccagggcttccatatggccttgcaggacctttcttagactgcagagaagtccagaacactttttacttagccttcctttcctctctccttcactcaaggtcagattttcatctcagtttgatagctctccccgctcctcccagcttygtccccattttttctcacccggctgtttcccctaatataataattggtcttcaattttaacttgcatttgctcctcaggagatctgaacttatatgtcatagtctgagtttggagggttgaagggtcaagacctgatggtgaagcccacttcctttgagttccctggattccaggaagacagaatttacaactgccagtaagggagcaaccagacgatgcaaactccttggcaccaagaagagaatgtgggaggaaaatgagatgttttagaaacaacagaggaatctgtgagacagggctgctgtgagatgatgtcacacttgacataaattgacagttaattgcctggagatttgggaacagttcagsggtgtgtgtatgagagagattgtgcataccatgaacaatggacacaaatatatatgcctgcttctgtgttgtgtgtctctctgaattagtgttccctggtccacttcataggatatttcaccagcacctgggactgactgtaagggggaaatggatttgctcatggacctttcagcagagggaaaaatgggtagaagcttctaggaagcgggaataatttcatgtaaagagggcttttcctgaagacacctgacagagtgggtagctggaggcatatctgccatagatacaaggactttctgccgtgggtgggaagctggactgggaagcccacaagaccttccacctcagacagttgtagaaattcaaaagtcccagcagttttctaaacctggcaggtcacttgaatcacatgggaggccattaaacacaccccaratattctaaatttggatttcaagggaagggcttgaaaggaagagcaaggaacctggataaaactctaaaaccttctttcccttgcaattgaattagccagcctaatttgaaaaccacactgctttgttgaacagaattcccggaaccaccccagacttgaagtatcattcagctatgtcttcacatgggaaatgtgttgtgctatcagaagttgaattgcttgtttcaatgtgtttaagacaatgtacctccgaatctggcaggaatgagtttaaattctgactctgctacttatcatctgagtgatcttgaataagatattcaacttctcagaacctcagatttcttcgctgtaaaataaggatggtaatgacacctttttcctaaatttactgaaattatcaagtgggataatgataacagttaacattcattttcaacttgctctgtgccagtcactatttcaactcatgtattagctcatttgtttgtagcaactgtctgaagaaggttcagctatgattcccgctttacagatggaaagattgaggcatcaagaggtcacataacttgctaaggtttgcacaactaaacgggatacagctgatatttaaacctaggcaattcagtcaaaatctacttttcaggatagtatgctttatacacacatactatgctatgtgtgtataaagcacttaacccagagcttggaacacactatgtgctccataactattagctaatgttataatcactgcttttaccctgggacttacagtgaattgtcacaactctccagcatctgcaatattcctacttagctgcttgcaaagccagaacacctgtgtcttcatgccctctcctttttgtgcccagcccctgtctcagtgatgagcaggacagcatgcatggatcattaacttactgagactgagaatgtcaaattcaagacctgttgaataaggtcagtaagtaatagtagttgctgtatttctcataagtgttgaaaaggaatccttacagaaatacattactttaatcctaatgtattttgacttcttcaggatgcacaggtgtccagggaactgtagtgtcagtatctctgagaccttaggagaacttcttttgaatctaaaggagggggagttgaaaggcatctctattatagcaaaaagaaattagagggctgattcatcctattctgtagggaaagcagaactctgctcagagatcttgaagtaagtaaaacatggtagttacttttggaggaaaataaagtaccatcgaatgtagaatctgatggtttcagtgaaggtaataaatggtgctttgatgacaactgtattcattagacatatttgtggctttcctcctcctttctcttgcagataaattctcactcaggccctacagagataggtgcgtggttttagagatcatcagatgtgggtttaagatcacttttgccacttcccatatgcgagatcttgggcaggaccctcaccctctctgaaccttggcctcttctttctgaaatgttggtaattgatatggtttggatatttgtccccatccaaatttcatgttgaattgcaatccccagcattggaggtgggacctggtgggaggtgactggagcatggggacagatttctcctaaatggtttactaccatcttggtactgttctcatgatagtgagtgagttcttatgagatctggtcgtttaaaagcacatagcacctccctctttgctctgtcttgcacctgctctggccatgtgttgtgcctgcctccctttcaccttccaccatgactggaagcttcccgaagcctccccacaagcagagcagacattggcatcatgcttcctgtaaagcctacagaaccatgagccaattacacctttcttctttttaaactaccctgtctcacgtacttctatatagtgacgtaagaatggactaatacagtaatactcttacacttattgtagagatgttgtgggacaacataagacaattgtaaacacagtctgtgcctgcaagttcagccaggcactctgtagagatcaatactgtccctaggatgctgtgaattttcatattggtacgtctgagcctgagtaacacttggcaaccagagtgagccccagaactggctcatgtggaggtcagtgacaaacctttgacatttgatacaatcaamaccaagccgctttgtttaaaatgctcatcaaatacctaccatgcacactgtgtatataaaagtcattgtcacaaaagccctttttcagaatctctagcttgccatttctctcagatttcttattgtcctctgggtcaaaaacactgcaaaatttcattcctttaccacagcaagcttttatttctggtgtacacacccgagtgttatctggaatgtggctgctctaagctgggcctctgctggatttaactctagactattggttgagctaaggtcttcttcctgtgtctcttatttttctagggatagcagaaatgaaagaggcaagtccaaccacacaaacatatctcaagcctttgcttgaactacatccaatagtacctgctggtcaaaccaagtcacaaggataacccaactgtaagaccatggcaaggtgatgaatgtctacaaataccgcaaatgggtgaagaattgagaccatatctcattctgtcatacctggaactccaaatttcccagttcttttaaacttttatgagttaggtactttcaagttgtgtaggacagactcacctggtttgggtgarttaagtctrtggaaagggaacagaaaacatgtgaggaaacacttatcccatctattccatcttatcttgatggaattagaatttagggattcacttttcagggacaaaaagcattcaggaaggtgcctcacacaaaatggctactcaggaaatgtttatggagaggacatgtgaatcagtgaggagcggctgtagcactggtcaccttgccgttttcccagaagtagcctccattgctccctcctctgtggtcttcaatattctcatgattcaacttccctgtcttctttggttcttccagttactgctgtatcccttaaactcgcccaaaaggaaggattgtgttgcattaattagctgtctttctatctactgggcagagatcttatgatatgctgcctcattggcatgaatcagccaatttttgttttgttttgttttgtttgtttgtttgtttgtttttgagactttgagatggagtcttgatctgtctcccaggctggaatacagtgtcacgatcctggctcactgcaacctcctccttctaggttcaagcaattctcctgcctcagcctcctctgtagctggtattacaggcccctaaaaccacgctcagctaatttttggattcttagtagagactgagtttcactatgttgaccaggctggtctcaaactcctgacctcaggtgatctgcccgctttggcctcccaaagtggtaggattacaggcatgagccactgtgccaggccatgaatcagccagttttaaaaggcttctttttaagttgctggtcactggttgaatcgcaaagagtgtaaggaccatgcaaggaattccctatggctgcattcttcagcaagggtctgtgggttttgctattgcttagagactcaaggattttgtgttgggttgccccatctcttgctttgtgattctgcctcttgggatttggaaaggtaacctggatctagcacagagaggtctttctccctttgaagtgttcatcatgatctgatgagtcaacagtgcctcgtctcattgtttgctacactagctggctggaacactaccctcccagcagagcactccctgccagagcatgatactgccactgccaattgaagcacggctatgtttttacatcttgtagcaataaccctccttcctcaatcattgaagactgatcagctgggccaaaaccaaagcaatataacccagggtcgtgtgtgtacatgcatatgtggtgtgtgtatgtgcacatatgcatgtagtgtatatgtatgcacatgtatgtaagagcacgcacacacgtgttctttttaatataaagaaatgcctttagagaatgaaatgcactgggggcatccaaggtgaggagacttgagggaatgttttttgttttttttcttggcaaatcagtgaaagatgggcagataagtatggtgaacccctagtgtgaagtagagaaattggaggctggagttatagaggcagatgttgaagaacgtggaagcttctagaagagctgaaaacgtccatagactgagtaatcggccaggcacagtggctcacacatgtaatcccagcastttgggaggctgaggcgggcagatcacctgaggtcaggagttcgagacctgcctggccaacatggtgaaaccccgtctctacaaaaatacaaaaattagctgggcatgttggtgggtgcctgtaatcccagctactctggaggcccgagacaggagaattgcttgaacccggctggcggaggttgcagtgagccaagatcgcaccactgcactccagcctgggagacagagtgaaactccaactcaaaaaaaaaaaaaaaaatgcgagtaatgaagggcagattcaggaccgggactggatgctcactcagtaggttgctgtgtcccgcaaggtaggaggtgttctgtgggtgaaaggcaaagacagagaggacatcaggtcagaacattccaagtgagactctacgttccttgaagactccattgtctcatttctttttatatctccagtgccaaagacctaagtgagccctctggatattagataaataaattaacttattaaaggatgaaagagtgaactactaagttaatttgaaattgaaatatagggtaaggcctgcacttacacagagaaaatgaactttcaaaaatgtacaaagcagacaaaggggagacggagagagagnnnnnnnnnnnnnnnnnnnnaatgggtatccaactgatacctggaacatggcagtgtgagtagctgaaaaaggaaaagacctcaaggaatggggctgtctgtggggcctatatttatgttgacatcactcacaagtacaagtctgcatccctgggtgtcctcagacaagcatatagtttgcatatcgtattaccttttgtgttagtaatcactgattttgaatcttagctgactgtggaggtgctgttctgcctttgacatggcagtgtgagctggagagggatggggagatgaagaagccacatgtcccaggaatatcaggatcctataaacttattctgggtaaggcagtggcaagggtgaccagcaaagtggtgcctgaaggctgggaatccagtcatgtcaattttcttgtttgtttctctctggcaccttctctaggcccagagcctagatgaggctgtgtggaccagtgatacaatggagactttaattttctcgattagtgcagaggatgaagaaatctcagcagtcatgctgtattcaaggtgcagggtattgcctgcttctgttctcaatgctggctctcgtagcttaacccacctatacagaagtgacttgttttcatccccgtcctggccagtgactctttaaccaggcaatgtgatttacgtttagatgttagtttaatccctttgtttcttaatgaagctgcccttgttaaaatccctgggacctaatcatagaaattctctctagccccacgtctccgttcaacaactgcttagcaaatttctcatcagtcccatttttttttttaccagctcccctcaatagccatttcttgtctccaaggttttttgaagcccagaggcttttcttgtcaggcaattctcttatttcagccctgcagtgaactatccatatactgtatcacatcatgattttttttttctctgcaacctctcccttccccttgaaacaacttacctttatctgtgttccaaccccaatctgttgcgtctagaagtcagagagccaactgccaatcattttagaattcagcattttcaaagttcatctttgaaatggatagcctcttgttctgcagaaaagcaaggatcctagaaaaaacatgcaaactgcatttcaaggaggatggcatcatctttttgtttcycttggaatgactcaggagtgaggaaacaggaatacattactgtggttcccactcatcttggcctaccaatctctcccatctttctaggtacagcccatcttgtgatgggctgggacctgggcccctcctggacttacgttcaggatttcaaataacttggatggcagtctagccaaggaagccaaaagcttccatctcttccttgtcgtttgtgtgggttttttggtttgggttttttttttttttttagagacagagtctcactttatcatccaggctggagtgcagtggcacaatcacggctcactgccgccttgaactcctgggctcaagtgattctcccacctcagcctcctgagtagctagaattacaggtgcatgccaccaggaccagctatttatttatttattgtagaggtggggtcttgctatgttgcctaggctgattttgaactcctggtctgaagtgatccatcttggcctccaaagtactgggattacaggtgtgagccactgtgccccacagtatatctttttaaaatgaagactttcttatcagatttcagcaccaaggctcatacatatgttgactcaagaattaaagggctttagtttcatgtgctggcactaatcaatggctctggtttgagaacaattttgaaaccatactcgtctcattggaaaagagggcagtagtggtgcctaccagagatagggcatgaggaagcagtagtagcatccctgccatgcacctgccatccttgatttgataaagtccagaagcacatctgatcacaccatcttgcacaatggccttctcccaagcaacagtgacaacttagatggcctggaaaactatttcaaactaatagcaacatgtctaccaagagtgcattattaatgacacattcaactgaaaaattgatcacacgctcttaggtattacatgggtcacatttgcaataattttggtttttacwgctgaaaggcaaatttaaggtaaaaatcaaatactttaaaagtatatatcttaatatgccttcctcttaacattcatctagtaaggggggagatgtagaattttgatataaattggccagccttrtgttgatttatctttaacacagatttcaactcyttcacttcagttgccatgaactgcaaggcccttgttcagtctggcttttcatctctttcctgcccaagtccaatttagctcttataaaacaaccagactactgcaatccctcatctcacggcaacctccaggacataatatataaaacttacccttgacatgtgggtgggtcaaataagtgatcaaagggcaagtcatgatctgaaagcatggtaatctcaagcaaccgctgatgtgaacattgcgtgtggcacagtgaaactcaaaggactcctgattttggcaataaaaacgattgtgtctataaactgagagaattatagaagtttgagcacagctgatcttagccttgaacatagttgaggaagagggaaggagaaatttaaaactttaattctgccaatttaacaaaaccgcttcacatcattatctaggatgagagtgatataaagaaatttaccagaactttttccattaatcaaaaagaaggtagtgaatgagatggaggatcaatcatgtcaaaaatttcagaaagggatgaggaaataatttctagcaaattatataataaaagtatgtttccactgaaaggagcattgaggaagaagaagagtatttcgtagaagtgaaacggcactgattaacctcattaaggacatgacttcctcatactttaataggaagtggtaaacttcagaatgagaccagcactatgttgaagtatgtcctagtccagcctctgttgtgagctagctgggaaagcatggccttatctgtttcagtatccttatttgtgaaatgaagagcttggcctgaaatcagcagctctcaaattttcgtgggcatcagaatcaccaaggatgtttgtaaatgtttttaaaagtcaattttcaagactccrttaaatggagattttgatawatacaatcagagttaaatatgtgtatatataaaaaatatctttaagctagagtctcttatcagtgagactttgggctctacgtgcagagagactggtttacaaccagtcaaggggcagggtggggatagaattcagaactttagagataatctaacattctcagagactagaattctgcagtgttctggaacaataccccaaggtcaaaaagctttaactaaatrtttgtatgatcaataaattggtctgatttaaaattagcctataaagacattttttaaaagcaaatgcttaacttcaatactacatgacaagagggtgatatacaaaaaawagttactatgtggttcttggcatcaagcagattaaagtctactttgaaataaagaccataataagtagttgaccccataaaaattaagcaataatgggaagaagttcagaggaacagaaaatcaattcatgctgagatgataatcaaattattggtaaaaatgaagatgctggttaggcatgtccttggctagagaagggctcaggcttgcaggtttaatgacctttagctgagaccaccccacgtgtccatctgcctcaggatactctaagtctcgtggctgaagcaaagtcttccttaaacagggcttccattgggccatgccagctattttgtttgtttgtttcctcaagacttaccaggccctatcttctgattccacctttgatcttaggtaggttaattcagttaatatattactaataactgtctacactctttctgccctcgatatctgtttccttctgctaacattttatgactattctttgtgggttaatttcacattttatctcccaaaggcagcccaagttccctcctttccagatgtcttgggctctcccaccgtagagcattggtgctgcctatactgttgttcttgatttcagagaacgttctacatcatacagatgcttacgcttattaaactactgatttaagttgttgcaggttttgagttaccactggcttttgactcagttgaaaaaaaacaaagaatggtccagggtgagagaggtgtgtaaattgactccgtgaggactctaggaactgatctttgacttcctcgccagcctctttgccaagcccaaattcatcatcattgtgaagtagcattgggccatgtttaagaagttttctataagaatttattttggattaatagcaaataattgcagctgagtcagcattaaagacatgttatatcagactgtgtctgctagttcagaggatgctgcttctcggatgggacttagctgaacacgtgttacacctctggggaagtgtctacagcattgtaccaaaaaacacagaaaacaggccactgaaacaaacaccagcagacatagcattggcaggatctaacaagcaggttttcctgaaacgtcattttgacagggttatagtcaggtggaatctcttaactgcagtggtcacctggtgcttcgttctttggtgcacagagagggggctgcagaggattaacatggaagaagcaagcactccccctccgttgttacccctccctgcaagatcctgaagccctgattctttccccatcattatatcccttttcaggaacggaaatgtcttctgcagagccagcccattccctctggtgctggtctcaggggaagtacagcatctggctcccaccctccatctaattacccatctgtttgtggggagggaagggatgttctattccccttctcttcccaaacattttaatgtgctgatgcatgaagacgacagcagctgcacctcagaacccatcctttgtgcatcacactcactggcttagcttttctgttcagttcttggatgggcctctttatagctagagacccacgtctctaactcctcctcatcctgacttagtacaaccctggcccttgcattagactgctccagattccatgttgctctctgattcagcatcatcaagcctcagcggggtgcctgagaccccctacctttagggaggggcagggatttccctgctctgctcttggcctagggcttctatcagctccagcaaagagaccatggagagcgtagcctttcatcgtaatctcccaacctttactcagctaatggcccctttggttatttctctctcactctggaagccatgtttagaaagagctgatatactgaacaaattgcacttaataaatattcacttattttccctctttttaaaaattaatcaagttctttgtaaggaagaaaaacgtattagtctttgacaaatgaaactaccaatctccattgatacctacgttgatagtattcaagccccaaacaaacacttcttagctggctcagatgatctggttaaggggaactttgtcagtttagttcagctttgtgaaatactgaaggatttcagaccactattaatacctgagtaaagtggttaagagaataactttggacatagagacagatgggtttcatttggccacatactagctacatgacctcgggcaagtttctgaacttgatgcggctccatttcttcatgggtaaaattggggtaattatactattgatcctgtaggattatcctgaagatagaatgcataatgtttacaaagcacttggtacaaagaggcataaagcaagaagtgagtaaatgttaactgctgctatctttattcccgtcattttaatcatcactatcaattatcatcacaacccaagtggctcagggatggagagaccccaactaggaccctctctccattctaggggaaacatttattcaactcaactgtggccagaactcatagtgaatctcgctatagtcatcctccgttttgcaacagcagattttgctgggctcgtggtcactcagctaaagactactttctccagccaccttgcatctaggtatgaccatggaactgggtgatggccactaagacatgagtgagcgtgatgttagcacattaatccatgcctttgaaaggcaagaagtctattttcccttcctgtttttcccttcttcagctgaaacgcaaacgtggtggtgaatcatcttgaattaagctgaaaagggtaacatggaagagatggcatggcaacaggatgcatccccaataccatcaagccaccattccaattctggactgccaacctagactcttaaataagggagaaaaaaagtcctttttgctttaaactactgaatctgatatcacctattataacaccatggtgtatcgtaaaaacacaccaaacaactattttcaaaatagatgtgatacttctccccagttatacaacttctggaagcaggaagccactgcattcccccacccagcttgtcatggtttacttctgattggatataactagatgataacagggatcacgctgcatccattgaggagaaagatgattcaaccctctcgcgggctgctggggaatcgatatcgtttaattatgagaaagtaaactgtgtttacattttacacagtggcaagaggaaggtcaaatcacaatcctcataccctttatcaaaaccatgcatcgctgtttgtcaagtgagattcaaaatgggatgaacttggagagttgccatcttcctgttttctcccttgtttgttcatatggctgtgctttacaagattaaaaggcttaccgggcaaaagcatagcagaaggaagtaaaaccttcgggcagatgaaataattcttccattttaggaaaaaaaggcaattagttatttgaggttttctgggtggggcagtgagtagaaggtcattatgttcctttcctgttgtatatcgaaaatcagttgagaagtaatgaaaatggtaagaaaaagaaaaaaaaagagtaaaccctcttcctctcccagtggcctctaccccatgactcatcagcttcctgaactggaacaacactgagctttatgactacagaaatgtcagctctgagcacagtgcatacttctttgtgtgaagatcttaggcggttgtgcaaaagccagcccaggacccagcatggtcctgctttatctctctgccgggctagtctccatgttcattagaaatgtgtgatttcttgacaagcactctttggatttgctgcagagtcaggtgatacattgaaatcagcaaaaacattaatgatagcaacaacaaaaacgaccttgtttaagttttacgccttataagggggcaatgttagccttgtaataaaaatgaggtaactgcaacttggaaatattaggaaatttatttaggnnnnnnnnnnnnnnnnnnnnaatgtgtaaactcacagtgctcagtattgtgattgaccctaatacgttttcactaattgttggcttcagggctaggactagagtgaggtgaatgaggtactctctttgggtccaaatttaaagggatacgaaaaatctcagtaattaaagtaaataatatttaatgcaatattttataaaaataaaaattagtgcaaaaatccatggtaaacaaaatgtcaacattttaaataaaggttctgtacatgcacaatatattctatttaccttcccctaatcccacccagttgtctcagctaatggcaatcttattttatacttgatgaaacaagcctgagcccaggttgttcttatccctgttytataggtgaaaatactgggcacaagagatttttccacaatcacatagctaatatatggaaaagctgggatttgagctcagctatatctaacatagaagttcagcagtctatctggcttctaaggtaagtttctgtcacaacattaaatattcagtatcattttctggrctatttttaaatggtagggagtcaaagagattaactaccagttgcagctcttatcaggccaacaatatcagctaaggtgaatctgatactagtagaactctaagaatgtgcatttattaagtcactcatataaataatatatttaacctacttagaaactctgtatagaagatatcagtgttgtatttcataaatagagaaagagaatctcagagttgagcactcacagtcatggycaattcatggcagagttggtgaccagctcaaattttctaggttgacataatcctgtcctttctatggcttcaaagccatccacgtttgtctcttgatcctggaactttttatatttcgtcatacagaccttcctaagatcctcactttgcttgtatcattttccctagaataactattttctaaaacgcattaatgcattgattttaataacatcttgtgtcttatgtaattttaaaaatcagcatatattgactgaagacattttgacaaaagagaaagaaagaacatagcaaaaaagcatttccaactttcataaataagcaagagtatcactttcgtgaagttcttttctattttgttttgtcctgtttttttatagtgacatgtaactttttctttttctggacagcctgtcctcttggtgataataaagcatgatgataaaacaaatgagatctcactactagacttttctgtccaggaaatactcttgacttcatctgtcctcacctctgcttggaccttgtttcatccaatacctcatgccactctcagctttccaatttagatccttctcttgggtcattctcctctgctatgaattagcagacattgatcttgtcctctgacaagtagttatcagcagttattcataaatggatttagtatgttccatatccttagaataacatatacatataagcaaaaattaaatataatcttaggggtttcacaggctcccctaaatctcattcatgtacgccttaagcctgacttaagaaacgctgccatgtaatttccccttgatcctttttttttttttttttgcagatactgccccttctcatttttaactttcaccaacacttttcttgttaaagaagctttcattctctgccgctgtaattttccttacgcacatgaatatttatcttaatcaagtttctcctcccaagaacatcccttcagacaccaaaacgcgtattcttccacgttccatcagcagaaactttccttcatttgatacttgaagtccatcgctctggtgaaagcatccctcttcttgtttttcattatgttacattctttggacttgtcctcttatctatgtaccttgtaacttccatttagccctcttttctctttcaacttccttattgtagatactycttaatgttactagcatttaagttgtttttttyccccctcctttgtcagtcycaaagctcctatggctcaactgttggtgcacataaccttagggaggtgatttgaagaaattttaccgaaatgttgtatgacaaactccvaataacaggatttaagagaataccacttgttcttaccccttcagttctcttaacagggaagaaatatcatarccacataacacatgtttatatatatagatatgcccttacatcaaaataaattcttgatgataccaagatacgtgttcaaggcaaccataaaacactggaaaaaaatcaatcagaggtgaattttttcttatcttatggtcaggcagagtttaagcatgacaccaaaagttaaaataagctgaaaattgatatcattggctacataaaattttaatgcttctgtacaataaaaactgtataagtattaaacaaatgacatgtttaaaaacacagtttgcactatatattccgaagggcaaggacccctctccagcagctgtcgtccagcacatatttaacgtttccatatatctctgtcctcatcaataagatgaggctaatgacgctgcctctgcggtccttctaagaagcagatgggataaaagagtgtgcaccagtagctctaaacccgggacaatttcaccccctgagggcatttggcagtgtctaatgacatttttggtggtcatgctgggggatgctgctggcatcttgtgggtagaattcagagatgctgttaaacatcttgcaatgcttaagacatccatgcagaacaacaacaacaaaaaaatatcctgcccaaaatgtcaatagtgctgtggctgaaaaaccctggtctatacagggtggaggatgttgcggagcgtttggtacctggtaagtgctcagtaaatgtcagtcatttttacatcttattgggcaattctatgtaaatgccttgtccctaggaatatccacaggtttagcttatttttttttttttttttttttttttttttttttttttttttatgaaacaaagtttttccttttgttgcccaaannnnnnnnnnnnnnnnnnnnnnnnnnnnnnnnnnnnnnnnnnnnnnnnnnnnnnnnnnnnnnnnnnnnnnnnnnnnnnnnnnnccaccacgcccagctaattttttgtatttgtcgtagagacacggtttcaccatgttggccaggttggtctcactactgacctcaggtgatccactcaccttgggctcccaaagtgctaggattacaggtgtgagccacctcacccgaccccaaggttgtctcttttttcttttctcttttttttttttttttgttttgttttgttttttgagagggagtctcgttctgttgcccaggctagagtgcagtggcgcaactgcaagctccgcctcctgggttcacgccattctcctgcctcagcttcccaggtagctgggattacaggtacccgccaccatgcccggctaattttttgtatttttagtagagacagggtttcaccgtgttagccaagatgatctcaatctcctgcccgcatgatccgcccgcctcggcctcccaaggttctgggattaccggcgtgagccaccgcgcctggccatttatctgttaaggacagaacatgacttgagggacagcttactcattctatgcctatttgcttttctctctttcctcagcgcttttcactctcagctaccccttccaaacctcagctgattttactaccattcagatgtatcacttgtctcctgaaaaacacatagagcttcctttgtgaattcttactgctctacttacctgcttttaatctgtttatgtgagaatgttgtcaagatcttctagtagatcgtaagtcccttgaagaaaaagatgactttatatttattccaaaaaacccctgtggtgaccacacagcatagaaatctgcacagagcaggcaagtaacttacgtttgcttcgcaattccatcttcttaagtcgttcttgcaattgagaatgcatttctagccttctattggagctgcttagcacaagtagtgttgcattggtgtgaattcctccaacccatttaaatgagtttattgtgcattcaagtgagggttattcagcatgttcaagcaaatagtgaccaataatgataatggatattttttcatctcttcctgctccaatgggccagtattcaaaatgccattgctcacatgaaaacagagctgccagaccgtgtccagggcctcagccagggagctgccactttcattttaatttaagaaaaagagaaattgactgggaggtatttatgtaaatcagtagagttctaaggagttatctggcagccatgttaatggatgtgccactctgagaagcgaatctcgcattttgcttctcttgtcagaaggggttctgtgtgaccatttacacctacggatgattggctgtgacccagaggacatttgatgtaaaggatattttgtgcatgtcaatgagtcctgtccaggtggtgggatacaggctcgagacacatgttggagaagatcacttttgactgctggggagctatgggaagcccttccaaatgggcagaatgtgcaattactatctcagtaaatttgtctcaggagagctgtacacctcaggaacatcatatcatagaaaagggaagacaaaaaaggagctcaccttaaaacttccaaccacattccagggactgtttgtatttgactcattcatttattcaacaaatgtgaactgagcacttcaacgtgccatactgtcttctaggcactgaagatacaacagtggatatgatgggttgaatgtyggccccaaaaagatatgtccacatcctaatccctagaacctgtgattgtgaccttctttggaaaaagggtctttgaagatgtagttaagaatctgataatgagaggagcctggattatctgggtgagccctaaatccattgacatgtgtgcttttaagagacacacagaggaacaacactgcaggaggaggagaaggccatatgaatacggaggcaactcttggagtgatgtggcctcaagccaagaaacacctggagccacaggaagctgaaaaaggcaaggggtggaatctcctctagaacctatggaggaagtgtggtcccatcaacatcttgattttgcagcttccagaactgctagagaaaaatttctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagggaatgtgccgtgtaggtatgtggaggaaaagctgtctagacagaagggaatgaaactgcaaaggccgtgacactggagtgtgcctagtgtattggaggagatataaggcagcaaaggctgacaagaccagcattatttagggcttttacttcaatttacccattgacttaacacttatctattgagcatgtaccaaatatattgttttacgacattcttgcaaaagcctggagaggtaggtaacaaaattcccactttaaagaggaaaacactgaatactggtccagcatgactcagctcatatgtggtggtactagaataggaatcttaatttgatgccaaccccagtgtcctttccccaacactggaatgacttatgtaaatatttatctcatttgtaatttgtctgtgtgttcagtcccatatgacagtcttgataagcccagctggcctctgaggccaatgcaaatatattttgagctgagaattgctcttgggcggtgagaggactgtagtttggaaaaggtcaagggctgtggattgccrtctctcatggtgtcttcagaatgtttcagtagctttgtgactccaggtagcattgcattgataatttatctatttaactggcttaagtgggtttttttttttaattttctatctcaaaaatccaggctcataaatagggacagtatggaaaatgctgtatagggagaataaataaatgtataatcaggttagtaacatattatcattgatgcagctactgagcaaggaaaagcaaacaaagaaggagctttatttcatacccaagcaagtatagctcaattgcaaacctctcagacttgaatatatcacattggtcagtgcatatcatgtcctggaatgttacagaaagcagtaatggagagacaggtggatgaactaaaacttaacttacctctctcttcacatagcattagagcacagagaagattactacgacccttgggcatctgtgactactccattcaaaggttccttagaatgtttgctggaagcagttacagaaatgtgaacagggcttaaccagtgtactccataccctaaataattctgtataaataagagcttacatatctatgatgcctctctgtcacttcttttatattctcctttagtttgttttggggaaaattctaagtggatttgctccatgtaaatactgtacttccttatcgtattaacaaaggaagaggtaggagaatcaagacaatcgaatgtgtcagactaaagtagataataaatgctctttgggaaaaaaatattctcagtcaatgacagggaattctgatttgataaggaaattttcttgggttaatgaatgcaactgtagaatactgagtccgaccagcagaaacctacagccccaggccagctgaatcccattccttataccgtgagtatctgtgttcccttgcagcgggttttgtaggagtcagggataaagatagggaagcaggaggaaagggtcatagaatgctgccaaaggctctggaggctcaaaaggaagaactttgaattcacaaaacactatgccagctcagacctgggcatccaaatcagttaggatattggctaacagctgtaataaagaatgctacaaaaacagaagcttaaaccaaatagaattatacttcttcctcataaaccactccagggcagcaaggtaactcttcttttgaatgtcatgcaaggacccctgttttgttttgttttgttttgtttttttcccaagactgagtctcattctgtcacccaggctggagtgtattggtgtgctcactgcaacgtgtgcctcccaggttcaagcgattctcgtgcctcagcttcccaagcagctaggactacaggtgcccgccaccacacccagcaaattttttgtctctttagtagagtttgtctgtgttagtcaggctggcctcaaactcctgacctcaagtgatccgcccacctcagcctcccaaagggctgggattacaggagtgagctactgtgccacccagccaaggactcatgttttgaaaaggctgtggattatcatctcacattatgtctccagcaagttacagcagctttgtgattccaagtagcatggatggagatggcacttgtcatccccagggtggtatcctcattcctacctcctgcaccatagccaggctgtaggaaacagactgggaggaacaggagaagagcatcttccttttaaaggacattgactagaagtttctcctaatgctccctttcattscctgttgagcagagctgagtcacatggctatggccmgctgcaatggaggctgggaagtgtagtttctaactaagtagccaggtacctgaataaaacccagagggtaggagatgagattctattattacaagaagacacaatttctgccagggctttaaccggtggctctacccttcacagctggacattgctggatttttggatgattatttcattgtctccactcaaagattaagtttggaaaatagggaawttttctaccaaagcataggaactccaggccccagcccctcctcactctttctccctgttcattctcatctctttccagttccytacctcctgtaacctgtgggcatactaaagtaccaaggtaggcttagctgcaggcacggtacttccatgattcagtgccccgcccccaccactgagmtaggccactcccaccaacaacctcagrmcttcagatgcccaatttctgtgtagagctttgagcagtgttttccagttgtgaagggcaaaggaaattctccaattatttgtgtgttcatcttctctacctcccaggtaaaaaggagttgtctcaccattatagcttgtttcagaaacagtgtcaaattctcatcacagctcatgcatgccttctcaccagaagtaccctaattggttctctgactccaacaagagagctaggctttttgtttcttttgctttgttttgttttgatttgctcctttaaaaatgtttatggtgagctcagttatttaaaacaattcctggcagaggatttaagaggcctggcagaaattatgtaagcttgtacagtcatcttcactgataatgagtaaatcagatagcagacattaaaagattaagcactggtgtttggttttttggttggttggttttgttcacttgtttttaatgttgcaaaagtccttcatatgtcattgacaatagaatttaagtatttttgaaatgtactcagttcagattcamcattacatttcatgtccttaaggttggtagcttaagatagcttgtgcttcagttgcacaatactggcgtcagctctcctttaactcaaagctttctggtaattttcatctactggcagctcagtgggggcattttcaagtctcaatcacatcactttaatacataaacaaaaaagacccaacacaatagcaaatgaccatgagcttagtgccatcttgagtgtatgcttttagaccccagtgatgatacaacctttccttaatacagagaggaaaacaattttgatccgagaggctttctcccaggtgcatctgaaaaaacgttcagatatgtctcctgaatggttttgactaacacaacttactttcccccagaatagctcctctctaaaaaatgccaaagcttgcctttcagggacaaatcaaaggctaagcctgaggatgatggggtgacttgaaaaagactagccaagcgcttgactgctcagtgcagcctcgataacaccattcttggtggtgccatttgctccttgtccacagcccatatcccaatgagggttattcacttttgtaaccactggtttccctctgatagtgtctaaagaagcaaataatgatgaagtgagctgtacctccaacagagtttgaagctagccaggagcccttactgatgtttaaaaactggttcttttcaaaattgtggcaactttattttcagaaacaggtttcatcccaataagttatttggatgttttagaatagaataacgccatttgttgaaattcactgaagtaaggaacaatgtaatttgccactaaaattttgcacatttcatttttcttcaaaacacccagttttgattttttttgtttgtttgtttgtttgtttgtttgttttttttgagacagagtttcactcttattgcccaggctggagtgcaatggcatgatctcggctcatcacaacctctgcctcccgggctcaggcgattttcctgcctcaacttcccaagtagctgggattacaggcatgcaccacgcccagctaattttttgtatttgtggtagagacggggtttctccatgttggtcaggctggtcttgaactctcgacctaaggtgatctgcccacctcggcctcccagagtgctgggattacaggcatgagccaccgcgcccagcatgatgacttaaattctaatcatagtgatgttatgttcattgacacattactctgtgctaggcaccgtgacaggtgatctatgaatgctgtctcatgtagtcttcactataatccatgaattatatatattaacatgaaacccatttcacacgtgaggaaactatggttcaaaatggcagttagcttctccaaggttatataactcttcaggttttatccagaatcaaatctgagctctgattccagagttcttgctctgaactctattgctttcatgataaatttccctaagggctaaaaaatacctcgtaagaaaaatgtcttaaggccgggctcagtggctcatgcctgtaaccccagcactttgggaggctggggcaggtggattgcttgagtccaggagtttgagaccagcctaggcagcatggcaaaaccctgtatctactaaaaatattagctgggcagggtggcttgtgcctgtagtcccagtaacttgggaggctgagatgggaggatcacttgaacccaggaggcgggggtggcagtgagctaagatcacaccactgcactctagtctgggcaacagagcaagacgactctgtcaaaaaaaaaaaaagagagaaaagaaaaatgccttaaaattattatgcatgcaactttttctttctttcttttatccatagctatacttggccaaacaacattaagtcmggttatatttgtccttttcctcaattgttcctacctacctaccgacttacttggctattttcattcatcattaagtgattgatggatcatagttgytaagagaagacacggaaatgaaggaaatcaacccattccttcattgattcattatgtttagagagctaccatgtatgaggtattttccaggactttatgataccttaagcttacattctcgtgaaagaggcagacaataaatagtataaataacaaaaacatactatgggatacgttttaataataagaagtgctaaggagaaaaaaaatagcagagaaatgtcagggtaaacatgtattgaaatgttagatgggctgtccaggaaggggcagataacaaaggtgacctttgagtagatgccagaaggaagttaggaagttatgcaggggagccttggaaatgtgggggaattgcactgtaggcagaaagtacagcagatgcaaaggccctgaggcggagaatgcctgggggattgaggaagaactaggagaccagtggggccgagtgactgagtgagggtgagagtagcacaaaatgcgtacaacaaagtatgttatggagaaggctgtaggttagaacaggaactttaactcctaattaggtggttttcagtagacgagtgacacaaacataatgttatacttggacctttgctgtgttgagaccactgggtgtgggagatgggtggatgagggattgggaaatcagtgaggagcttaccaccgtaacccaggcagaagatcatggtggcctgtgccagaacgaggccttcctctctttctccctccttcctttcatcttcacagattattctatattagtccattctgacactgctaataaagacatgcccaagactgagtaatttatggaagaaagaggtttcattgactcacagttcagcatggctggggaggtctcaggaaaggtagaattatggtggaaggggaagcaaacacrtccatcttcacttggtggcaggaggaagaatgagagctgagtgaagcgggaagccccttataaaaccatcagatctcgtgagaactcactatcatgacaacagcatgggggaaactactgccattattcaattccacccccaccgggtcctttctaccccatgtggggattatggaaagtataattcaagatgaaatatgggtgaagacacagccaaaccagatcatagtccatgtctacttcattcaagagaatgaatgactgaatgacacttaattgggtcttttgatattagcatccagtattttgtcatcttctgagaggggctacttctggagacagtgacacagaaaaccagtgctcttgatttaagcagagtggatcagtaagaggtgtctctttcmtttgtttagattatgatatttattcaaagagaggagcagtgaactgtggttgagtttgttattttaatgaaattacacttgcaactattgtaggtgtctttctatgtaatggatgctttacattctctcactttttttcctccagacaattctagacagcaggcatcatgattcccattttatagatcatcaaattgaggatcagagataccctgcaaagtctcatatggctgagtagcagtactctttacatctgaacccaggaccactctgactccaaagccaatattctctctgcatatttaatagctgttctttttaaaaaattgtatctattagtgcatatttgatggtggataatgtatatttaataaacccaytgagtcatgtagctgtacaagcatttaggagattatgccatctaggaaattaaatattatcaagtgttgtcacacttgagcatgaacaaatacagactgctgggctctatccccaaagattctgattagaatggctcaggccgggtgcagtggctcacgcctgtaatctcagcactttgggaggccaaggcaggtggatcacctgaggtcgggagttcttgaccagcctggccaacatggtgaaaccctgtctctactaaaaatacaaaaaattagctgggcatggcggcacacgcctgtaatcccagctactcaggaggctgaggcaggagaatcacttcaacccaggaggtggaggttgcagtgagctgagatcacaccattgcactccagsctgggcaacaagagcaaaactctgtctcaaaaaaaaaaaaaaaaaaaaaaaaaaaaaaaaaaamcaagaatggctcaggtaggggccaaaaatctgcatttctaacaagctcctaaggctgctcatgctgctgatcctggcacagcactttgagaatccttggtccacgccaatcccatcatttttgcaagaacaaattggaggtcagagaggttaacactattttcaatgatcagttaatacccctcccacctgcattaactgtaagagaaagcttgaatgacagagatgcacgactgtcagaaatggaaatgtagggtttttttggcccctttgcttgttttaattcaagagtataaaccataggtaatgttgtgctctcactttctcctgatttatctccttttgagcacttaatgaagaggaaccccactcattcacacacacacattttatttctcctgccctttttctttcctttccactttgaaatttctgttgcactttgtagttgtccagaatattttcagaaatacctccttgtgggtgaatctgctgcaaacagggctgatgaagtccctaatggttgttacccagagccctactgaatcaaaagaaatacttattttttctaaaaaaggaatcagtggtgggtttgtgaacctatgattagaaacatcctgcrgggacatctacttgttcatatttaatgtcatttactagtagtggagcttacgtgcagttggttgtagcaaacagctctttggttctccccattctttaaggcgaaacttaaatgtaatttcttagcattttgtggctgaagctcaaaccagatggctccttcttttctttccagagcacttagttcacacttctaatgcgtagaacatgcaacatcgtcgcctaattttaaatggcttactcactggccagagtcatgataaataaagatggtgtgraacgtttcttctgtttcatgctcatggaacacagcacaatctttggggctcagtttactgagtatgagacagcaggacaaagtagtaaggggtgtgagcttcgaagccaagcaggttgtttggagactaggtttttctacatctaccacacagcttcactgtaggctcagtttctccctctattaagtggagaaataatagtaatatcacacagagttgtaaaaagctcttaaaatgatgacgtcatgcttgcaaagtcttagcacactgttgagctcatggaaagggctgaataaatattaaatataaaccagaactcatgagcacattcaatccccagggaattagtctgaaagaaggtgagccctcaacttctacaagtagtgcaaatcgaaagcccttcctctcacatatggtaatccccaggggcttgtactgtcatgacccatgttgcttctgggtcctgtgcttgaaaggctgtctctttccccatctgagtcaaccgggcggtaaaacgtggctcctgtaccaggttgcacaagaaacatgcatacacacatatcactgagcaaggtgaatgccactgagggttcggggaccaggggacacctgtgtgatcttctaccacctttccggccctttcctttcttcccttcttcttctactcccagttaagctttcattttccaatgctcttcagcaatcgctrttttactytcccaaacttctacagccaaacccagcaagtgttcagttcagcagaacaaagggtcttgctctttgctggatctacctttctttcttagaggggagttggggttgaacaactgtttcgttcattacagctattattaatattttcaaagttattattaatgaaagagtgagtaacgctgccttattctccttttatttctcacccactctttttgtgttcagatcactagattttaattttacgccctttccccagcccaggactaggtctgtgttacccaggaccatttgaaagttgaaagaggaactcattggtgatacactggcttaaaaaactttaggaattcagaaaactatccaagaataacttataaaattacagatgaaatatgtgttatagtttaaacacaatatttttctgagttctttggatttttaagtacttaaaatacacagtgactatctcttttcaattttccaaatatagcatctaaatttagagagatgttaaaacaatttgggggttgtttggtttctttccttttttttttttttttttggcccctttgctcaaagaaatagtgctttgctttcttctaatgaagtaagccctggtccaaggaaaatataaaataaaatcgctattttcctaccacctttgggctatgtaattcccatttcattttccaagaggctaaattttcaaatggtttcacttacacagtgcagaaaaattagacatcttcgtcatttgggggaaaataatgacagactctctacaagaaaaaactatatatatatgacaaatcatattaaaagataacggatcactttaagtatgggaaacagaccttgaagacaaacagttttgcacccgaacttgatctaagcatgattcccagctaattgtttggttctaaattaaattattccttttgataccgaaattatagatacagttccatttggcacttcagggtatatttattttctctgtaagtgcttgtccatatatttaaagactacagataatggatttttaagtgtatttaaaaagttaagcctcttgagaatttattttaaatggaaaatatctcccagcagattgtaatttaaaaaattaaaggcaatacaatacacatgcatagagataacattcaggtgtttgtgaatcattttccccactctgctgattgtctttgtggttaatcatggaactgatggtgcagaatacactgtggatgagtttacttgcctgagcacttaggtggcttagagcagatctcttgcaaaatgcgagaaaaaatatgaccttggcctacagcagtgatcaacaaacttattttgaaaaggattagaaagtaaatatttaaggcttatgagcgagatattctgttgcaactatccaactctgctgttgcagttcaaaagcagccatatacatgtaggtgaatagtgtggctgtattccaataaaactttatttacaaaaacagtagtgggccggatttgacatgcaggttgtagattccagactcctggtttggaggcctgacttcacaactttgtgtcatcctataggagtatgagttcagctcctggattcagcatctcagttaggcccactctagtgagttagcagagcagccttctttacgcagctgccataaacaaaccaagcaagccatgaagcccacgcttcagtgtcataatcacatttcccttccacatgatctgtacacacctcaaaccccaatcctcacaagtgggattaagagcctcaggaagagctccaaataaatcctcttctcctgtccatctcaccacagaaaagcagatgaacagaaaatcagaaagtcagtaacttgtctattcctcagagttagatgtcagtgtgatacctgacatagagacaatctgacagatcacaaaagtctgattcatttataaaatatctggtgagtggctactgtttgtcaagctctgtgctagtgcgagagatacaagggttgctgggatggcccggtctctgcaagaatggaggttttattctagtgagagagacacaacatagggaggaatccaaaagacagaaggagggtttgccctgagtttcctgttggaaattgggactctggtaagcagctgtgtgataacagaaagaaacatcagcctcatctgtataagcacgtcttcattcaataaaacacatataacaggcctttgctaaacactcgaggtaaaatggcaaacaagacactttcttccctcaagaagttcacagtctgataaggaaaaaagcaaaaagaacaagtaatgacaagttgaactctgaatattctgacagatcaggcaattcacacacacaaaaaaaggaaatagaattgccgatattataaaacaatctctaaccttcccattcattgaaaaattttcaaactaatactacactctcttccaaccatcagattggccaacaaaaataaacattgtattatcaaccgttagcgtgaggaracaactcttagagcccaaatcgataaaaaaaaaaaaaaaaaaaaaaacttagcatctaactaaattttaactgacgtttcatttgaatcagcactttcagaatggctctgaactacttaaatatatgtataaaagccaggtataaaggtatttgtggccgaccatggtggcttatgcctgtaatctcagcactttgggaggccaagacggatagatcacttgaggtcaggagttgaagaccagcctggccaacatggtgaaaccctgtctctactaaaaataaaaaattagccgagtggtggcccatgcctgtaattctagctacttgggaggctgaggcaggagaattgcttgaacctgggaggcagaggttgcagtgagctgagattgcaccactgcactccagcttgggcaacagagggagactccatctaaaaaaaaaaaaaaaaatatatatatatatatatatatatgtatatatatatatatttgtatatatatatgtatatatatttgtatatatatatttgtatatatatgtatatatatttgtatatatatatttgtatatatatatgtatatatatatatttgtgtatatatatatgtatatttacatttactactacacagttggtaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgatgtaaaaagtatttaatagctattaagaataaaacctacctactgaactgtttaagtgtatatatagcttgcaaatttggtagaataatttaataatcaaaatgtgtggctaatcggggaagtcagggcttgttgagatagtaacaggctgcatctcccatttcacttcagttgattccatttttaattatttttgtattttaaaatgactattaaataatatgagttaaaggatgtatacctatttaaagactatccactgagaaatctcacccttaattctaaagggcgctgcaattcagtgatcaatagaatgaccaaatctccaccctcaaagttccttggttattttgaaaaccgtactgctaaaaagagaaaaaaaaaagtgtcattcttttctgcctgatatcttcccagcatatgtaaagtagtattcctggtgatagtatctgaaaatcaacataatccaaaggtcctcactttgtaatgtttgcagtaagattccagcatcttagcatttaactgttttcagattacatccatttaaacatctgtgattcattatcgtaaatatcacagttgtggggaccatatgcttcagcttgcagcatatatgtgtgtgtgtgtgtgtgtgtatgtatatatatatatatatatatatatatatatatatatatatatatatataaagaaaaagcmcgagcaataaatctcaggaaccttagacttgccgtgggtatgtgcaaaaagaacatttccaaacacatggggctgtctataatcacagtaatgtacttgagatcccatgtaagaattattcaattgcaaaagttgccacttgtgatggaaagctatgatttacatttggcttgtgcacttcccatgataattcaaatagggtggaaagcagcacaaaagccttctgctgcattggcttttacttcttaaggaaatatgtgagcgctattgttgtcgagtggagaaatcacagaaaaatgagatacctttaacaagtggcaaggcactcttggcaggcatccttcattcccatgagactggagctagagatgatgccatatggcctaagggatgtaataaaaatcacttggccactggaggatgaataggcatggcctacagggctgattattttcttgcttacaccagaaaacccacgtatgcacacaagaattaattgtgcttcatgtattgtaagccaaatcattgtcttttaatttcctgataaagtcttgtcaactagacagaaccaatctgtaatcacagctgatgagtatctcacacactgcaattagggaggaggtaaatgaattaattggttacaaccaaaaggagtctgctaatattttttgattgccaactctcttctagggctagcaccaagcctagccagagatatggagataaaactgtaggaagctcttgccctcaaggatcttccagattaccaaagggcaggttaggtcaggagaaaattttcaaggtgtggaagctggccttctgcagtctgctgcagtttgattggcatccctgctggttattatcaagccaccaaccttgtcaaagccttgtgcattccctttaggaaggagatccattgttgccttagatggtgttcttgagcccctaaacactaccctgccatctagaaacatttctrgaccctgtcctggaatcaaggtagcacaaggccatctctgcttagaagcattctagatatccacaaggaaggaaggatggggtgtttaaaatgcttttggatctttttgtacaaaagatgctcatctacatactggctacacgtcatttatgacatttatgaaaaccaaaattgacattctgaagtccttggatcaaatttctgtgctgttcttttctcctccatggtgttttatttgatgcgatcttgggatgtgtgatgacttcgtagtggaatagcaggtgttgatccgtaggaacttcaaatctcaagagttatttgataaaagttatagacagatcaatgatagcaaatttcaaacttatgtttccccagtcattgaagaaagaacactagtaacagctcttgactacatttaggtgttcttgactatctttaatgggtgcataaggatttgcctgggccccattcattcattttccttgaccctcttcagagcttgagtgtttcctaagctttgacacacagggtcttctggcatctgctgtctggatttttgctgatggatttaattactgacttcaagattctactcaattccattttgacaccttttttagctcaagacacagactctttgactccctgttatgtcctgtgctgctaagctgtagaataacttcgaacatttactttggataccatcatttgaaggaatccactctctttcccaaggacctggaactggattctatattagttgtaaaaagcaatccagctttcctacttacagatgtgtgaccttaagaaatgttcttactctctgagcttcaggttttctcccctaccttcatgatactgttggagaattgaaagaaataatgtttatcaagtatttagtccacggactgacatatagaaaatgcttcataaatggtaggtatkatatatgatagacatcaaacatgaaatactattagggctctgtactattagcactattagggttttgtagagtgacttgaatatatagggaaacaattcatgtaatccccaaggtgtgttcatatgaaccaacacgctttgatgccacagccatttataccagctggaagagtgcagaactaacataaatgatgtcctgctagcatctgcagctgggtyataaaccaaagcttaatgttttacaaagttttgatatgcagtagtcaatttatccatttttgtgaatcaagtaggttgggaaacaagcccagcaaaacacagtttggtaaattttatgtgaaaaaactctcttctttttcactcagtaatttttgcattttaaaaaaatacagtaatcaaaagaaatatgatgggccagtgaaaagcctggcctttggagtgtggtgaacctgagttcaaaccccagttctacaagtaaacctttgcactatgggtggctcagtctctcccagcttatctcattttgcctctgtaaaatggttgaaatatcggattatggggattggagtgaaatggaacactgacccttcaacatgacagccctgccaataattatggggtctaagcttctagacgctaagtatcatgaaaatagatgctattccacattcacctttagttgccgtttatcccttactgcctactgtcttgtacattgtaagtgaaaaaatgatgtttttaatgggttaatggatgagtatgttgaactttagaataacagaatttcccagttgtaagagacatcattcaatgctggaattgcttccacaatattcctgatgaagtcatataggttccacttgaaagtacccagtgacaagcacattatttcacccagaargaactagatcttccaaatggtaacctgaattgctttaggcccctccagtatggtcatgcattgtttaaccatagggatatgctctgagaatgcaccactgggtaatttaatcattgttggaacatcacagagtagacttacacaaacctagagggtatagcctattacacacctaggtgatctcttacaacctatggctcctcggctactaacatatatagcacggtgctgtactgagtgctataggcaattgtaayacaatggcaagtggttgtgtatctaaacatatctaaacacagaaaaggtataataaaaatatagtctaaaaggtaaaattggcacacctgtatagggcacttactacgaatagaggtggtaggattggaagatgctctgggtgagtcagtgagtgagtggtgagtgaatgtgaaggcctaggacattactgtgcaggactatagactttataaacactgtacacttaggctatactaagtttataagaaaaagctttctttcttcaatcataaattaactttagcttactgtaacttttttactttataaactttaattttttaactttttggctcttgtggtaacacttagcttacaacacaaacacattgtacagctatagaaaatattttctttatatccttattttatagacctttctatttttaaatgttttctctttttctttttcacttgttgaacttctttgttaaaagctgagacatgaacacatacatttgcctaggcctacacaaggtcagaatcatgaatatcactgtattctgcctccacattttgtctcactgaaaggtctttaggggttrtaacacgcatggagccatctcctatgatatcaatgccttcttctggatacctcctgaaggacctgcctgaggctgttttacagttaacattttcttttttttttttttttttgagacagggtctcgctctgtcacccaggctagagtaccgtggcccgatctcagctcactacagcctctgcctcctgggttcaagtgatcctcctgcccaagcatcccggttagttgggaccacaggcaccagccaccccacccagctaatttttgcatgttttgtagatatggagtcttgccatgttgcccagtatggtctcaaactcctgggctcaagcgatctgcctacctgggcctcccaaagtgctgggattacaagcgtgagccaccatgcccggccagtaaaccttttcttaatgggtagaaggaggagtacactctaaaaaaaaaaaaaaaaaaacartaaaaacgatagtatattaaatatataaaccagtagcatagttgtttattatcattaccaaatattacatatggcacataattttatgtgcttgacttttatgactgaaagtgctataggtttgtttacaccagcatcaccacaaacacatgagtaatgcattgcaytctgacgttatgacagctacctcactaggcaataggactttttcagctccgttatcatcttacgggattgctatcatatatgtgttcctctgtagatcagaacatcgctatgtggcacatgaccgaatttggacaaatatgacgtcatgcaaatatgaatatttgcattgttctggcttgtagccccacacctgcatagctgtaggacctcaatgtattctccttcctggccttttattctggttatttctggaagacctcagggcatctgtcacatgaattcacaaattcttcttccatgtcctctcattctggcctctttaattattaacattcctgggaaactcttggaggaagggcctccccactgccctctgtgggaaaagtccatctccaggatccccaaagccatgtacccctcaaggtgccaacagaccctatgactgctctagtgttctctctaccagaacaaagccaagctgtactccactcaaaaatggggccaccctgcygctcagcataacagtttgctattaggaaacaaaataacagtgcttgaaaatacctaagttgtctgtggtttgtgaatctttgagttgtgtatgtagctttcttttctctgaactatggatccatggggctggcctaggaaaccaatattgtgttcctctctctctttctcctggttctgcctccctctctaggtgctcatgcagaagtagtcctcctcagaggcccccttcctccccaggtatatctgctcttgcaatagagaggtaactgggaaatcacgagactgtcaaggcatcaaaacacaatcagggtctgaatcccaatttaggcttagccaggacactttgtcacatgtccctagacaaccccaactgcaaggccaaacaccctgaaagttgcagtggagtaaagctctcttcacattaatttacccttgagatgcacattcagaaggagacttttacacataattgctataaastttaaaaactaagggccttgtcagagacgtgtgccagtcatgaaaataccaagaagggatctctgtaaatccgagatttggtgattctcaaacttgctgaatccatgatttttctttcgcttaatgggtgactttcaaatccacttactcaaatcttcacttgagttgatgccatcattctcagttgtgtttggggagtttcaaatctgcttagctgccaagttgcagttctgctatttattcattcaacaaacagggttgagtatgtactgtgtcaagcactgtgctatatataaagtaattccaatttgaaacacaaattcgtagtgattataaccaccatgggatagatgatgcatagcattctatcaggaaacaacctgccatgttttaaggaatccacggcaagaggagaacgtaagactgacacacatacaaaacaaagattcaaagctaacggctcagtttttaatggtaggtggagaaaatcccctgaaagcagatgtggcctctgtctttttccaagaggaagcccttaagggttacatggcaaaaataggtttctgctgaagattgttggactgtatcattcattatgrtatcttctgctgacatgatagaattgaaactctattttatcaaagttggaactgaagcatggaatggaattwagactgttttatgtttgttctgcacttaccaaattctataaagcctttggaagtgaaattcactcctgggtcaaccagtcatggctagaatactcccagaaccttatagaagctctgcaatgtcagtgctgactctaggccaaacatggaacacggaagcccaatacgcatgttcaggaagcagaagagtagaaataatcaagtctgtagggtgtgcttcttgattcactcatggatctgacccaatgtgggtggaattgaacgtatgttaatgaaggcttgagtgactagaatgctggtgaaatgagagtattcaggaaagtcaaaagaaatgcttcctgtttcttccatttggaccagtctaaagagactctggactaagccctgtgagtgctttaaaaggaaggtggtgcctctggatgccagtggcatactgagggatatgaaaagcaattaagtgatggcctgtatcctggaaagagtctgtctgatatttctgaattaaatgctactttagttgtcagaaagacattgtcatgccccagcaaaggctttgcagattaaccaatatgcaggaccttcatgctgaggaagaattgaattctgtttttccaagtaggcaaggaataccaggatagctgggtctctccatctcaggcaaaacagacaatctacattcwtatgctctggggcagttcctatctgtgtcatgtccttgagacagctagtataggtacttctgagagctggtaaaaattttagaaaagttgcaagccaactgaaggcacattggtaccttgaaataaacaacgtgtagagcatttaaaccacagaaatcggcagatgctacaactcgagactttttccaagactagcacatcactgcaagtccttctcttctgtgtgtgcgtatgaagatcctggaggtggatctgtgcatatctgtctgggggagggctacaacttccagggtgactgattcagagcctgtaattctgattcatatgcatccttgcacacatgtacaagyggaatctgaccatccactctgaaagggccccacaacttatgtgcagacacatttgcaaagcctctacaaatacatgcaaactctaggacaatttacccatataagatgtgagtgtataaatcacagattggcccaagcacgcttataagaatagcacaaaattcatatattagttcatacctagctctgcaagcaggactgttctatatttggcagataagtttaaatccatctgcatttcattttttctgggatcataacagagcttaattttctcccttatccatttttagatggtaggaaatctatgccttttggattttcatccccaagaaccaccttcaaaagaaagaaatggaaaagcataaaatcaaggtcgggaagattaagccccttaattcacatgtcaaacttgccatttcaattgtggttttgtctcccagctgaagtttgtctttttgtgacatttgcattaagcccaggggacattttgagtggaaaagcgctgaaagcataattgaaactctgagtgttgccttttgtctaatttgcaatttcccccaggtggggtgttttcactaccccccgactccaccccgccctcccagggtgttctaagattatctcaaagaatgatgttatgcaatttattccaataaawctccatgtacagtatcttatatgtgtatattttttgccttccagaagttatttcaaatccgtgagaaactatgtagggaagtcattcataggttcagaagagtacagatagttcatttcccctttcagatagaggttttgagtatttgttcacaagtttaattgtttagtcacatctttcagttatccacatggtgtcattctgagccacccaggaagttgtctctatagaaacaagcattttttaaatggacataaactgttcagttttgtccttaaatatgtctttgaactctgtgctcaattcacatatggtcttgatatctacttaaaagtttgagaatcactgacactttggtggcatcaacaaagtcaataacatgaaacacaatgcagggctgatgtcatcacatgcaccctttaataggaaatttaggatatgattataattggtgagaatgtagagtctgttttctccaggagaaagaagaaaacgtaaaagaaaatgttgtggcttgtttttcttttgagtcaatgtcttcctgtttatcagagctgtcctttagatattgccaaagctatggcaacaggagcaatttagattttgccctttctagaatttctgtttttatcaagacttcattatttatattaaataaattatttcttatcygatatttggatatcatagccttcctggattatatacctgagtagagtggatgcaggcatgaatttgtctaactgagggttggatggcaaggaatgtagtaccagccagcatttccagagggtacaacaaacgtcactgtggaggttttagtggatacaaggacaaacttttttagtggatacaaggacacacttacttcttttgaatttggctctttagatttattttaatatttatttgaaaaaatacctggcatattcaacaggtattataaatactacattcaaataattttataatttaaagggtcagtcagttaaaaaatattaagtaaataatcgatgtggtatgagaggtggcaatgaaattgtgagtctggaagctgaatgactaaaggaaagaacacattcatctagaaagactggcatagccctcaggagtgtgggctctagaaccagaaaccacactcccgagtttggatttgacctcggttcatataatgacttcgtggcctcggataactcatgcaacctcactaagtctcagtttccacagaacaccaaaagttcctacctcaaattgatgatgtgaagaagacgacatgaagatttattgcaatcattagtgtaaagctcacagtgtaatgtaatgtcattactttaggaaaactcttgccttacatttgtacgaagttgtcttcaccaacaatccgtttggagaatatcgaacaaaactttgttgattctattttgagcagggctctgtaatttcactcctttaatatcgtttttccttcacaactgttcacatgaagtacgtagggcttcaccaaaacaagtgaagggattcarcaatgggcaagcctgaatcagaatcatcagccccacccctttaaccctagcagtgatgcctgtagtaaccatttccatggcaacagcctgagactagcaaggtacctgactagaaggaatgacagaggaggaggtagaaaaatcagctggaagaaggaagctgtgtaggaaaaggaaaaggtagcttccttagtgcccagaattatggcaataatggtgatcattctcattcatggagcaacaagctctgtcctaagtgctttctgtgtgtaggcatgcattatcttgtttacacatgccataaggattatagtacctttcaggaggatgcccactctatggataaagatgtcgaggattaaagaatataggtggtatattagtccaytctcatgctactaataaagacatacctgggacagggtaatttataaagaaaagaggtgtrattgactcacagttcagcatggctggggaggcctcaggaaacttacaatcttggcagaagggaaagcaaacacatccttcttcacatggcagcagcaaggagaaatgcagagagaaggggaagaatgcccatcagatctcgccagaactcactgtcacaagaatagcatggaggtaaccactcctgtgattaaattacctcccatcggcttcctcccatgacacacgggagttataggaactacaattcaagatgagattttggtggggacacagccaaaccatatcaggtggtttgcccaacgtcacagggctcctacacacaagccaggattagaaaagggcttagaaacctacccttaaaacttccctttcttggggcacggaaataacagttgctggcatgccagtccccaacctctactcttttccaggaatggctgggaaatgtggagacctggcaccttgacaaagagtttataatgtaaggtcctggttcctggctctgtctgcattagattaatcagggggagcttttaagagatactagtgcacacagaccscaactcagcacagttgtatcataatcttgggagagagtgggggcaggtattgctattctttttaatgctccttcagcatttcttagatggccagccttgagaaagaaccatggcctaaagcacctrctcctgagttggtaagtggtatcaaaaatatacaaagacccaattatgcaactgttagctatttgatttagaaagtattgagtgccggtgatgtgccaggtcctgaaactgcagttgttmtcagtgtgacctcacttggtacctctgatgaycccaaaggggtttgtgagatgcccaagggggccatgttggggcaactgtcctttctccacttgcccatctattcctaggaagcagatgtgcccagagcttgggctgtagaggcagamtgaacagatcagagaaggttctcgctytaggcctttctggatatgggaccacgagctagtcagtcaatctctctgagactcagtctcttctcctgtaaaatataatatgatgcktatatatttatagactgtgcattctcattggggctatatttcccccacaggggtgaaataggttcgagggtggggggacaaaaaytgcacttacaaatgtaaagtatagatatacttgtagtasctaaacagatataagtatatctgtgatattaaaattttacaggaataktggcaattagaaaaaaatacttaaaagagcccttaggggagtagataatgaaaaaaacaaaagttaagcaaccctgctatagaattgctatgaggctraaaggaggtatggacttgtacagtcctttgcwtagagcgtagcactcagggaccactcaataaatagtagtgccatgactgttgtctgtccaagcatcacttcattcaaaatgcacacactgattccaaccattctttggggctatgcaagttttactggcatctttgggacagataaggcaccacctctgacttcaccaatgagctaggtcagagctaagcagagcggctgagtgccattctaaatggatacacacggggtccaggggccaaggggagagcatagctgagttcttcatttccttgtactccctgctgctgggttcaatgaaatcaagaggtcactacgggcctcttatcccaattcacagccttgtcggcagcctcttgctcacagcacagaagggagacccccccccsccaccgccccgcctccaatcctctaccattactaaatcatcattttgctctggagagtaactgagcaaagtggaattattactgatggcctcccatgtggaaaaacatgctgttcattgctgaagatgtaaagatgaatgaaagaacaagactcaatttctgctcttggttctggtgcaaaaaacaaatacataatatggacagattgatataatataaaaggttctatgggaaggaaattctggaacacaaagagaatgcttgaagaagttgcttgagttgaatcttgaagagtaagcaagagttaacagggtgaagaaggtgagaaatgccttctgcagagagggagcactatacacaaagggtgggacagtagagtagggagatgcaagagtgggtgaggtgtgagstatgcagtgaagacaaaggcagaggggaggctgatggacagcctagtcatggaggaccttgagtgctaagtattgttttgcaatgaagatccataattatatgagactcaggtggagaaaagctggtcttatagttgcaacaggagaatccaaggcttcctccagggagcagagctgtgtggcccccagtaccccacattgcctgggcttagcttatctccattctaacttccttcaattctcccttgctgtctgtgccaatctaactgcttacatccagttckgtagatgccgcaggactttgcatatgttatggttttctctgcctaagtaataggtccccaattatttataagagtagtaaattgatgtctgtcttccacattagacttcaaactagggactgtgcctgtctttgttcaacattataacctcagcatctagcataatgtaggttctcagtaaatatttatggtaggaagaaagggtgggaagaagaaacttagctgggaatccagaacccccacaaactttcatatgccttttcctctaccccattcactccccagctgagactgtcttctgtgatcctgttcgagggttaagtctggaacctcatgctggcgattgaagcagtcatttcctgtgaggccttgtcatttgagtaatttgcctccagtggatgaatactaattgatgataacagtgaaagcaaccttggtgtcacttcttcatagttcacttccaaaaactgaaactaagcatgttcaattcatctgggctaccaacatggttagagaaagtgagcaagtgtctgagaaccgcagggtcctgagagtccacttgtgtgtccatgcaaagatggctctaaagctgacttaaccacggaaagccttagaacctttgcagagcgatcaaaaggcaccgcagcgtgcagtgctcttcaggactgggcaggaacatgaaaacaggactgagcagggcaatcacagctctctacagtagtccctgcttgtcctcaggggatgtgtcacaagacctacgtagatacctcagtccgtggatactacccaaccctatatatgctaatttgtcctatacatacatagctatgttaaagtttaatttacaaattgggcacagtaaaatattaacaacaataactaatgataaaatagaacaattataacaataatgaaaatggcacacaatttgaaacttatgaattgtttatttctggaatttcccatttaatattttcagacctgtgttgaccatgggtatctggaattgaagaaagccaagccatggagatgggggaactactgtattcaggttttgataggatttcagaagggttgtattctccatggggtattgtctttattgaaaatgtgcagtggtgacaggcaaatggtccagggttcaaatcctggctcatcatttacaacctgtgtgtactgggcaccaactttgcactccatgagcctcagtttccttatctagaaactgtaggagaaggggatcaaaatagtactttatttgttgtcattgtaaagattaactaaggtgatgtgtgcaaagtgtgtagcacctacccttgaatgtggaaagtgctcaatctgcattatccactattattatcagttaatatgattattatcaccctaagtatcatcttcccagagtagaaatatcagtttagattttcagatatttatatggctttcacagtgtgctaggacctatgtagatgagcttagattctcagatatttatttggctttaacagtgtgctaggatctatgtagctgttgttaccaaaagatgtacacaaraaagttcctagcaacaatatttggagccccaaagtggaaatagtccagataccagtygagagtaggatagataaagagactcaatacagccacataatggaatactctatgatgattaagataaagataaatatagtaacctggatactatacagtgatcagtgattattgttatagtgattagaataaactaccacaactcacagccacatgatgaatctcgtggcatgtaatgtcgaatgaagaagccaaataggagagagtgcatactgtatgaccacattagatgccatgcaaatgcaggtaaaaccaatctgtggtattagaggctagaataaygtagcctctggggaagaggttaggaattttactcaggaagggaggggactggtaatgtgtcatgttatggcctggttgctggacagttggttgtgcttactttgtaaaaattcattgggttgtatgttctgatttatgtgcttatatgtgtctacattatgcttcaattaaaggtttrctaaacaaataagcctgttcagcagagaccaaaaagcacgtagtacaattctatgcttacccacaaggggcctcaaagtttacaggaggaggcagacaggcaaatgcatgcacagataatgagttgtgatacccataataatagaattgtgtaccacatgcagaatcaccattgaggggagcatgatcagccgtcacagcctctgcttgtgtcaatgccctgtgctccatttgttcatgcagggggcccatcttccctattccttcccacacatgaataaggtattccatggcaggaactttgctcacatctgtccactctccatatcagcaccactgccttcattttgtacagccatctttgatgcaacactgaactcgttggaactgggtctcttggcctctcttcctgcccttctttaaatcacttgctataacccagatctgccaaattataatcattgtattgggtcctctggattcttaaaaagtaccctgtgggccgggtacagtggctcacgcctgtaatcccagttctttgggaggcctgaggtcgggagttcgagaccagtctggccaacatggtgaaacccccatctctactaaaaatacaaaaattagccaggcatgatggcatgcatctgtaatcccagctacccaggaggctgagacaggagaatcactggaacccgggaggcagaggctgcagtcagccaagatcgcgccactgcactccagtctggatgacagagcaagactctgttaaaaaaaaaaaaaaaaaaaaagcaccctgtgtgattctgatgcaccccaatccttgagaagcactcctcttcactggaagcagagcacacacctgatcttgactctctccacacaacaaatcgtccagggctaccagaaagcaccataacttactggcttttcccaacttgtttcccagagacattttcagcctcatttccacccttcccttctagatccccaccattctagattcccaccatccctgccccgttttaagtttgcctctattcacctaaaaacatatggactattccatatggactgagcatgaaagaaatatagttcctcaaagtaaattaaggagctgttttcagaggaaaggaaatggatggtggataggcaagaaaatgtggcccactagaattctatatggtgctgcatattgtgctgtatacatatatggtgcatgcrtatgtgtacatatgtgtacatgtatacattacatgcacatataccatatgtgtgtatatggtgctgtaggtatatacatgcgcatgtatacaccatatacatgcgcatgtatacaccatatacatgcgcatgtatacaccatatacatgcgcatgtatacaccatatacatgcgcatgtatacaccatatacatgcgcatgtatacaccatatacatgcgcatgtatacaccatatacatgcgcatgtatccatgcgcatgcataggcatgtatatatatgtatatgtatacacgtatatggtatatacatgtacatgtatatgtatacacgtatatgtatatacatatacgtatatgtatacacgtatatggtatatacatgtacatgtatatgcatacacgtatatggtatatacatgtacatgtatatgcacatcgttaattctcattccctgaatctgttttgctatttagccctcatccctgtgcctttgaatagcctataatgtcttccacattcttaagggccttctcatctcctacttatcttcaatacccagctcaaatattgactctgtgcagctctcctcaatggtcctgagcaccctgtggttctgctcagtcacccacacatgccaggattagatcacttccctcaaatgtcactctgccagatctgactcttcactccactgagaaggcactcaagtstgcacactcagagcttagcacctgcctggaacaygcgagttcgtcaaggacatgtcttgattgagtgaagtccatcagcacaaagtcacttgggcacaggcatcttgctgtgggataaaacstaacatttgtgaactctgggttgggaaactatgtggtaattcacacttaataggtcagagatatctcagagataagctgcccaacctactcatgctccttctgttgtttcgtttgtttcccagtgaccttcagtgactgtaagggaaacgacaagctacgctatgaggtctcvagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtaacacatctgtttgwgatmacttgggttcaaggaggacattaggttctgtctgtcttatgtggaaaatgggtctttaayttattatgttggctaagattccttttgttattgttgttgcaaatgacagaaatccaactcwaaaaatgtagatgaggggcagcgggaattaattgattcatgtaactaattgaggcatagttcgtggattaattcatggaactattttagggatacttctgccttcaggcgtggctgaagctgtccaaatcagctttaatccctgtgcatctcgtggctccattttccttttattagatgtattgagacagtcacatctctccctgcctcccaaggtggaggtctcagcaactaccctctttctgctggtctgaagtcgcctgagaaagcatctcttcaagacgatgctagcaaaaccttggaattcagtctcgtaggttagatcatgtgtccacccctgaactaaacatggtgtccattgggttgtgatgttctggttggccacgtctcggtcacatttcttttcctgaagccagggcagagtcagccctattcacctgaaaactcatggactgagagtgaaagaaatgtagttcctcaaagtaaattaaggagctgttttcagaggaaaggaaatggatggtggataggccagaaaaggtgacccactagaattgtatatggtgctgcatattgtgctgtatacatatacggtgtatgtgtatgtgtacatatgtgtacatgtatatattacatgcacatataccacatgtatgtatatggtgctgtatgtgtatatgttgtacatgtatgtgtataccatatacaggcatatgtaccatatacttatgtgtatatgtacacatacatatggtatatgtgcatgtaatgtatacacatatgtatacatccacatttaatrtatcaaagatatctcaaagctaacctgcccaacctactcatgctcctcctgttgttttgttttgtttcccattgaccttcagtgacttcagtatatctatgtgtgtatatgtatatatgtatatgtaattgtttacggttctgtatatatatacrgtgtatatgtatgtctatatgtatacatttgcatttaacaggtcataggtatctcagagataagctgcccaacctactcatggtccttctgttgttttgttttgtttcccaatgacttttggtgacttcagtatatatatgtgtgtatatgtgtatacgtatgtacaggcatacacatactatatatgcgcatatactgtgtatatgtatgtgtgtatatacatacacatggtatatctgtattatatgtgtgtgtaattgcatatcgtgcttctcgtttgccaggcagcagtgcttgttcccttccacargcacatgcatgcagatccctgcactcccacacatatgcatacactttataagtgtcacaaactgccattcaggcttcccgattgtgccattcrgagactttttgctactactgactcctgccttcttcaccaggagctcagggactccaccttygtgagaaaaggagggcaagacacacagcaggattccagccaaacaatgacttaatgatggcatgcccctgcttggcatgcctagccttctctcctacctgcgagcttggtcttcctcgatttttcacagcccctaattcacatcccttttctccacctgccatattasccacatccctgcttgatctactcattttgttcagtggtggagcgagtgtgggtcacacagctgggagcagagacagtacaactggcamtgtgagagttaccttcccgccagtgctgtctgtgtgatcttgagagcatcatatagcttctttatctgyagaatagmgaggttaaacagcctgcagtggcaaataagtggctcatgtgccaccctactgtcaccgtgctcgtgrcagatattgctaataacccctggcttagcctgagtatccttctcactgcaatgcttctggaacctactatcaattgatcatttagtggtgtttctgagggtggaacctatctgccattcctgggctggatgaacttcacaattccccttcagcatctgtgaagctgtgagttaaggatagatggcaacctaaaaacsaatgtacggcacgtcagtcatgtttcagagsaaactggatattggtgaattcataccagtgtggaaatccattgacaccacaaaggcaagcttttctcttacttagccatgaccaatggtcacagcatctcactaatctgtgatataaattatgtggcaaatatctaaagcaacaaagttgccaggatatacagcaaaaacaatgttccatagaaacatggaaatggtatggtgagggggtttgcccatgggcttgaatgcatttagatggcgattgttcttcgtgaatggtggctcatctttctatctggaaaagatactgtcatcgtattttgcttcaaagagagcagaagatcttctgggcaggttctcgggaccaaccccaccttgagggcctgggagagctgggttcattatgaaaactcagccacgcattgtttgtacctcaagtttctgtgagatgccatccagagacaaagctcccctgagtcctggctgtttctcgcttgctgctgtctgtacgcattttcgacaaaacttgcctgtgattgtttttgcttcttataaagggggcggaggctgccgtgtccttcagtttgccagacttcagcagaatggggcattcatctcccacgtccagtaattttatgagatttgaaaaaaggctttgtgaagatgtgtagctgtgtccttcataaaaacgcctcaaaaaaggaaaaaaaaataaaaagaaaatgaaggaaaacaaaatagatagcaaaagaatccctctgaagagagcacatacctcaatggatatgcacgtggtatgtttgcaggtcctactgtgtgcagccaagtgggccagctgctagagaagaaaatcagtgagtgcctgagtcagctcagctcctgttggggagggaatacgaatgtgtgcattgatgcttgggtaccaggcggggagctaacagtgatggatgatctctgcatttggagaggggagaggtcaaggggagctgggctggtcctcaaagcaccaaccatgtgccaggtgttgctccatgggctacaaatgctgactcacgtaacctccttagcaactggaggcagatgctactgtgttctgcctcatagtgagtttttactgattttactgatggaggaactgaggcacaaagagccaagtgacatttccaaggtctaaaaatgaataacaagctggatggaagtgagacttgagcctgggcagcctggcccctgagtccgtgcctccaacccctgcatgagctggactttgaaggacgggtcattgtgcatagttgggagggtctacgagggaaatgttggcctgtcttcatggtgtttctcttctaagctgtgttaccttcagtcaattgctttacctcctgagcctctatgtagttttgattttttcgtctgtaacatagggataatagacttgtttggatcttcctgtggattcaatgagacgatacatgtagcagtaatgtatagcactcagctgatgctacagcaatgaccaacactgatgcttacgtaatacttactatgtgctaaaccctgggtttattcaagtctttcatcctcacaacagtatgctaagggaagctgttactgttactggtgctgttatcatttgcatctrctgggtgaggagactgagacacaatggggctgtttcttgctctggacacttagctagtaggtggcggaagagggcctyagaccttagcagcatggctctggctctggagctctcctctttttttttttttttttttttttgagatagggtctcagtcctgtctcacaggctggagtgcaatggtacaatctcagctcactgcaacctccacctcctgggttcaagtgattctcctgcctcagccttctgagtggctgagattacaggcacccaccaccacacctggctactttttgtatctttagtagagatgggatttcaccgtgttggccaggctggtgttgaattcctgaccttaagtgatcctcctgcctcagcctcccaaagtgctgggattataggtgtgagccgcagtgcccaacctggagctctctgctttaacagtaggttctattggctcaccatctggaacagagtaaacctgcacaatgttcactcccacaaatgcagttacaacagaggcaagcaaggcctgcaacccagaatgccagattgtcaggaccagctcagtgcccttcccactttccctcttcccgtggctgaacctgatagaacactcctgtggctgcctgtaaattctgacccttgatatctggctcccactctgcatccctctcccttgcaccctgtgttctgcttcttcccagccctttggttggtgatcttgtcgtgcagcctagatgcaattcatcttctcattctcaggcaggaaatctgcagttcccggagatgatttggctccacctcaaggattagcctgcacacccatacaccccacrcaagccagggtccagcatcccagggtccacttttcttggccagaggaagctggaacagaaagggaatgctaaataaaagcatgggaacatgtgggcagacaggatggagacagcatctgaagaccaggaggagggattctagattgatatgacaggagctatggagccactgtaggttcttaagcagagaaacaggcaggataaaaatagtccttggtggtgttcatccaggagccttgactggagtagggagagactagagctactagttgaaataatagctactactattttttgagaattgatttcatggagctttcttacggtcatgcatcttagtctatgtttagcctatgttatttctaattctcacaacctccctgtggggttaccgagattaccccttcctgcagatatgggaaccttgccaagagactctaacttgaaactgacaaaaatgagattgaaattctggcctctgcctaaatacccattctccttcctgccactttgctgctagaaggctgtgccactggggaggctgctgccattgcccatgggtctaggagatgagagcatcagttagagcaacatgggagcaatggagggaaaccagaagcaagatttgccagaaaggaagaaagagccaggatcccgtatctggatgattccagattgtctagcctggaggatggagatgaattggaccagtcaggaaagaaatgttagggaaagacgtctagtcaggcttgagtgtgttgatttatatgctcctagggacatctttatagagatgtccaggagtcaatggacaatgtgggactggctgctagagtacaaatttgaaggaagaacagcatagtggtgggagttttggcttatgttggacatgagtgggttcaaatttctgctatgccacttactcattgtgtgacttgggcaagtgactcaattatctgaatcccaatatcctcatctatcaaatagggataagaacagtctgtgtcacagagttgttctcctgggcatagcaccagacatcaagggacagttcccatcaatggtataattttggaacctcaggaggaaggataaggaactgagggctaagtgtattcactgaggccctgagacagaagccagrgatggggaacaggaagagaaagtaaagccaatgaaaagaaagggaaggcatgctcagagaggtaggtgggaccgccagcctaaccaaaacaggggcgatttcacacttgctcatttcatgtcactgtgttttggaaggaaagattctctaaggcaaatataatcacagttaagcctattttagctgtggtaactggagcctggctcttctttaataaaaggagcctggcctctcttatttttacctgctacttatgaccctgtctcacctgcaaaacatataccccaaatctgtgaggtctgattgttaatgacttaattatagactcacaagctatttctgcatttttaatgggcttcccagaatctagtacctgcctggcttatgtaagatcaccttagatctgagtaggcagaagagcagtttaattccaagtcttttgacaggctctgacaaattgttatggaagatagtgaggttaaccttccgtgcacaaaagggctctcctgtctgtggaaggtcatgatgaacttgacacaccaagttatgtctggacagaatcatgacttttccccaccaaatctgctgtttctcatggcccaacaaggatgaaacgaaaaacagtggatgaggggtctgcgtgtgtgtgtttgtgtgcacacatgcgtgttcgccttgtatgtagtttcaaaagtttacacagaaaagctccatgcttcgttcctcacgcagaaatgtctttatctgccatataaatgggattcaacaacttcattttctggcctggccaacgaaaacactcacaaastaaaaacaccatacttactctttctttctgagttaagaamttgtagcttgcctgattatagatcatggcaagtaattctgacatcagttaacgaacttgatgaagtcaggttgggaagtgacatcaaggggcttagaggaatttattctgacattgggtttgggaactaaagatactgtacctccaggcttcgtcttgaaacatggaagcccacacactaaacagtggtagaatttagatgcctacggccaggcagctggtccttatgaacaaagcaaaagtctcccatggcccaggttcccacggagagttatgagggccacaggctatatacgcttggatccagcttcactgctcccagtctggagttattcctcaaatgcacctgatcacttcgctcctctgcttaataggctctcacttcctgatcagctcacctggccttggggataaattctaaagacagcatatgtctgaaaaggtcctttgtggtttagcctgactgatctctgcagccttctttcaagtctcattcctgctcatctctaagtggcttgacctgcggaattgtcaccttctccaagagccttcccttcctgtcaccctcgcctcttgtccccatcccaagaaaggatctcccctactggtctcactcttggcatcagtgcttttccttcctaggcttcttctcaatttgtaattatgtatttactttcttgttcaggtgtttaatgtccgccttggatgaatataggaacagtctcttccctgcctccctcccttccttgtttctttcccttcttccttcctgtgtgttcaccactctatcctcagcaccctgcccagtgcctggcgcagagtattcagtggatgccttttgaatacatggatgagtggagcgagttacccctctcacaccctacattgaactctccctccttcaataccaaatcacttgtggtttcttgaattggccaagctttcccatcccttcacactggctactcctctgtctggacattgttccttccactgaggttccacctaccctatggtcagcaccattgatgcttcagaaccagccaagattttccttctttgggaacagctctctgaatatcccccagctggctaggtgttctttctccaggctcctgtagacacctgcctggctctctctactcatagtactaaacaaaacagtctgctttcttctgcttgtgcctgtcttaatgctgagctcctgagctgaaggccctcgctcccatgcagcacactaagatcactctggggccagaccaccttggcatgaatcccagtgctgcatttactacctctgctccaggttcctcagctggaaaaggggttcataattgtgtgaacctcatggggatgctgtgaggattcaatgaatcaacacgtgtgtattagtcaaggttctttaaagacacagaactaatgtgatagatgaatatatgaaggggagtttattaggagaattgactcacatcatcacaaggtaaagtcccatcgtaggccatctgcaggctgagaagccaggaagtcagtctgagtcacaaaacctcaaaagtagggaaggtgatggtgcagccttcagtctgtggccgaaggccccagagcttctggcaaatctctggtgtaagtccaacagtccaaaagctgaagaacttggagtgtgatgttcgaggccaggaagcatccaacatgggagaaagatggaggccagagactcagccagtctgctctttccatgcctggttttatgctggcagctgattagttgatgcccacccagactgagggtgggtctgcctctcccagtctactgactcacatgttaatatcctttggcaacaccctcacagaaacaccggggaacaatattttgcatccttcaatccaatcgagttgacaatcaatattagccatcacagcatccaaagtacttgggacagtcagtgtctcacaacaaactggagttattcatagtgattgcattgttaaayccagacctatgataaatgttcagctaatgaacgaggcaaactgaggtgacccartcctccatccatgcccaacatgaccaaattctatgatttctgtaacctgtatatattcaggattatgggcgaacttacaccatcaccactcttattcctcaggtgctcactgtataggaagcactgactaaacttcctagagaagaaattatttctacaggtccacttaacaaactccaaaagacctggcagtatttaaaagttcattatgaacaatttacccttcttaactggaagtcaatacaagttgcctcaataaagggaaactggtctcttaatcaagttgcttcaattaaatgcaaaaaaatatttttcccttttttgtcattacaagaatttcttaaaaataaaacaaagaagaaaagttatgacagaagctgaaaaggctaaatttaaggctcgtttatcatgcttgttcatcatcgttgcaaacatgcaatttaaaagacgtaattttggctcctaatccagtttcaagaatcaggatggaaatggttccaaaaaaaaaataaaaggagcaatcagtagaaggagccacttgggagaaacagttgtttttgtttttaatttttttaataaaaatataaaatatatcgtcaattgcccaaaagccaacgaccctgctaatacgtctcttactgcattgggtggttacaacttttaaatccactacctatcagaatctcaggaattatttggtaagtaccttgaggaaaacctggagctaattgccccctgtttctacacacatacattcatggggatatttagcgaaaatttttgtggatgatactaagaggtacctgaaatgaccaaaaatcagaaacgaatcacacatttttcagccacatgatactgaaaagttacgtaacttctctgaggttcagttttctcatctgtacaatggacataatactctggccttgtgtggatgccatcatgagacacatttaataaaacaaatgtcatgcttcattcagtgccttgctaatggatgattcttaatcactgatcaattattcttaagtgaagtagccagtaagttgctatcacttctatacatttttcccctctttcctgatctcacacgttctagacaaaaatacttttgcacatttgttactgatgtaaactgcaatttttttctactctgagccaactgtttgaatcctctgtttgttttggccatgatgccatctaaccttcaagacacccgacacgctgcagacatgtgactttactttatttctttaaaacaagagtgtcccccacccacctgtctgagtaccagtccgtggcctgttagaaaccgggctgcactgcaagaagtgagtggcaggtgagcaagcaaagcttcatctgtatttatagccactccccattccccacattactgcctgagcrctgcctgctgtcagatcagtagcagcatcagattctcataggagtgtgaaccctattgtaaattgcacatgcaagagatctaggttgcaccctccttatgagaatctaatgcctgatgatctgtcactgtctcccatcaccccgagacaggaccatgtagtcgcaggaaaacaagctgagggctcccatggattctacattatggtgcgttgtatacttatctcattgtatattacaattaactaataatagaaataaagtgcatgataaatgtaatgcacttgaatcatcccaaaaccgccaccatgaacaccctcagtccatggaaaaattgtcttccatgaaacgggtctgtggtgccgaaaaaggctggggactgctgctctaaataattcctgaaaatgagagcaacaagctcgtggtaaattaattaccttgtctctaaaccgtctcacattgactgggagtgacatggaatctgttgacttgggtgattatatcgatcctgcttacatgaaatatgttttacaacaatcccagtggagaatgaatctgcacatttgctgtgaccataaagaaatgatgagttaaagatgtggacacttaatatgccctgatttaacaagtgtgataacttcaaaaaacctgtgaagtaccatgctccatggcaaaagcctccccaggtactgttaaggaaagttagtatccatttaactgtcacctaaaktggagaaaatatatagcttgaaaattattgtacggatccaagaattgggcctagaattcaataataggctgttacatcttgacacatgcctaaattgttatgtttatrtggctcttagctccaggatactattcatatatagataaaaagacatccttcaattcattaatttaaatagataacagattactttaaggatcagaatctaagaaaactatattctggagattaattttaattgaaattcttgggggaaaaactgatcccatagaaagtatagataactaaaaatggcttctttttggcttttgaaaattctaaattttattttatacaggagcatggtccaatagaaatgtaatgaaagccacgtatgtcatttaaagttttcttatagtcatgttaaaaaacgaaaccagtgaaattaactttaataatttatataataactgtatatatgagtgtgtgtgtgtgtgtgtgtgtgtgtgtgtgtgtgkatgtataacagatatatctaacatattatcatttcaacaagtaatcaaggccaggcacaatggctcacacctgtaatcccagcactttaagaggccaaggcaggcggatcacttgaggcccggagtttgagaccagcctggccaggatggtgaaaccacatctctactaaaaatacaaaaattagctgggcatggtggtgcatgcctgtaatcccagctactcaggaggctgaggcaggggaactgctagrtcatgccattgcactctagtctgggcaacggagcaagtgtgactctatctcaaaaaaaaaaaaaaatcaatatgaacattattcataagatacctttttacattcttcttttcatattaagtcattgaaatgtagtatatattttatgcttaaggcacatctcaatttagagtatttaatttttaagtacttaataagcacaagcagtgaatagctaaggattagataggatgctctacagttctacaggaatattgcattttttgaaaggatggaaaggatcattcactgagttcctaccacatgttagaacattgcctttggccttagagcccctcacacatccatctgtttttctcctatagctagcctgttcctatattccagatgcagaagtagctcaggctcagaaaagttaagtaacttaaccagtgccatcatccatcagtaagtggcaggactggaagttgagctgggccttctgattttgtggagtcattgctattttgctaatactgacatttatggcagaactattgtgcttttctatttttcagtaaatttcctgaaatagcataggaaattaaaaagttgttagtaataaaaaataaatccagagctgagcaaaactcctaaagaaattttaggaaggtgggcaagccctgtattgtcatgacacattttaaaaacttttcctgtgaatagaacctttacaaaaagaaccttgtggaaacagcacgaggtgtctaaatgtaaatttctcccaggccagggacctgatctcattcatcttcatagtcccataggctagagaaaacgtcttgcgtttatatttttaaaactataatttacaactttgtttatatatgcattacccgatttaagctcacaacaatgcctggatgcagatggtgtgtttttcgttttctgagtgaggacagtgagactcagaggtgggtcttaggtcgcggtcrtggagttggttgagtggcagccagtgcggccatccacaggctttcccaagtgcatcgctgcagccatagttagctccccagcagctgctcggggctttcacatagrtggaatatagtgttgtcagaggtaaatttccagctagtatataggatagaacaagataatgtaataaaatgtacattttctaggctctctgatatgcttctaccctcctatctcttrttattaccataaatcaaatactagtcaattctaaatgtaaatatagggatgataacctctttttacaattcctctcttatctgcaactcccagagagattcacatggagatacttggtcactgccggctttgcggtcggcatgactcctattagagattaaatgacatagagtaatctcaaagtagttagcaataaaaattaatacaaaactatgcaaaactcccagagaaattttaggcaagtagacaagtcctgtgtcatcatgacccattaataaaactttcctcgtgaacagaacctttggaagtagaatctcatggaaatagcatgagatttccaaatgtaaatgtctgccaagtctctctgtaagagatgggttggctgggggcgatggctcaaacctgtaatcctagcactttgggagactgaggcaggtggatcacgatatcaggagttcaagaccagcctggccaagatggtgaaaccctatctctactaaaaatacaaaaattatccaggcgtggtggcaggtgcctgtaatcccagctacttgggaggctgaggcaggagaatcgctcgaactcaggaggcagaggtcacagtgatccaagatcacgccactgcagtgtagtctgggcgacagatcaagattcctttaaaaaaaaaaaaaaaaaaaaaaaaagatgggtctgcatttctcaagggaaaaaaacatctccaatgatgagaaaatacagtgtttgataaagaccatggattttctctatttgattctctgttctcaacacccaaaacttaggcagtaaagaaacaggggaagaggtaccatttattcagtctttttccacccagcacatgggatgatcaaattacatggtctcatccaaagttttcaggcagaagcctgaatgtttgtagaaaaattagcctatttggccctagccaaatacatcctccagtctacccatgttgggcagatgcctgtggacttttggaccctttggcctgggagtgatgtgtgatagttgccagggtggcatctgctgttgggccagactgttggtgctgtttgattctcagcccaattgcttgtttaagcaaagccaagtctagtctcaaggcctaatctcatcatagttgatgttgtctttttttgatggcttctaataaataaatagaaacctcttttcctctggtccataccccttagaagtgccacatttaaaaaataagaggaaagccttcwtctcactggggcccatagcagtggcagatattgttatttgctgaattgcttctatctttcttaattaggtaggaagtagcaaccatcaaaaaacaaatattgtatgtaggcggccatcaaaacataagacaactgtttttcttccagcagaaaaccaatttggcaaacacttatttttctttctctatcacacaaagaaagtcaattctctaagaaaaaggrtagaaaaagaaaagaaaagaaaacttttaaataatatcccatatatgttttgagaattttatacatcaatacattaaaacataggcaggaaaatttcaaatgcaaacaaaaatcacatcttatagctcttagcaattccttgtcttcaaagactggaggaaatagcccactgggaaggcctttaacagagcaggtgcttccctaggggaaggagtaactacagatatttgagggctactcagaggcaaaagggctcaaaaaacttcagactgtcttccaagcaacagccccagaatgcctcctagatagtgaggctgccttcagttggcctgagattgttgctctgaccctggtgccacccttcctctcyaaccttgttacaaacaattcagaagggaggattgtgaaatccttcctgctgctctttctgtcttctgccaatcagagaagaytggacatgagatccaagagagggctttccctttccccgatggctacactgtgtctcctgcctcccagctgtttatggaaatcagatggtttcctcaactgtctatctttctgcagcaaatcctttgacagagaatgtgcaytgtcaaccaaccccttcatcgagtcaggcaaattaggattcctttgacagcaactttttacaacttccttcctttgaagatataaagctttaaacagtagtagttctccgtgagacccaaggaaaggtctgcagactataagcagactttatctgaagaccacctcctgcccctcactcttactccagaggcctgtgtatttatttatttatttatttttttggtaaaggcctctgctgtgaatttaagtcatctaatcaaaatgcattatttctgtccttgcattgtccattctcgtaaaccgtggttaacacagataattgagacttgagtgcttttttattccaagtcccttattcgatttggcccttgttaacaaagcctagtctgtaagagcgtgaccaccagtcttatttaccttgttatctgtaatttcctctttccctcaggcctttgcgtaatattttctctgcatggaaggggagrataagaaagaagacctaaaaactgaatttttaaaatacaaacagaaaaaaagctccctgtattttcccaaattctgcataaataaaataatatgctccataatggcagagatttgactgacttgttcgttgctataaatctagcacttacaatatctggctgtgaataaataatttcttaatgacttagcaaatgctggagacagaatgaatattgatattaataatgcagatcgtagtcaatttatttagctcaaacgttgtgcggggcaccactttaagtgcatttcttacattaagtcatataatctttataataactctataatataggtcctattttatcttcattttacaggtgaataaaggaagacggggagactatgtgtgaccagcacagggtcatacatctagaatattttggagacatatttttgcactcagactcctcaaaaaaacatttaacaaaatatgttatcttttttgtcacaatagaaaaatatgaactgaatattattacagtaaagtagattcaggttggttgaatagctgtatccaaaagggttaaaatataatctgtgtcgtcctggagaatgatttccgcatgcagaaatctaattgaatttaattgctttcatctcagtgatggagaccaagatatgaacacaagttggttactttgaaactttcataactcaggtattcccattgtacaatagccttgagttttgaaaagaactcaagcatgtataaggattgactgaaattaataaattgatactcagcaggtataaatatgaagcccaatagatgggcaaaagaatttctgaaacacaggatgggggtgatacgaaaatgacttggttgatgaggtattcacrctcctggacctgtgccaactccctctctgcaggttcctgcccttattgctaccctgtaattattcatctttaatttattgctcttcaccttgagcaccactctaaggcttttccatttacctaaagcagtaagttgtactctagtgcctacagttttctgtagctggccttgcgggttcctctgctgagaaaagttcataccatccatttcagttcccttttccatctctgagtacccctaactcctttcctccctctcagagaaagaccgattcttcctccttttcatgacatatcccttcacttgtacccttgaactcactcttttctgcctctttcttcatttcgcatttcccctcacactcttacatcttaaattttccctcctctgtgaatcctcccccagcctccaaacgtggtcaaatctccccaggcgaaaccaaattatttctccttcaaatcgctgcctcccttccccagtcttcttgaaagccatcttcactcaacatctctatttccttgcaagttcataccttaatactccgaaatggagctcctgtcctcaacattttggtgaaaattctctcttttgaaggtcgtggaaactgaacagctgatttccctcaactgtttcttagtcctgaggctgcttgaagtctctgaagcaattaatttttaattttaattttattgaggtaaaatttacataacrtaaaattaagcaagcgatacttaattactttctaatgttgtgcaaccactacctttatctagttccaaaatggttctgttaacccaaaaggaaactgtatacctgttaagcatgttctcccttccccagctcctggctttatgtatcacctatttttatatataatataaatgaaatcatacaatacttgggcatttatgactggccwcttttttttttttttttttttttgagacagagtctcactctgtcgcccaggttggggttggagtgcagtggtgcgatctctattcactgcaagctccacctcctgggttcaggccattctcctgcctcatcctcccgagtagctgggactacaggtgcccaccaccacacccagctaattttttgtattttttagtagwgaccgggtttcaccrtgttagccaggatggtgtcaatctcctgacctcgtgatccgcctgcctcggcctcccagagtgctgggattacaggcgtgaatgactggcctcttttactttgcataatgttgcaaggttcatccacattatagcatgtatcactacttcattcctttttagggataagcaatattcctttatgtggatggaccacaaattgtttacccattcatctgttgatggccatttgggcttttttgactgttatgaacaacactgctaccaacctgtgtgcaaatgtatttgagtactaattttttatttgtaaatacagtgacaataatgccacaaaaacattgcatacttacaagatttawgagttacataatttacaatgattgagtgtgggcagctctattatctggatttcattaagatgatgctacaaaaatagtaattgttagtaataataatgctacaaaaacgttgtatrcttgcaagatttacaaattacataatttatgatgattgaatgkgggtggctctcttatctggatttcattaagatactcaggattctttacaaacatgctaggtttccacttagagcaagatctcttaaaaaaaaccctgcttattgaccacagcagccagacccgggcctccttctgcctactgtcgccataactckagttataacttgcttttgggtttatacctaggagtggaattgctggctcaaatgataattctwtgttcaactctttgagaaaccacccaactgtcccctaggagtggaattgctggctcatatgatarttctatattcaactctttgagaagtcacccaactgtcttctacagcagctgaaccactttaattcccagcagagcattggcagtccttgaaatgctcttccgtttgctgtttaagacaccatactgtccttgttctcccactctttctgtatagaaacccatatrttttcttcctctagttcttcttmttattcctcctgccattggaagtgcctgtccatttcctgtcttgattttcctttgctgttttctaccatcctcaacaattttatccaacctagcagctttaaagatctcttcttcagcatgtctccaaatttatagcttcatttctgacctcaggtccrtcgtgtctacagcgcatctccasccgtacatttcacttgcctctcggggttaactgtgtgtttctgaacgctcatactggggttaactgtgtgwgtctgaacacctgtacctcattacctcattacttccttacctcatcttcctaagtgcacggtttcttgcagtgccatcctcgtcttcccatgcacctgaacccaccaccttgtatttgtctttagttcctcaccacctgggaggtcagtggtacttcttatcctttctctctctcccatgtggtttctacctgcaaactcttcattacagtggtcacaactggtttgaacatcatttcctcttatccagccaagacagggccactttcttttaagtttatctttctcccttttcctgtgatccaatctgcgtgcctgttactatctaattgacttcccraagaataactgtgatcatatcatgccctcttcaaaggctgtcagtcttcccatgcttactgagccacaacsaaatgagtcccaacctgctttgtcactttcagccctcacaattccctgtcattcatgtgattctcctaccaaagtaagctgcttatcttctatgttcactgaaaatggtatgtttccttccacatctatctctaagggatggcataagtgggttgcaataggwttacaggaatgaggatcagattaagagctgtggcatcagtaaaaccaataactcttgatttattatgtaacaatgtatatttttagccaaacaaatgctagataccaataggtaaacctggtactaggaatttcttttcatttttgctttctttgagatctgtaattaatcatggtgaaaataatgctacagaaacatcatatacttacaagatttgcaaattccataatttacaatgattgcatgtgggtggctctgttatctggatttcattaagacactccggattcttcacaaacatgccaagttcccacttagagcaagatctcttaagtaaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtctttctttccttgatttatttggactatggtttctttggccaaccatttaatttttttkttgttgttaactttgtccttgttaacattaattctctcatgtcatgtggaaatgagaataattcagawattgtaagagaaggaaaatggttagataaattagaagcatgaataattgatagagaaataattcaagcagctaactatatcatgcattctctgcttacttcatgaatgatccgtatgccatgtccatacgacttaatatttatttttagaaacctttaccaaaatgagcaagaagtagtaaatgcctcattatcctttcagagcacctaatgatacattattttctgttataaaacttcaaggtttttgaatgcattgttataaatccagactgtcaacatttctttggcaagaagcagcacaccatcctatagaaataagatgtaagattaacaattcaggttcatatattttcatctgtccctgaattccaccatacatggcagaaaaccacaatcatgttttcatagcaaatatgttatgacaaactatacaacatttaagaacatttagaaaagccaaaatggaactttcagaaataaaaccttggctgttgtggtggctcacgcctgtaatcccaacagtttgggaggccaaggcgggcagatcacctggggtcacgagttgaagaccagccaggccaacatggcgaaaccctgtctctactaaaaatacaaaaattagccaggcatggtggtgcgcgcctttaatcccagctactcgggaggctgaggcagaattgcttgaacccagaagacagagactgcagtgagccaagatcgcaccattgcactccagcctgggtgacagggcgagactctayctcaaaaaaaaaaaaaaaaaaaaaaaraaaagaaagaaattaaaccttaaatagcaaaatagaaaagacagatcatcagcaatgattaataaaaaagctattttataaagcggtgattgggaaagtaaaataggttgtayagattgggccaaagcctaaagatattctggtgattctttccacgatagaagaccgtgaaagaggcaatgcagtgagaccataagccttgtggtttgggacacattcttttcgaaggcctaactttttctgttggtgaaatgggaataaaaatagtacgaatttccaggagttaaattagagttgaatgagataattcaygtgaggctcttagaaagatgcctggaacatagtaagaattaaataatatcatctaataaagtgagaatgaccacagaatatgtctttatatggtattcattgttaaaatgcctagggatggagagttctggctttagctgtaacttaatataggagttaaaaaggtatcataaccttaatattaggtctcgggaggtgtcactaggactctgttatcctttcttcccttctttcttttttggctttctrtatgtcttcattttcagacarcctctctcctggggtatcagaagacacactcacattaggataatgcagataagatcaattcacagtaagaagatttatcaaggtaaagtgaagtataggagaagcacatgagaacccaggagcataaattgataaacacaccaattgaaaacagattggctgaattttaaagcaatagatatatgtttcttaaattagatagaccttgaatggaagggtacagaaaaatasaaaatgaaaaaaagtaagaaaatatatcctgtaaatattaaccaagagaaagttgatagagctatgctattatcagaggaaatagactttaaggagagaagtatcgctacagataaagaacgctatatcatatttatagaactatacagcaggcagatataataattccaaattaggatgcatccagtaacatatacagcagccccccttatctatgggaaacacatttcgagaccccgaccgggtacctgaaacctctgatagtagcaaagtctgtgtatgtatatagtcacgtgtgacataacaacgttttggtcaatgacggaccacatatgtgatggtgatctcataaaattataataccatatttttactgtactttttgtgtttagatatgtttaaatacacaaataccattgtgttacaactgcatacagtattcagcacagtaacatactgtacgggtttatagcctaggaacaataggctataccgtatttcctaggtgtgtagtaagctataccatctaggtttatataagtgcactgtgtaatgtttgcacaatgccagaatcaactaacaatgcatttctcagaacatatccttgttaagtaacgcatgactatagtatgcttttcctatacatatgcaaatatgacaaagtttaatttataaattggacacaatcagagattaaaaacaataacgaatagtaaaatagaacaattacagtaatatgccagcatcactaatcttgaactttggggccattaagtaaaataaagcttacttgcatacaagcactgatatctcagcagttgacataactacacagctactgagtaactaatgggatagtatgtacagtgtggatacaccggacaaagccatgattcatgtccagaacaggacagcaggatatttagtcacactactcagaatggctcagaatttaaaacttacaaattatttctttctgaagttttccatgtaatattttcagactgcaattgactataggtaactaaaactacagaaagcaaaactacagataagagggtgactggtgtataaaataaaactaatatatataatagaagtagtcaaaatagaaaaacccatcatcatagctgaaaactttaacacatttctacatagctgatataacaagtagtctaaatataaaaaagagtaataaaaatttcactaaaatctgtaatatagattttactaaacaaaatttggttctaacaaaatttacaaaaactaagggtatgcattctgcagtgttcacgtggaatacttatcaatatattgtaggctggtcatagagtacatccaaacaagtttcaaaagatagaaatcatacagattgtatattctgaccattttaaatttaaaacagaaattaataacaaaaaaactaaaggatccccacatatttagaaactatgcaatatatgttgaaatattccatgggtaaaataagaaataatagtaagaagtagaaaatagtttgaatggaatataatggaaatacaacataacaaaacttgagaatccagataaagtagaggaaagatttacaaccttgaatgcatatataaatcagagaacaccaaatttaactctaataaaatggagggaaggaaataacaaaaatacaatttataacatagaaagtagacatgcaagaggataagtcaataaagtttgttctttgaaagttctgtaacttgatatcaatagtccctagtaagggtaattaagaaaaaaaaaagaaaagacactatggctaattaaacaaatggagacagcactagagatctttcaagaataagaaaaaagaagaaggcattgttaatacatttataaaaattaatttgaaaattaaaactggcaaattctgtaaaataaataaaaaatcagtgtaccaaagcataccaaaaaaaaagaaatataaaatctggtaagttctacatttattaaatgaaaactctgtagcctaagataattccaagtccagatggcttcatggtaaattccaccaaacttttaaagaagaaaatacactaatcttatgcaaactcttctgtaaaatagaaaaaaaatgaaacgctttccagcttctttctgaaggccaacataatcttctttgcaataactgacataaacattgaaagaaggaaaaattataagccagtctctctaatgaatgtatatgagaaggtagataaatttgacttcaataaaagtaaaaacctgtgctcatcaaaatacatcattgagaaagtgaaaaggcaggctatacagtggaaaaaaaatctttgtaatatatgggtctrttacaggacatttatctaggacatgttaacaactcctacaamaatataacaaaagggcagagaacccaactaacaatggaggaaatatttaacaggcttttaacaaaagaggatatctacatgaccactaaacatattaaaaggtttttagcatcactagtcatcaaggaaatgcaaaggaaaactacacggaaattattcagatactattatacacacatgtgaaaattaattagaatttaaaaagtaagtataataacaatagcaaggacgtgtggcaatcagaattctcacacactgtaaagctgaacattcttgacctagaaatcctacttccagatctataactaaaacaaatgtatacacatgtacactaaaggctcttacaagaaagtccagaataacactttgtaatagctaaaaactggaaacaactcaaaagtccatcaagggacaaatggataaattttggcacatatatcatatgtatataccaaatacatagcaaaaaaaaaagcaactgttattatgctcaaaaatatggataaacttaataggcataacattgcatgaaagaagccagatagggaagggaatatcctatggaaatgaagttcaacagcaggcagaactaactaatctctgttgagctatagatggtgatgtgaactaatctatattgagccaggatggtggtgatatggtttggccgtgtcaccatccaagtctcatcttgaagtgcagctcccataatccccacatgtcacgggagggatccagtggcaggtaattgaatcacgggggtgggtttttcccatgctgttctcgtgatagtgaataagtctcacgagatttgatggttttatagaagagagttccctacacaygctctcttgcctgctgccrtgtaggatgtgcctttgctcatccttcaccttctgccatgattgtgagtcctccccggctatgtggaactgtgagtccattaaaccttttttactcttttttgtttgtttgtttgttttttgagatggagtctcactctgtcgccagtctggagtgcagtggtgcattctcagctcactgcaacctctgactccctggttcaagtgattctcctgcctcagcctcctaagtagctgggattacaggcacgtgccaccacacccagctaatttttatatttttaggagaaatggggtttcaccatgttggccaggatggtcttgatctcctgacctcgtgatccacctgcctgggcctcccaaagtactggcattacaggtgtaagccactgcaccccagtctcaggtatgtctttattagcaacctgagaacagactaatacttgtggttacctttgaaaaggtgatgactggaaggggcctgagggaggtttctgagatcatgacagagttgtatgtcttcatctttatggtggtgacataggtgtgttcactcaaaaaaaattcaccaaactgtacacttacacttttgcagtttaatatatgaatgatacatgttatgctttaattagaaagttaaaagtaagtttttttcaaaagtagtaattggatgactcccgcttttattgagttagcaagtatcttttactgccactttctattgttaaaaaaaaaaaaaggctcaccactgaggctgtaaggctaaatccttagcatgacacacaaaaccatctataaaccagtttctagcctttcttcctggccattccctttgacctgagctgtcttgaatattcttaagacttgacaatactaattttaaaccgtctaagataagatcacctcccactccagaaaaggggtgagggtagatgttaagaccagagtgtgcttccagcacacttgtattttttatggtactaagaaagaaaaatgctgacgcttaaacctgcacacagtaattccttaacatcaatggtaaggttcctccctaattttgraggcattaaaatggggtcggggaaatgtcttacaaatgatattttttaaaaaaataaaataaaacaaagataatcatgtcttggattatcatgactcacagcaactttactttcaaaagtaagaatatttacttctaaaactatgaaatcttcactatattcttaaaaatataaatcgttaaatgtcattctttagctctaaatacaaagttagtttgttgaacttcatgagttacgtcttttatcgggcttggggtgtgaccttagcccctctcctttgtgaggggagatggcagaactctcagaagctttttctattctcatctttgttggttactgkggaaaaactggatttcgctgcactcatcaaataaagaggcccaggtagcagcgcctccacgttttgttcaagtggggttttctgcgtgtgccgctggccaattcttcaagaaaagtgtttgttcttctctggcggtttggtgttyctatgtttcaacatggggrtaccaaataattcatttccccttttcccaacaratgcattcttgtgacctcactgatgacaggggcgtcrtttattctaacaaatgcwcttgtccamattccaaccatgttgccaagagatggcatagctggtgagggctggactttaggggccaatctccactcctgagctcccctgaccacacaggaagaaaacrttaatgatgttcccatactgatgttgtggtgtaagtgtctcctgtgtaaatagaactaaatatttaggaaagaaaacagaagagtcttatgtagtgcattacaaactagaaagcttttgaagtcagcatctgggatggtcttaaaaacaaacgtgcagtctgagagaaagaattactgctgacacacgctgacctcacagaaactatctggtgatgagattatctctcttccaggactctaacaaggctttgcaaggatattttcttgctttgctttgctttttttaatcttcttaactggtggaacctcttgttatgtgcaaatctaatccattctcattcaaagatggatgtcccggttttactgtatctgccttagttggagattcccgggaagaaaagcccaggacaagtggtcaggtgcaggaacttgatctgagaggtggtcccaggaagcagaagtgagttcatggggacattgagaagaggaaggaggccaatcaaaaaagagcatttctgaggttgcttctgtacacaggggcttcatttcttcaattctcccagatcctctgggaaccctatgaaatgcttttcagaattctcagagtcatccacctgaaaaatagagggactggagccttttttcctagtctccctactgtccatggattgagagttgcctgggagcagggagagcgggtgttaactgccttctgtttagaacaagttcctgtatgtgtcagagatctggggcaggatgatttgcagtcatgtaagcttaggttgaactctgggagagccaggtgagtgtgtgctcaaaaagaactgtccagtgcagctgctgctgaaatcagaggtgactgcaaggatgtaacactggcgctcgggtgtctgccatggcctaggtttcttatgagagattgaactcttcggagattccatcattcagagcaggcacaagacggtttggccaccaatctgggtagagccaggctgttgcatgacaagtcagtcaggagaaaactgaggctagcaggctgactttctggttccatgacacacatcacatctgcaatagagcttaaagacagggtgcttatccctcaaacctccctgtatcactaactttcttaatccagacttttgcctttgtttttttttttgtttgtttkttktttttttttttttagaaggagtctcgctctgtcacccaggctggagtgcagtggcaggatcttggctcactgcaaactccacctcctggttctcgccattctcctgcctcagcctcccgagtagctgggactacaggtgcccgccagcacacccagctaatatttttgtatttagagtagagacggggtttcaccgtgttagccagggtggtcttgatctcctgaccttgtgatccgcaagcctcggcctcccaaattgctgggattacaaacgtgagccaccgcacmcggcctacttttacgtctcataacccaaaagctctatggcttcaaaaattcccaactsctcaaaaagctgattttctgttttatcagtgcccctttgattgataaacaatatattaatataagatggatataaagcagatgtattttgttgccacaacttctttggttcaaattaaagaatataggtcatttgtcccagagagtcagtccagctgaaaaattgtggatgttgataaatgcrtaggtctccattyttaaaaatccagcatttttgtataggaacaaaactttacttggattataaattgcaggccttctttgaaaagacaaagtgtgaaagggaagagaactgtagagtcttcctgatgtttactgagcccttactccaaaccaggacttaggcttgttgcatcccctccattaactcatgtcatattgcctaattcataaagaggcccagagaggcagtcgaggtgtagaaaggttaagtaacattcccactgcctcataacttgtaagtaatgaaactctccggaaaagttgagctcagatctgaatccagagcctgcatgcctaaccgcagtgcaatgctatcctcacctcactgtgcaaatacatctcagatctctgcattaggatgcacaggtttacattttttaaragcaggtaataactgtcttattctgtacctattgtctgttttcacagtctgctgtgaacccttgctttcagctgggacactgttgccttccactgccttccacagcctctttacttccccttaaacaacctattccaactggtactacttgrtaatagtcattttctctcacctgaaagcatgcctctgtcaaccaggctcttcccctcaatggctaatgactctcactcctacactcctgcagagggcctggcacatagtgggtgcttaatacaagttccttggcacaaagaatataggaataaatacggggacyaaggtattgcgctctccattttacaaaggagaaatctagccttggtctctctgataccacagtctttcccaaagttgcacagcacagtggaggagagttggacctagggcccaggtttccaggatcctggtctagtgtaatgtcagtttctaattatgtggtccacacacatgaatatttaaatcagcrtctcctggagataactcaagaggtgactctaatggtagacaattgaggctgtacatcagggttgcaaaggggctttgtccggatgagtggattttttgtgtcccttacaccatgtgaattcccagcatcatggtttatgctaatcctctttccaaaatagtttcctggkgaccttctccctgtgccaaccccggaatacaatgggatgagtaactggcaggtccagatacagaaaatgagtgagcaatgcctttcccagctaaaaattcttccagctcacccatggtgtrctagggaagatgttctcctatgtcctgaatgascagcagcagaggattcagggcacccaatgcaaaattgtcaccaaatgactgtgacactraagtggctcatgctgctctttgcactgcattaagtgaaaccagacgcctccagttaaactccagtgagctaaaaagtatagtgataaatatatgaaatgagtagaaagaacaaaaataaagaagcctcaccccagatacggcacttatgaagaatctgtgtctcagtctcccagcaaaattgaaacgtaattcaacttcagatggtcaatgcctgccttaatgccccatgctaatgtcagccctgagatgtcacaatagtccaggagatgcttacctgaaggagaggccctctagagaggctgtgagaactgtgatttggagctcgaaactgagatagtgagctgggcagggtgacaatttatggagaatgggaaaaggaagagggaagtattttagcaaaacggatgctatcaggatggctgaggctttagaaccagatggagtgctgtggcctctcttggatggatgctgtttctgagctttgcatctggaaagacagagcctgctctaggrataatgatgtcaaagatctttctcattttactgtctggttaaatatcacctcttcagagaagccttcccttatcaacttacttaaattgagtaccccctgtcagttttctatcacagtacctcacttgtgtgtgttttccattcatagcatttgttacactttcacatttttaaaagcgttgtttctttttttgttttttgtccatctccagttcctatcagtgccctaccatgtccttaacatttagcttagtgcctgacacgtagtgcttcagtaagaagtatcaatgtggtaagtgaatttctaatcgaatagcagttacatcataaatagtcaatgattcttgtgatgtctcatggtcccagggatcatgagatacagagtgacagaggatggaagttcagttttcttctctatgtaacaggaagcaaggaagtgatcgtcagaataactgcaagatgaccctgctggctgctgtgtgacaggggattagaacagtcataaaagcaggtagagaggtgtttcagttagctatggctgtgtaacaaactactccaaacttagagacttgaaataatcattctatgtggtcatgtttctgtgggtcaagaattccagcaggattcagctggttgtcaactgggtctttcacatagcttttttcacctggtaacttagctaggctggaaaatccaagaaagcttcactcatacacctggcaccttggtgattctttgcatgcaccttggtgattctatgtgctrttttgtctccctcatagctaatcagatgtcttatgtggtggttggcattttttttttttttttttgagtcagagtattgctctattacccaggctggagttcagggtgcgatctcggctcactgcaacctctgacttccaggttcaagtgagtctcctgcatcagcctccctaatagctgagactacaggcacgtgccagcacgtctggctaatttttgtatttttagtagagacagggtttcaccatgttggccaggctggccttgaactcttgaactcaggtgatccacccacctcagcctcccaaagtgctggaattacaggtgtgagctatcacgcccagcctggtggttggcttttaaagggagcaggtcaaccatatgaaaacagaagctatggctctcttgaggcccagccccagaagttacacaccatcagttcccctgtgttctgttcgtcaaagcagcccaagattatctcaaaatcaagaggaagggaaatagattcagctcttcatgaagattggcaaggaatgtgcagccattttcaaaccaccccgcagagagaatggttaggacattgttatgataaacccagcctaaggttatagcaatagagatggacagagatgatttagctgaagatatagctgtagttagcatgaccagacttgccaatggttgtaatagggtgtctggattagggagatgttgtttatctctactagtttcctgttaattactctatgaacaaattagcacaaactttgtggcttaaaacaacacaaatttattctgttttagttttggaggccaaaagttcaaaatgagtttcacaaggccaaaatcaaggtgtcagcagaactggttccttctggaggctccaaggagcatttgttccttgtctcttcagtctctggaggcagtcgtgaccccttcttacaacttcaaaggcaattgtgtaacatttttgcagggagagtcctgggaacagtgagacaagttggggagaggcaagtggaagggacagaatcaagattgaagcaggctaagtatgaaaaatttgtaagatgtccaagcggagatgccagaaaaagtcagatgagtgtatgagtctcacatttcagagctaaaaatatacactctggatttatcaatataaagttagatgagggccaggtgcggtggctcatgcctgtaatcccagcactttgggaggccgaggtgggcagaccatgaggtcaggagctcaagaacagtctggcccacatgatgaaaccccatctgtatcaaaaatacaaaaattagctgggtgtggtggcatgcacctgtgatcccagctattcaagaggctgagataggaaaatcgcttgaacccgggaggtggaggtcgcagtgagctgagatggtgccattgcactccagcctgggtgacaaagtgagactctgtctcaaaaaaaagaaagttatatgagtattgttgaagtcatttaggaacagattttttagcaacatcatccagtagaaatgtaatgtgagccagaaatgtaaatgtaaatgttctgctagccatatttaaaaagtaaaaagaaaaaggaaaattaatattagcaatatcttctttaacctgattattatataatgatcattccatcatttaagcaacataaaaagcaatgagatattttagataactttttccatactaagttttagaaatccagtatgttagctcactttccaattcagactagccaatttctttttgatggagaaaatgtatttaattaaaagaattattcttactattatttttgattggcaagtcataattgtatgcatttatgaggtacaatattatgttttgatacatgtataaaatggtataattaaatcaagctaattaacatgtccatcacctcagttacctatcctttttttgctgagacatttgaaattgactctcttagttattttgaaatatataatacattattattgactgtagtcatcatgctgtgcaatagtctcaaaacctctttctcttgtctatctgaaactttgcactcttagctaaaaaaaatctccccagtccctcccctgcacccccagccccaggtaatcaccatcctactgcttctaggagtttagctttatttgatttcccatacaagtgagatcatgtggtatttgtcttctgtgccttagccatatttgtattatccactggccacctttgtctcctggtgatatactggacagcacagctttagaaagaagagattctagaagttatccctgaggaatcccagcatttaatggtcggatatagaaaaagcttgaaggtagaagaaaaaccaggacagtgtagtattgcacaggtaggaaaagccttaagaagtgagttgatcagctatgttgaatgctggtacaaagatgggtaagatgggatggagaagtttctacaaaactgctgctaattcaaagaaacagatatagaccacttccaggctgggcgtggtggctcgtgcctgtaatcccaacactttggaaggccaaggtggacagatcacttgagatcaggagttcaaaaccagcctggccaacatgctgaaacccmgtctctactaaaaatatgaaaattagccaggtgtggtggtgcacgcctgtaattccagctagtcgggaggctaaggcaagagaatcagttaagcccagggggcagaggttgcagtgagccaagatcgtgccactgcattctagcctgggtgacagaacgagatttgtctcaaaaaaaaacaaaaaaacaaaaaaacaaaaaaaaaaaaacaagactacttttaggttctcgctctttggatgtgttgctgtttcctgcactctcttcctactgtctttgggtggtagatggaagggtgccacaggacacacagctggggaaacttcctcttgcaaagcctctactaaaccatgccacaccactgtataataactggaaaatggctttgggacttaaaagcaacttcatccaagaagaattgcagtttggatgcagtccaggtataaaacaaccaccttcactcctgtgtgttactgtaaagcttgccttctgtaaaatgtcttaagcataagagctgtaaaggaaaatactcatggattatattgtgatttgaaatcaggatgtaatamgatagtgacagcttaaagattcttctaaaactagatatgaaatttgaatgtggcacctgtctataatttgtaaagcactttggctttttctcagctacatrgtgatgatgagttcttctcaacaagtgactaagctctaggggaatcagtttctcaatttgcatgagatacgggagcttcctaagacatgagactttcagttttaaaaccaggatagtsttgagagagctgcccttgtttttcggagacatgcaggcttcccaagatgtgagactttcagtgctaatcccaggaaaagtcctaaacaaaaggcaacgagttggttgcccaaccaagctgggaggccttctgaccgaggacctcctgaagtcatcaacccaaagagaagaactgcctcttagggctgactgatgcttacaaaagggattataaagcctgaataccaatttcttaatttgcaaagagaaatgatgtgacaaggaccaggaaactcaaagtccatatggtcagcattttctgtctctgtataaagccwatctattaatttaaagaacagaatgattatcacatgcattgaaatacacaaagtccaaacgatcagcaaattctcgcccggtgtgaagtcagtcttttaatttacaaagaaaaattactgtcacagagactggaatgctcaaagtccacatggtcagcacattttctgcttctactctacccttcatggaagaccaattcataatcagaaggctgcttagtgagcatgaagtgttggttagagtgagtgcttaaaggcactggactaagaaagcctaactttaccaaggggttcagactgtctttgtcaccaaatgctgaagtctttgcttcagcaatttttcctgcctctaggatgagtactgcaaagttgcctccaggaggcatcttattttccaagctgccatggatgactgacckttttaagcgtccttcattcttcagatgtgctaataccatcaattaggtagtagagtttcacttccctaggagccattttgtctttgctacatttatctttgctcttattccaaagagcagccttcattctcttcctatcaaatctttcagcagcagaaggcaactgactgtatctctgagtaatgttgataagtattgtgttgtggaggctctgcatagtacagtggttaacggcacgggctgagaactgaggaatacctactgtctacttgtctactaccatgcagaactatagtaagtcactatatccctttgagccatagtttccagttctataaaatgggaaccatccatagttggttgtatcaaggactcaatgacagcaaacaagtaaaagaacccatatagtgtttgagacatgattgtgctcaagaaatgataggaaacaaacgtacaaacgacaagcattttttgctgcagtttggaagtattaatgttttacaacctccacaaactaaggttcatgatcgaagaacctcactgaatatttaactttagggataaaatgcacaacctataataattttagtgcaattgatttattatagtcaagggaaacatgactgaataacaaaagtaggttaggaaaatactgaaacagaataggatgaagaaaagcattttaatgaaaaaggaaaagcagagagcagagtagtaatctctcttggttcctctccttccgtcagcctgctgttcctgcccctctcttcttctctctggcctctagataccggaatgtctcaggcctcccatcccctctatcctccatttygccacctgctctggccaaaaagtttgaaggaggacctatgaaaaatatccctggcctgggcttaagaagccttcaccctcattctcaactctgaggctaccagagcatgatcagytcatcatctcagtcaatcctcccagctcctctattagatccatatgactgccactttgtgaaagatacaaggagracttggcaaaacaagggccccacctgaaatggatagctgagagcattaccacagtcggatctgctgggttgaattgtacacagcagatgccaacttccaatgaaattagaatcatatttctatacattttcttaagtgccagacatcattctaatcattttataggcattatctcacttagtgtctaaaaaaccctaaggttttgccatataactttcatccccactttattatctatctagaataactgaggcttatggaggaaaactgactgactcattgctgcttggctattaagtggaacttcccaagactctgtaactttggagactagtcacatatgaaatatgctaccctctcacttgtgtgatgrcgttcagggtttggcraatgttgagcaagccaataaggtaaggctgtatgcggtacaattctcacactcgttgctctttttgttgtaaccagcctctttaaacactatggcctgaccctctgaaccagccacctgaccattcttctgacttcccaataagcctttgccatcaccaaacatactggcctccatggtcttcatctttaatgccattaattaaaaaaatatgccccacagctctgcaagaagaattcagcaggcagttggcataaaaaggttgggaatggtttacatctttgagcttcagtattttaagtctgsaagttcatggagtgcaagggctgtggacaccctgcttgccaatttttctgccttaaccgttccctgcccccttgttgttcaatttctggccaatgtctamattttccaaaaggaagtatggtcttttgcattatgacacatgattgccacccactggttaagaatgttttcactatgaaggtttagaaggtttgctgttgaggcaaaagttacccatttcccatgcccccagttcagttgtctggatatcccagaacaagaagcattaactgcttcaatttaagtcagattctcaaaatcccaaaggcatgtctttcacttatcccataaaacatctaattaaattatttcatttaattgtacatcttgaattatttgtttgcatcttgaattatttttgtcaatgcgcattttccaataaaggagtaatcagtggtctcaatgtcattcagatgaggccacccttatttatcagagttctaacaccaatcagtattcatccacagggctctttagtggaactgtggcactctttagtggaaatgtgagtttcagatttctgattaataaaaataatttgtaaatatgatcacataatttttgcaataccgttttcttttctaagaatcacctatagaaacacctactacgtgccaggcattgttttatgtgaacatttcatgtatgtaacagccccccctaaggtagaaattgttattgtcattcttattttgaagatgaaaagctgaggcatgaagagggtaagtcaccatccaaagtcacctatctaaaaaatgcaaagccaagattcaaactcaggaaatgtgttactagaatcttatctactatgccatgytgcctctcagaaagactatcactgcttcctccagcctcatcctcttgtcttttcctgggctggggccatcctcaccctgattggctctccccaaaggctcactctgacacccattccagtgctaaccctgttcagagtggacaggaactggtccatgcatctccttagatttaacacgataggctctgtctctcacaagggcaggcagcaagcaattgtcttttagaggaaaacaaaccatttgaactaaatgttgattcttgctctctctagaaatgcagacagaaatcggcaatcagtgtagttgatggataccagaaaaagaaataaaagtaaggaaatgaagaaaaattgggccaatggcactttaaaaatttcccaaaattttgaggacaacttccctttttttcaaggcacttgatgcttctctagatagaaaaattgttttcacctaaaatatcacactagctgttctgaaatcctcttgcttcttggcatgcttattaagaaattctgctcttgcagcaacaaatctcagctttctttgcttctagagaactttaaaatcattaactatcctttaaaaactcactcttggaaatacatgtggtctctttccctataactaaatatttgatacaagccactatcaacttgatactgacagtttaagggtgttgggtacgatgacctttgaggtsccttctggccataagtaccaaggaattcataaagttggattaaatgataacaaaaattggaactttccctttatcttcttttcttcttaaagaataagttaagatacattgatttcatttyacaacttgcacggaaatgagtgttttactgttgatgtttttatgatctgtagtttccattctttttaatagccttggtgcagtattaaaaaaactatcttggtgataaaagttattttagaagtaaaagttgctttagaaaagcaaacatgactaatataatccaagttttctcaggaaggaaagcgctagtgtgactggacaatgctgagacgcccaagaagatgattgaccttcaattacaytgaagggaatgactgaactatttatctgtgagggattgtaaatcaggagccaagggaaagccttggaaattcaaatgtaaaaacctagttcagcaaaggagttgtcttaagcaatagtatataaatcaggcagggttaggttatactacagtaataaacagcccccccccccccaaatatcaatgacctaaacaacaggagtttatttattgctcatgatatacaaccaatttaagttaggaggggagttatgcttcacgcagtcatgccacatgaggtcatgatagcaccgtcttaacatgatgcacctgagttctcctggcaaaggaaaagaacattccagattctgcattcacaactgaaggctctcctaggcatgagacaccatgcctcttactgtgatttattgatcataataatgtatagcctcatttaattgcaaagggatcaggaaagtgtcattctgaacattctcagaaaagcagagacctgattatacatgagtgttagaagcctctacarcacagcaattgtggactgaatgcttcattcaggcaataagcaaaagcctccttcagcagcgtattatttaatcctcacataaccctgcaaggtgtgggctttcatgatccccctttctcggataaggagactgggaatcaaggaggttaaatagtctgcccagagatgctccccttcctattaagagcccagttgtaaacctrtgctcctgactaccatgtagctcttccctgagagctcctccaagccttggttaaagggccagaccctttgctctctgagcaggaggagagcaacgtctgccctcactgacccattaatagacacctgtcagtgaggaagrgaggcttgttcacttcagggagctgtggtcgcttcccctgtgccactggaaaactaataattcatgaagttggctttcaggtacgagcaagctggactgaatagttgtttsaagtcataaacatagaaaagtaagttgataggagaagactatgtggagaaaatttaaccatgttaaatatttgaataaacatttaaaaatacatagcatatataggtgcatatataataaatttgagacartaggcatgacagagttctgaaatagtttataagtatgtgagttgtaaatatcccatttatattatgcatagattataagtaaaatacacagaattgattctatgctccatcatctatgtggtcatctaatcatccatctctctaaactaacgtcaaagagacatataatttaaagcacatatgcaattctaaattttcttggataagcttttaaaaactaaaaataaatatataaaattaatttaatagtatattttatttaacccagtgcatgcaaatatgattatttcaacatttagtcaagtcgaaaattgttccatctttttkgtacttagtttytgaaattgtgcatgtattttacccttaaagctaatctcaatttgggtgctaaaccttcagtggaaatccttgctctgtattcagtttataaaagatgcggttaaagaaaccaaactcacttgtccaaggtgttccaaagatacttcaaagtttgcaatcgtttagttaatctgttgacaatggttagattgctgttgtgtttatatataatgctagaaataatgcatatgttgggcatgtacattacaatatgatcctgtcttccagaccataaacacaattagtttttcctggaggattctaactcaccattgggtacctcttatatggaaaatcattagaaatgcctgtcctctctgcaaccagctgggaagaattttctgtcaaaagctagagatgtttgtgtgtttttgtcaatgggatcacaaacttgaagtcagaacagttggattctggatatgagtcttcttttaccagctgtgtgatcttaggtgttctgggtcccatttgggaaatgaggggtttaattgcctccaagcttgatctgtgcatggakcaatgtcgttatgagaattccccacattttgctcccttttggacctccctaaaattcccctaagaacacccctcactagtagaartgtagaatcccagaccttaccccagatctactgaatcagagtctgtatttttaacaagatcccctacattggaggaaagttgtagaaagactgccctggaggatttstaacatttctgtgggctctcatattccttttaaatatacattagaatgaaatgcagatattttaagatgatgtggcctttcagagagtagttgcatttactaggatgtgaaagaaacacttttcaaatggtaacgatgtgaaggtgtcctaagtgcttgtgttgagtccagcactgtgctggtagctcacgaactcctcgtgacaacctggaaccccatgaaccccattttacaggtaaggaagcacaacctgagagacatgaaattatccaggcaggcttgcgtggctagtgattgtgaagcttggatttgagtacaggtcgtctggttccagagcttgcacgaaatcactgtgctagtaagaaacagagttcgaggttgaacccgggtgactcagcatcaaggaatgggctctctctttggggtgtgtgtctgtgtgtgtgtgtgtgtgtgtgtgtgtgtgtgtgtgagagagagagagagagagagagctttcttaattaccacaccatactacctccattttatattaaacagaatattggaatcttgacctttttctgtatttaattagatgctgctgtttaataacctatcacaaaagttaggcaggcattcacacacatggcgatgagaattccccacattttgttccctgtgagccctccctaaaactctcctgagaatacaacagctgcatttaaagaagctgaatcccctattgcagattttattcctgtaaaaatatattgaacttgacgaaacagagaaaatgtggcctgcttagtcagttaccctgacactatagctcttcacaaaagttttaagatatgatcatatatttaatataatatacttagtataacatgatatatgtgctatactatagcatagtatgtatatgtaatatatataatatacagtacagcatagcaattgtctaccagtgacagatttatttttaagttttttattgacacataatatttttacatatttttaggatatatgtggtattttgttacatgtacagaatgtgtaatggtcaagtcagggaatttagaatatccatcatcacaatcatttatcatttctatgtgttgagaacatttctagtcctcccctctagctattttgagatgtacaatacattggtgtgagctgtagtcaccgtactttactattaacattaaaacttcttccttctgtctactgcctgtttgtacttaactaatttctcttcacttaccctcccagaccgacaaacatctgcatccttcccagcctctggtaaccaccattgcgctctttttctccatattttaggtcccatctgtgagtgagcatgtgcgatatttctctttctgtgtctggcatatttcatttgacataactatctccagttccattaaggttgcagcaaataatatgatttcgttcttttttatagccaaatagtatttcattgtgtaaatataccacaattttttaatccgttatccatttatccactgatgggcacaaggtccgttccatatctttgctatcgtagatagtgctacaataaacattagggtgcatgtatccctttgatagactgattttctttccttggtataaataccaagtagtgggattgctggatcatacggtagttctatttttagtgattttttaagaaatatccatactgttttccataatggctatactaatttacttttacaccaacagtgtatgagtttccttttctccacatccttgctagcatctgttattttttgcaatgactgatttctatgaacaggagtctttggagccttccttcatagccatcgtctcacacagtcctcactggtgctattaccagctccatttgcagaaaaggaagctaaagccaaagcttaagtgagttcctgataaatagtccatattttacctcaggtcttctgattccagacatcacgtggactgtctgaaagacgcaaaattagacaaacagcaaaaaagagaccctgttggtgtccaacacttataatgaggctcacttctgaggacacgtgcagcctaagcaaggcagccactgcctctcaccttacagcttgctgggctgataatggccataggggatcctcagccaatgaggggtaagatctgtagataaacatccttgggtccagcatccttgacccttaatggacaattctgggggatgtttctcactgtctcttagagagtccccagtaggattgagctccagttgcccacagtggaagtctttccatgaatgcaccctttattggcttgtgtccacaccctgtcttacttcccaactccctcacttgtgattcctggcataacctcccaaataaaagagtttcaccccagttcttgtctcaggggaccacaaagagagtgactatgtggccccgtgaagatgaacttgtgacaatggcatgaccaaggtttaccacctgagctctccctgttagcgctagttacatgtagcatgtgagctgggttcttctttcccagtcattttcctgtcttaaccttggggtgaaggacaatgttcttgacctagaatggcctaggcagagtctgataagattgttgyggatgcaaagggaacagggttgtggttgctgagcattgcatccagtgcgtaccttgttcccttgctgcactctcatcatgtttggattcagatgaactttgatgttctgtgtgaggtggacgttagcactgtatctgtactgagttaggcraggcggtcccggcaaagtaattacaaggaaatgctgtattttagattgtttgagttttccaatagagacatatcaatcttgcttgggaatactttgacttgtgctttgtgatcagatttccctgtgcttctggtgaagcttatggattcatgagttagctctgcaaatggagagtttgtgttagaagtcaaatcagttaaagctctttgatactgcacatattcatgggcagaattgctgcaaaaatcctctaaacacatacgaggagctacattatacctttaagtggcaggatcagcttcgtgacaaaaaccaaaccaggaatgagaggggaaaataatctaaatgtgttaagggaagtatgcaaaatggctgaaagctgacaaatggcagagccagaacgtgagttctgctgattccagacatcctgcctgatgaacataaaattggaaggaaaaaaaagtaaatgagctatgatgagaccaagtggcccatatgggtatcaaactcaacaggatggcatgaccaggcttttttactcaggcacaaagagcttttgagcattgtttgataatattccaaaaagaaaatgatagagccaaatttcccaaatgttccatgtaaaactaggaaatgactgaagcattcaycctcatttctaagtattgtaagtgtctggatcagaatccattgccatggcttattcattcagagcttgttgctggggattgggatgcttagactggcaggactggtgtctccttggctagacaaagatccttgcatggcattaagggagcctgtcctgacatttcataaaatcatttctgaaccgtgacgtttccagtattttattgtgaacattttcaaacataaagttgaaagaattttacactaaaccaccatgtgcccataacctcgattctacagtttacatttgacatttccatatacttgctttatatatataaatatacacatcacacacacacacacacagtccctgcctctatacatccaccttactttttatgcatttcaaagtaagcaacagatatgtaacactccaccccctaaatagatctgcatgcatattgttaattagaattcaatatttgcttttggttattttcttcttcagaggaaaatttacatactatgaaacccacaaagcttatgcgtcatgtttacattttgacaaacatatattactttggtgcaaaagtaattgctgtttttgacattaaaagtaatggcaaaaaccgcaattacttttgtgccaactgaatacaactgtgcaacccaaacccccatcaagatagaaaccatcattatgacctcagaaagtttcttcatgaccttcctagaggccaccaatattctgatttttcccatcatagacttgtttcaagtttcattggttctagaattttatatgaatgaaatcgtatggtatatatatttttgtttgatttctttcactcagcataagattttctttttctttcttttcttttcttttttttcttttcttttttttttttttttttttttttgagacagagtctcactctgtcacctaggctggagaacagtgatgcagtcttggctcactggacctctgcttcctgagttcgagcgattcttgtgtctcagccttctgagtagttggaattacaggtgcacaccaccatgcctggctaatttattgtatttttactagatctatggttttgccatgttggccaggctggtctcgaactcctgacctcaagtgatctgcccactttggcctcccaaagtgctgggattacaggtgtgagccatcacacctggccagcataagattttttagattcattcatgctcatacatcagcattcatttctctttgttgctaggtaatattctgtcacctggtcacttgtatagaccatatttattatctactctcctattgatggatgtctgagttggttccagcttttgattacaatgaataaaattgctataaaaacgttcatgcacaattctgtgtatagacctgtttttctttcgcttgggtagactcctagcagtaaaagggtatgtcatggggtagactcatattgagtgttatcagaagtgttcacttatttttctgaattggtcgatcctcttccggataacgcgtgagagcagtgacggctttgcatcctcacaaacatttgctgttactgatctttttaattttagcgattctggtgagtgtgtagtggcatcccattgtggatttaatttgcgttaccctaactacccatatgtatgcttattgaccattctgttctgttctgttccttaaaggaacattttgttcgtttattggctttgtttgtttttggcttggctaaagtcaaacttgcatcctccatctgacctgagatgagagtcagctcaaatagggatacctggagactgctcacgcgtgcatggttcgggggtcaacatcggcagagttttgggcagaattcatacacagaagttggggcttcctgtcactgagtctcttctatctggattttcctcccttaatttccaacagctactgttgtcatgaactctgttctctgttctgtaaacaagcagtccccaaccttttggcaccagggactggtttcatggaaggcaatttttccacatattggggacggggatgatggtttgggggtgaaagtgttccagctcacataatcaggcgtttgttagattctcataaggaacgtgcgacctagatccctcgcatgtgaggatcacaattgggtttgtaggtttgtactttgtactcctataagagtctaatgccactgctgatctcacaagaggtggagctcaggcagtaatgctcacttgtcagaggcacatctcctgctgtccggccaggttcctaacaggccacagaccagtaccggtccatggccgaggagttggggacccctgctataagccaccaagactatgggttttcagtcagaatgtagtttcccatctggcactggttggtcctcttatcaggctgaaagccagaaaaatgggaaatttacccagtgtcaaattcttccaagtgtttagcctccagttttttgtttgtttgtttgttttggttttttggttttttttgagacagagtcttgctgttgtcagcccgggctggagtgcaatggcgagatcttggctcactgcaacctccgcctcccaggttccagcaattctcctgcctcagcctcccaagtagctgggattacacgtgtgcaccaccacagcaagctaatttttgtatatttagtagagacggggtttcaccatgttggccaggctggtcttgaactcctgacctcaggtgatctgcctacctcagcctacgaaagtgctgggattacaggtgtgagccattgtgcccggcccaggtttttcatgcattgaagttcacactccacattccccaggtagttgtttattatatgtggccaaaagtttatagcagttttctacaggagaattggtcaaacaggggctactcagctataccagaagtagtgtcttctgcactataaatttgaatggctttagaatattccattgtatgaacgaacacaccttcttttattaaccttgccttctatggatggttattcatattcttcttattgttctctgttatgataactttgcctctgacacaaaatcaacctcactgtgaygcatactggatgtggaactgaagcaagggacaatttatctgagctcaagcttgctcatctgtaaaatgggataattataataacagaaaatatgtgctttaatgagacttaaatggaaataatatttccaccaaatgcaagtagtaatttagtgaaacaatgtgtgcaaagtacctagcactctctggcatgtaattaactcaaattaggtgctacttggttctctttgtagttgtcattgttaccattatccttgctgcctacactcataaatgtataaataaaagattggagaacaaatggcatgtacgcaaatgtgtttcttcctttttataaataaacataccatgaggattttttatgtcagtcaagttgtttttgagaacatgattttaatgactgcataatatttatttggatgatccatggtgttggaaaataataagttacatatctaccttatataaatttctctggggaaacaagtcattaaaaacaagcttatttctaatttcagcctaatgctgatagacaatgtcaactggataaagttgagtcgcacatttcagtagctagaatgctttttaaaagtactttcacgtttggactaataaaaatgacatatctgtctcatcccttttcaaggaagctgaagtgcctcatcaaatttattttaytaggatcccgacagcaatcttgtggcctgggtgaaggtcaaggaggttttgccttttgcagaagggagtaacaagtgatgtgatgataaagtgttctttctctctcggttcatccatggtgggaaagagcccttcagctcattcttcagttggaggtggttcagggccccatgttgctcaaattggtgatgacagccagctgyttggtcccaattcgctgagactaggaattcaaacccaggaaaattgagacacctgtgtatgaaaagcataaagagaaaatttggttgccctcatgctcactcttatgccaagtatttattcaasaattaaatgaataagaatagggatttcaactaygttctatcctcctcctcctcctgcatctgcctgaccttcttgggagccagatgttccactgaacactttgcatgcactgtgactatctaatgcaatccttgggacagatctgtgaaatagastctgttattagyyccgttttaaagatgaggacactaagattcagatggtttaagtaacctgtccagtgtccacagctcctgtattagctgagagtcytgtgccattatatcagaaaagtctgcttgtgtcttacagtcttgatcagaaacaagtatatccctcagaacatagaggcggcaatggggggtgactttgttctaacccacaaggaagattattacatgaatagtatgggaatcttggcagaaaattagtgggttattttttagtccttattagtaaggactccaggcaagatagagttttgttttgtttttgtgtttttttttttttttttttttttttttttttttgagacagagttttgctgttgttgcccaggcgggagtgcaatggtgcaatcttggctcaccgcaacctctgcctcccaggttcaaacgattcccctgcctcagcctcccgagtaactgggactacaggcatgcgccaccaggcccggctaattttttatttttagtacagacggggtttctccatgttggtcagsctggtctcgaactcccgacgtcaggtgatctgcccacctcagcctcccaaaatgctgggattataagcatgagccaccgcacctggcaagatagagtcttttaactttgaaaagttaggattcaaatcagtctagccattgaatcgtatttattgagcacctgctgtgtatcaacctcagtagaagacccaagagatatactggtgaatgggatagacatggtctatatttcagaggcctmctagtatacagttgaagacgggcattgaacacaggatcacagctatgctaataggggtgttactgcagggccatccaacctagaacaaggatcatattaccagcgtttagagaatagggtatacacatgcttttaaatgcacagagtgtaccacttcagagaatactgatttctccttagtttgggctgctataacaataccagtgactgggtagtatagaaaacaaacatttatttctcccagttctggagaccagaagttacagatcaggtaccagcagggtagggtttttggggagacctgtcctcttggttcacagacagctgccttttcattgtaaactcacacagtaaagagagagagagagagagaaagagagagagagaragagctcgcaaggatcatctccttagaatggtactaattccatcatcgggttccaccctcatgacctcatctaaacctaattacctttttttttttgagacagagtttggctcttgttgtccaggctggagtacagtggtgtgatctcggctcaccataacctccgcctcccaggttcaagcaatyctcctgcctcaggctcccaaattgctgggattacaggcatgcrccaccacgcccagctaattttctatttttagtagagacggggtttcttcatgttggtcaggctggtctcgaactcccaacctcaggtgatctgcccgcctcggcctcccaaagtgctgggattacaggcctgagccactgtgcccggccacctaattacttcttaatggcccaatctccaaatgttatcacattggggtttagggcttcaacatagtaatttggaggaggacacagaagttcagctcgtaacattccactctgccctctccccacacatttatgtctttctcacatgcaaaatgtattcattgcatctcaacagcccaaaaagtcttaactcgttccagcatcaattgtcaaacaagctagtacaggagttgaacattttccagattcagaaagatctccctgcccttaatcccagcattttggaaggctgaggcaggtggatcacttgaggtcaggagtttgagaccagcctggccaacatggtgaaaccctgtatctactaaaaataaaaatwaaaaaaaaatagccaggtgtggtggtgggtacctgtaatccaaactatttggaaggctgaggcaggagaataggaggattgactgaacccgggaggcagaggttgcagtgagccaagaccatcgtgccactgcattccagcctgggcaacaagacaagactgtctcaacaacaacagaaaagaaataaaaacaccagaaagatctcactaaactggagcaatggactaaagcctcaaagaggaaatttcatttataaggttaggctgtagaagtaagtacagaatcaagagatttggcataagaaaaacctacgtggaaaagatcagaaaaagtccctcaagcacagagtcaatattaattagcaaagcattcggtgctgctgttttaacagcaacagtgaattcgcacgtttgtttttcaggccatgcaaagggaaaaatgatttatgtctattcccagacagtgtgttttaaayggtgtcttccctttcaagagacttttctagtaagaatttttttaatagggaaataagtaataactttgagagcaatttaacttgatcatgaatcagaatgattcagaaccacaaaagaagctgatattctttcatgttctctaaatatcttcactaaatgtaaagtaattggacatttataagaattcagactctcccataacaaaagtaataccaatcatgggttggtataggatgcacagttttaaatacagcatcttacttgattctcaaaatactcttgggagaagagcccaactggtgtttttatgtgtagtcactgtgtgtccacctgtttcagtaaagcattaggacaatttacataactctataccgtacagtataaacaaggctgtgatgaaatttgaaaggaagacaataaggataggagagctataaagaaggcaaaacaagtgaacayaattccaatctgtgtagtcctgcacatttgctggaggtggaacaaaatccttgcccccatgttatgcatatggaaattgagatttggagagattactgacatgcccagtatcacagagctagtgagtaacagagcccaaaacacatcagccccaccgaaattctgttgttttctctagtactctatgctgccttccaataacatgaaatatggaatttgtattggaaaagatgccaactcgcagagaaactcgatagaactatagttggaagtgtcttttcaatatgagcctctagctataaatggatgaaatttccactccctcaaagcttagaactttcttrctcttagcagctcactagttgyttaacatacctaatattaaccatctggtcagggagctaaatacaatgaagggcatccagctattatccmacccatttgcctatcccaagttatgtttyattaggttgagttgtcaattttaaataatcaagaaagatagctccaggtaagtctcactatctcgttaataaccctttaccaattgcagctgtttcgagaccagacctttgcaatgagtttagaaagctgctgtggacctatcataatttttactacactttgtggccacatgaactggcagaagaggctgtcctaaaatcctaatgtggcaaaaaccaattttcagaagtcaatttggaygttataggtagcgctyttcacacccaataaattgcttatctttggctttgaactgatgggcacgtacacaaaagattggagccaactgattgcattattagctgaggaaaaagtgtgtgactgtggcgaatttagcaaggggtagtctggagaaggatctgtgacctgggaaaagtttgttttgacgtggaaggtcaggagtttttgtttgtctcttgtgtccctttttacgttcatgtctgtccagaagtaytcatcttctctttgwggtttaaatgccctgggcagctgaattactgtgtgacctcctattgtcagagcatctttgtggaggagaacccatcacctgtctctcgaaaacagttgtcctttgaactttcaagattatggggaaaaaatgtacttattttctcaatcatggagagcatgtcctttagagatacctttggctgcagatatgtgacacagctgatttaaaatagcttaagtacccaggtgcagtggctcatgcctgtaatcccaacacatccggaggctgaggtgggtggatcacctgaggttaggagtttgagaccggcctggccaacatggtgaaaccccgcctctactaaaaatataaaaattagccaggtgtggtggcagcacctgtaatcccagctactcaggaggctgaggcaggagaatcccttgaacccaggaggcagaggttgcagtgagccgagatcgcaccattgcactccagcctgggcaataagcacaaaacttcatctcaaaaaataaaatagsttgagtaagtagaggtgtttttcttgcctaacgagaagtctcagtgtaggtgatgctgggtttggttcaactrttcaacagtgstatgagaaattcaggctattcctctacttcatctcascatccttaattgtctggctttaatcttcatagttttccccttatattggtctgttttcatgctgttgatagagacatagctgagactgggaagaaaaagaggtttaattggacttacagttccacatggctggggaggccctagaatcatgamagggggcaaaaggcacttctttcttggtggcggcaagggaacatgagaaagaagcaaaagcagaaacccctgataaacccatcagatgtcttgagatttattcactatcatgagaatagcacaggaaagaccagcccccakgattcaattacctcccctaggtccctcccacaacacgtgggaattctgggagatacagttcaagttgagatttgggtggggacacagtcaaaccatatcactcctcatggtgtgcaagatggctgatacatgtctagctatcatgtcagcaagactgggagaatgtggaaagggtgagccagccagccatrcttgtcctctttggaataagaaagtcttatcaaaaaccactagaagtctactgtttgtctctcataggccaggactgtgttatgacacagctatgcttagctgcaaaggaggctgacacagcaagcatttggctgttttatttgtgccttaaacaaaatacaagctctacagcaagaagaaggagagaaataaatgttagggagatgagcaaccatgtcactatgggttgtatagtcaaatacatatatttgggaaacgttattttcttgctgacagaacttctcagaggtctcaatatgctaagacacattgaagctcttgatggggaatagtcattatatttggcattttgccagagtaaacaaagaacccttaatttattctttagaatacctattaatkcagaagtgttctgaatggcgtcatgaaatactatgttagtgccagctcacatcctttgctgagagagttaaacrtatttgtctcaaatcagcacagccttctacagctaaggcaggtgtactggctgctccaattgagaacaaacaaggcaccagggcctttgcatgtaccccatgatgaaaagatggtggcctaagtgcaaaatggttaatgaaataccaaactcagataccaggccactggtgtcttccagttcactacatgtttaaggcaaaaataagagagcggttttctcagacagagtcttgagactacaaaacagtcaagacatttccccaagcaaactcagaaaaatattaagcctagacaatgtagagcgttagtagttagggaatgyagtatttcaattccagatctaccatttataagctgtgtgtttttgggtaaggtactctgagacttagtgttctaatctgtaaaaggggataattccttccactggagttctaattaagactcattggggtgacgatggttgtaaagtgcttattgcagtacagtggagctgtttctgtcccagatcctttatcaaggattgagccaagcggaatccttgtctttgttagtccaaattggattccccattcctcaaggtcttgtatagcttaacttataactttcaaagcaagatatcctgacattgctgttttgaccttgacatttaaaccatgctttgaaattaagttttgtgtctttaccttgccagtagtatttgctccaagaagtaagtgcacaccaccagtctcaaattcagttcataatattgctgctaagaatgatgcacacaaaataaaacaagcaatggcaaaaactgggcacagtaaaatttgctggagataggaaattggctaaaagatcaaatattgctggcatcatgaaaaaccacaaaaaaatcctatgaagaattagacttggcagaaagaacgagagcaaaataaaattataatggccaaaactacatagaagaggttttattattgactagaaatcaatgcaaatataaaaaaagacttcctgtcaaaaatacacaactgcaaaactggctttggcggactaaggctaccaaagaaaatccacaagtcagcagttgccattggtaaaatttaacttggcaaaaaacaatcaatgaaccaaatagttgacataaaatgtacacacagcacaattaatcctgatgaaaataattccagcaaagtaaaattgatttttttaattcaattgtttatgccatgtaggaaactgatcaatgacttaatttgacttgataaagtttgctttgagaaacattggatgaacaatgttggaaaaagtctgactcattttattgctttgaaatatatataaaaagctagcaaggtccaaatgataggattaaaatatcctatactcattttaaatatacaatgcttagcaccggctggacacggtggctcacgcctgtaatcccagcactttgagaggccgaggcgggcagatcacgaggtcaggagttcgagaccagcctacccaacatgtcgaaaccctgtgtctactaaaaatacagagattagccaggtgcggtggcatgtgcctatagtcccagctactcaggaggctgatgcagcagactcacttgaacgcgggagccggaggtcacagcgagccaaaaccgtgtcattgcactccagcccgggcgacgaagcaagactccctccgtctcaaaaaaaaaaaaaaaaaaaaaaaaaagcctagcaccaaagtattagcaagttcctsttatttattaatgttctcatactttcattgaatttttaaacctaatgatgtttattttcaaacacttcagtccatttattattgaatataaaatgggtgctaattacaaatgggtcttatgtatgcccttgggttgtctagcaagatggtttcataggtagtaataagagcagcaagagaagaaaatagtgtggcctttacctttactgaacactcamtttggaataggcctcatgcttgggactgcctccrtcagtgtgcagccttcagcggctacatttggaaatggtacaagtattaggttggcgcaaaaagtagttgcggttttgccactgaaagtaatggcaaatayttagaaatattyagaatatttagaaagtacctgctgttctgactatcttaattcagatgtgcactcaccttttggctcacgacaacaaaagccttcgaaattcctgcctgtttagtttgtgttgacacattgcagattcaactctgacatgttatttccttatgctgagggtgtcttgttgagtttcatgggttttgtgcttccctggtgccttattaggcttataactcacagagctatgastttaaatgtcagggttgtcaccaaaacaatggagcaaaaagcaagttgttgacattctttggacgcaatttgcaatcccctttattttcctgtaacgtttttgtgtttccaggtgacagttgcccaccgaaccacagaaccacaaagcccagagttttagttacatactgctgctctaggatcagtagcccttaggtccaaaagccgtttctgatacagccttgggcaagctggttccttctctgagcctgggcccctgtcctataaagtaaaggtgttattacccttcataggattgttgtgagaacaaagtatttacattcttcatataatcagaacttttccaaaaacatgggatcttttacatggctcaacatgtttaaagctgtttatgttcatctgatattttaacattttgtagagtagaaaatgcttcaagcaaataaatgagctttatggtaattttttttgccagcatttagaagctggtggttaataaatactaatatgtatttagaagtttagaacagagatttttcagcaacaaccacaggctagatatagcccactacctgtttttgtcaataaagctttaatggaacataagcatggccattcatkaatatatgatcaatagattttttttggtacaagggcagaattgagtagttgcaatasaaacagtgtggattacaatgcctaaaatatttactacctggttctttatagacaaaatttacagactcctgrrgcagggttttatcaattsctttccatgtctatggatttagatataagygtatattttgttaaatattacagcagactttgaggtggctatcatctccattttacagatgtagaggatcaggctcacaggtagtgaatggcagaaccaagtatgaattccagcccactaacgtcacatctctatttgatcattagcgtatagacttttggtccttcataaattttactttataaagatattttaygttgtataattgatgtcatggccatattgtttaatcatcactcaccatgcacctattgtgtggcaggcactattctatccattagggcacaatagtgaasgaaaaacttgctgccatcagagaacttgtgttctgggctttcatgcacctgccttgcaggcgtcaggaatctgaatcacactcattccctccatcacttggctcaccagtgggaccagacaggagtcctgcagtttcagcaatgaaccccagggcttggtgcctgctctggaggtggggaatggggttcacagtttagtggaagattgcctttagggagcactcttggtttctagaacctgatatagatgagggatgtaatgaattcgagtctgaatgtttatttgccatggacttctatctcacgactttgctataagggctacacgtcggaaatgggatctaagtaaacgtagagtccacaagtttcaggacttatatagatgagtgaatctcagattttcacgtgcmtacagattacctgaggatcttgtaaaaaatgtagtttctgatttcaagtctctgggatagggcctaggactcagcatttataacgacatcctaagagatgctctgaggaccatactttgcatagcaagaaatgagaacagtccaggagcctctaagatccctcacatttgaggctagaagcatgtaacatgartgggttctcaaacctaaaagtcagggcttgggcataaactaaaactgtgatcacctcgcgtagatttgaggctttgactggtcgtcaaccccacccacaaaagcctacagcttcctcctaccccaggtcccagcttctccacttctctccaactacctcccacttttcctcaatttcaggctctttcgtgcctccagcccagtctacagcatgttccctggttcagaccatcccaatcagacccctatagagatgccaagccattcgtttgtgggccgggcacggtggctcatgcctgtaatcccagcactttgggaggccgaggcgggcagatcatgaggtcaggagttggagaccagcccggccaatatggtgagaccctgtctctactaaaaatacaaaaatgagttgggcatggtggtgcgcccctgtaatcccagccacttgggaggctgaggcgggagaatcgcttgaacccaggaggcagaggttgcagtgagccgagatcgcgtcattgcactccagactgggcgacaaagcgaaactgcatctcaaaaaaaaaaaaaaaaaaataagtgcttgtctctgctcaaagagaagtcagaaatggcagcaacattcctagcccaggctctgcactctcggtaatccctctgactgactctcaagtcttccccgtctgtctgctccgactgcacgagttggtgattaaactttaaaacaacaattagacccttgattttcaaagcaaacttggtttatagaccagacttcagcattcattacaatacagactaataaaaacaaatccggaaacatacgctttttaagctgtggtggtgtgaaatctgtaacagcattaaaaccattttgaaaaaaaaaaaagtcatttgggaacccccagcaaaatactgtgtggatattcttttctattcctcattcaagtatattgcatatatataaacataatatatatgtttgttactgtaatttttctacttattatataacattttctatgttgctacatgatctttgtaaatattatttttaaagactgtacaatatttcatgtagttgacaagccacaatatttgtaaacataaaacatttctcccctgggaaatattttagtgatctccttcttcctttctctctcttcttctttcttccttctttccttcctttcttttctccttctcctcctctttgcttttccccctactccctttttctccatcttctgctatcagaaaaaaaaaaattccatgagcacttggtaaccatctactttatgttgaattatttcctagggtaaattctcagtcagtagtaggaggaatatttttcccattsaatgtagtttgagaagcccaatgaccaaatcatgagatgttgccattctctatgaaaatcacaaaggatgactccctaaatacattttatgtctacagagaaactgtataattctgacattaatttcagttccttacaactgccttcattccttggggagggtactgaaatgagctccagctggagactaagtcagctcaagccactaagtcatgggctggtcttgcacaaattattttctgtttctctgtttctgtaagcttacaatttatatattgtatattttataaacatacctcatcagataaggttatagtgaaaaatatatctgctagggtattcacttcataagggaaggcttttttgtctgttttgttcactacatactatatccccagcatctatagcagtgcctggcacatggtgggtgtataataactgtttgtttcatgattcattttttaaaagatctagaaaaagaaatctttactccaaagggtttgaagcagtgattcataagtattttaagaataaatgtatctttcacacctgtgtgcctataaatataatttcacaaataattctagtaagttcagagaatctagaaatttttttctgtgcataccaggcaatgctggcattaaaaatttattttgaaaatcctctaagttctaattcacttgacattatcctaccaagttaaagaaccatgaaataataagtaattcatatcactgcattcatttctcattatggactgtcaaaattgacattcttgttcccgttttatagaagcaaatcttagactcagaaaatttcaaagaacttatccaaagtgacacaattcttcaatagagagcagggactacaacctaaattttctaattcaagtccagtagggtctgccttaaatgcctcccactgtcaccgtgttgatttgtataacctttgtcttcctagcatttgattgacggctactgttagtacagatcatctgggctccttgtagtgatggacacattttcatgaggcaaggtcttagatgattaaaacaaggcagatgctaatgccatcctcaccttcatctggaactgtctaactagagttcgttaacttgtcagccctagttccttttgagcaccaggctgatataataaaatattgcaaatcaatagaagctttaaacaagcttcatctgtctttctttgttacttttttcctttcttcttcttttattactacttctttctttgccgctttaaagggaaaactgctatccctcttattggctgtacaattctgttttctctgtttattttgagttgttggaaattcaggtacatccagsttttcccaaatacacctattattaccccaaagagtaggaagccgatcttatctagattcactcagcaaatctagaatctcccaagagactccaaatttagtacrttaatttttcttaagtataacattgctcagtaactatgtgggtgaagatctgaaagttctgcagcactgtttcatttataaaaataaaggtaacggtacttttgcscaagmtttgtgtggaatctaaaaacttccccaagttagtaaggaaggcactgtgatagtatctactaatgaaaatgtgagcacagagatggttataaaataccttatttttctcttcttcattattattgctcatttcatttgattagcaatttctagactcactcaacctccatctataaaagaaaccattagtctttgcctatgtctgctaaagcgaacttcttgttctgtctcatcttcattccctactcagtttctgtcttctccagcccttcttacattattgaaataattgactctatcaggtggatttctccagttgaacacatttggatttgtcctgtggaaacaccataagtacttttttttttttttttttttttttttttttttgagggggagtcttcgtcttttgccccggctggagtgccgtgagtggcacagtctaggctgactgcaacctccacctcccgggttcaagcgattctcctgcctcagcctactgagtagctgggattataggcacccaccaccatgcctggctaattttttgtatttttagtagagatgggatttcaccgtgttggccagcctggtctcgaastcctgacctcaggtgatccacctacctcggcctcccaaagtgctgggattacaggcatgaaccactgctcccagcccaccataagtactttaatatgctaatttatttcaaacdatatgggaatcagttcaaagcacatagtctcttccatgcacatcttcatgccggaatttgctaggcgcttgtacctccactcccttcttctcagtcctttgtccaaggaattcttccctcaaagagttctcagtcggaaagcatgtataagacaagaaaataaatggataccaaaatcaacaagtgaagtaaattcccagaaagcacttgcaatagtatatgataagaagtgggaactccgtaaaagaggcagaaaggaaatacctgaaaaggttaagcaagcgagtaatagcctggagagaagagttacagaaatgtttcatagaaaaggtgatctttgaggtgagcttttatgaataggcaaaatttgggtaaagaggtagacccatttttaagagcagggtgacatgaaaatctcaggatatattastcagcaattaatcctcattgttgtaacaaatagttacaaaattctcgttgcatggctctggcttacctgcaaagcaaagtagaaaatggagaagctcccaggcaaggccaacaacgcctggtctgtgctgcacgtgaagatatctgagcacgtgtgacccctgctttgccctctttgtcattgcaatggggttactgggaaagcctctcccatggtggttgacaagagggaaactttgggaaatgttctcaggagtaacccacattattttcaggcctgaaagatgcaaggttggatagagagagaagttgggctgtggtacgcttacaacagagatctcaactgaccctgcagaaagctttaagatgaggagaacccttctgtgttgtccttactcaggacaaggagctgaggtcttatgtctccacattgactagtcattgaatgtaggctcatttcaggaagggagtataatgttgggagaggtgctgtcttcagcagaaggcaaggcctcttagtttatagctctcagcctccaacttcccagtggctgaaagaatgaatgcttcagttccaaataaagggatctgagcagcaaatcccatcgtcctgtattttcattgaagtagcatttcataaccagtaacaactgtcttcccctgaaagtgtggtttaaatttaaagttggtgacttccttctgacttgtcaaggcgtgggcatacgcaattttttcctctatggttatagcttccaaactgttagctatatagatacctactttttaagataagtgagacctcaatcacaattaactctgtaagttattgaaaaccggtttgatgatgatcatcatcatcctgtgtacaccttgtgtgagcttgaggtcctattgtaggattaatcatcagagcagtatctgcagtctgcagtgcatttcttcttctttatttgtttagaaaaatcccactcttcctcccaaaattaactttattgtcaacttgataagaagatttctgaacagaaataaaataaccctgatttgtggtgtttgccaattactgtggtataaatactcacactgtggctgatgccaagctacaaacatgacatcatggaattggaagaaatagtaaaaatcatttataccttctccaaaacactcactgttcccaaaactttcacctcaataattctgtccactggtatatcaacatggtactggtgtagtaatgatccattccaggtacggacaaaaaaagataaataaaacaacaaaaaacttactaaatgccatatggttttatcatcttgtgctggcaatttgtaaacatcatcagtgataaagtacttctcccaaatggggtgaatcatacctatcctcaccctgcttttggacactggtatatcctctcaaaggcattaataactatgttataatgcaaatatcacgttatctttctatgatttttctaacccaatagactgtgaattcttcaagcttatgtatttgggtacacaacacctcgccaaaatccttggcatatagtagatgctcaacacaggtgcactaacttgttagttgaagtgaccggtacaacctagttaactgaatcagaaccatgaattcagaggatagtagtaaaaaatcaagttcatgaagtttttaatgagcagtatgttttgcctaagactctatgattctcactgtggaatgaaccacatagactccagaatgtgtcttttcttaaaggcaatagaggcatgcagtgaataaaatgcactgagagaagcccataaaacaatattcgtaagtacagagaaaggcaatattaatgccaatttcaggggatctgttcaagttcaccggaaggcagagtttttagcaattttttaaaggttgaacatrtctttaggaggtagcaacaagacaaaggtccaggaagagggtgtgatgcagtggggaagcatgcagtcaccttgtgccgaacttaacaggtcaagaactccgtatgtgaataatggtggaaatatgtggagttacaggtacaactctgtaagggcattagcctgtaccagctatcattgcgtaccaggctatgtgtggactttgtccttgtgaatctggtaaaagttaatcatcaggtctcaggagttcagcaaccgaccatcatgagctatatagtattagtctgcagctctacctgagagcagcccagaaaccaaatasgaatatatcagacattatcccagagagaaggctcagtcaaggatctgcagctgggacctgcatatcttaattcccctgttcctgggraagttatccaatagctactgaaatacaagatggaaggtatcctctctgtaccatagctaaaggattgctcacaaaaatgaaagtgcaattacagaaaaattatccttgggctatgaccacatctcctgagtattttattgccaccacgactcatgatttcaattctcaggactgagtatctctgctgaacscaaatttaaattcttaatatgaraagctgcrctttccagtcgtgtgtcaatgcaaagtgagyggatttgggtttaactcccttggactgagtgcaattatatgttgggaggggactaacaaggtagccyatgtaacaatactgtcgtaattatgtgcaatattttcatttttacttctgatcaaccgcaagagtagattgaatgctattgttcagtttgcacttaaaaatgatgatttttttatacctggagtttaacatctgagtttttgtttaaaggaaaaattgtccttgcctttgaaagttagggtcatgttaaaatatttactaattctcataaaatattttttttctgagcacggttgaaaataaaaatatcttggtcctgtcctttgaataatgtcaagattgagtgtacctctggagaaatgttgatagagactcaaagcaataccactctcccttgtcacttttctctgtgtactgtggacaagttgctcaacctcattcaaactcagtttttctcaacaaaatttgatatcaccataaaggaggagactcggttgcctttgtttttattattaaaaggaagcattgagtctaactgatatgaaacatttctgyatatgcctaagaacttatgaagctcataggataagaattcttggcaatccaaataatctcacattgtctctaatctgttataatgctgctcttgcctcataacttttgttctttgtattccttaaaaagacctaagagagctcaagattatggggtgctgccaaatatawcactagtcttctatttttatttttaaataaaactttgtaattggtaaagtcacagaatcagtgtgcatatgatcaaagtctataaaataatgaaccatgcataattgcarcagagttaccaaggaaggctgtaaggatgatctcactggtgcagccaataccccagtaatcaatatggatgcctgggtgacaactccttccttcctaactttcacagcttgcctgactgggatagccaaggaaggcatctgtgaagaggcagcatctttagagtttatgtgggaagtgcactctaggtaagacagatgctatatacaaaagcaggaaaatgtaaaatttgttcgtaaagagcaactagttgcatttgatctaaagtagatgattccagtacaaaaaggaaattacagaagttttctcagctccaattttagagagcctttaatatcatgctaagagggtagagtagaccacattccacaaagaagaaacagtattttatttgttcattccttcttacaaaaaatatccacctagtacctactctgtactagcttaaaggtaacttttgaaaaaaaaaattttataatgcctagtcaagaagcatatctggatggaatgaaggagaatgagacttcagggcaggaaagaaggcaagttaggatactattgggatggtccagataagagagagcaccgtctgaagggtctggcttataacaaagaggaaataatctttgagaccaaacagaaaagtgtagcctcaagaaatattctttgtcatcctagtggttgctttagaatttgtagtatacatctttaacttatcacagttcrygttaaataatattatagcatttcatayatggtataagaaccttacagtaaaacactttcattttctcctttcccagcctttgcactactgctcctctggtttttagttgctcataggttgtaaactctacattacattgctattattttttactttaaacaatcaattttccttctaaacatagaaaaaggcatatttttccacatatacaccactttctgtgctcttcattcctttgtgtagattcatatatscatccaacattatttttggtttggatgaaggactattgaacatttcttacaatgaggttctgctggtgatgaattccttcgccttttgtatgtgcatctgaaaaagtcttacttttgctttcaataatgggagatatcttcactggatacagaattctgagttgacaaattttatttttctttgagcatttcaacggttcactccattatcttctgacttgcattgttgctaacaagacatctgctgtcattcttctctttttcctctgtgtgccatgtgtcttcttccctctagctgctctcaagaatttatttttattagtggttttgagcaatttgattatgataagaaacatttttgagtggagaatcaagggaaggttgaaacagataagacgtcaatgctgggaaaaaaggttaattgtgagactggttgttccttatttgagcctgataataacaatctcttcaggtacaggacaaatgtcatgacagaatgcactttaaaagaaaaataatagctaacacttgaagattgctatatatacctatgtgtgtggtgtaagtcaaggtaagaagactggatttgcttccaaggcaatagcgagcctttgcaggcttcacgcaaagatgtgatgcttcgggtttgagttcaaggacctgagggttattcctttggagagtttgaagcttatattctagactcaagatgacataacctggttccttctaacctttataaccctaagatttgcctgggatcctagtcctggattcaccaagtctgccatagaaaatactgccatttattgagtatttattacatgccaggcacagtgctaaacatattgtacgattatctcacttaatccattcaacgacttgctggcagaaccaccatggctgttttcctgaagttaaaagatgtaaaagactcatcccaagtcattcagctctttggcnnnnnnnnnnnnnnnnnnnnatacataaagatagtgttcatacatataagatctaacttctaagatatataagatcctattctaacatatataatatgttgcatatattagaatatatatttgaacagtatctcatacaaagtatgtttacacaaagtaggtgctctttaaatgttaactattacataaatgtacacacacacattttacactaaaaacaattctatgatgtaggtagtatgataatcttcattttacacattttttttaagatggagtttcactcttgtcacccaggctggagtgcaacggtgcaatctcagctcattgcagcctccgcctcctgggttcaagtgattctcctgcctcagcctccagagtagctgggattacaggcacctggcaccatgcctggctaatttttgcatttttagtagagacagggttttgccatgttggccaggctggtctcgaagtcctaacctcatgtgatctacctaactcagcctcccaaagtgctgggattataggtgtgagccaccgtgccrggcctctacatattacttctaatccttaacataacagcccatgattccactctttcaatctcgtttcttttaactttgaaccattctttgccaattactttacctacctgtgtctcagtttcttcatttgcatcatgaagctaataataaaaccaaaaggctgttttgagtattaaatgagataattcatttgaaaagtgctcagcatagcgccagacgcgggagagtgctcagtaagagtgaggaggtggtactgttatcgctgctgttttatgctttcttctgcctgcgagttcccacttggttcattcaaagcacccacactgtcctacaaagccaagttagcatgcagcctactgccctgatcatgcagtcacaatctctgtttctgctaacagtcagtaaacacaatttagcatctcgatgggtttcattgctccacataggctcatttagacttttcaactagattaactcatcactcattcaattcgtgtgctgtctgaggacacaccaggtgccaaggactgttctggtttactagggttagaaaggtaaataagaaagataaaaattaaatccctgcctcatggatcttatgtatgggggtgggggagacaaacaaaaataatataaataagtaaaatatgtggtatgatagatgaaaacaagggacatagatacaaataaagcacagaagggaaataggaagtgttggggataccatatattttggataccgaggtcaaatttcactgtgtgggcaggattatctcacccatttcagaagagaggaaactgatgctcagagaagggtggtgaattttttcatttcatgcagcattggtttagagacaagatagaaatcaagattctccaacttacagtccaagacatatttctgtagcgggcagaagctgaactctatttgtgctcctaggtggaaaacaatggtcctgtagtcctcatcaccatttcccatgtctgaaactgtctttgtctacctcttttcagttcttctcaacttcataaccyattcttgctgtatctaaaaagcattaatgatccactggcataagaattttgggttagctcaagccaggtaggatagacttgaccatatgttcgtgcaagttacaaacagccatccccttagggtatacacttgcagcacccatgggtgtgtggttgcagaacacagggtaaatttcagccctcagccacttcctgcarggacttttgtacagcgtacaacctttaccaccataaatggaggctttttgtatttcacacatcatttaactagtgaaagttgcataatagatactcagtgaatcatggatgattgaattctttctcatttttcatttcctatatgattcagatcctttatatttcagctcatggtaaaggacaaaaattatttgtcaaatattgattgagcacctactatatgccagacaccggtctaggcacaggggtacagctgtggaaaactgacaaaaatccctgcatttatggggcttacatttataatatatatttatatatcatttgtctcttcttaatagaaaagtatatagaggtatgtatatatacatacatgcacatatactatatactataagtatatatacttatgtatacatatacatatacagatatatactttatgtgtattatatatagtgtattgtatacatgtttatatactatatatgtgtagtatatatagaacaccatatatatgcttatatactctatgtctattatatatagtaatgtatatatttagtatgttagattgtgatattgccaaaaaaaaaaagagtaaaataaagcacaggaggggaaatgaagtttgaaggatgttttagaaatactgggtagaggctgggcgtggtggctaatgcctctaagcccagcactttgggagaccgaggtgggtggaatcacatgaggtcaggagttcgagaccagcctggctaacatggccaaaccccatctctactaaaaatacaaaaattagctgggtgtcgttttgcatgcmtgtcatcccagctactgaggaggctgaggaaggataatcaattgaacctgggaggcagaggttgcagtaagccgagatcgtgcccctgcactccagcctgggagagagagtgagatttcatctcaataaggaaatastgggtagagtggccaggacagggctcatggagtaggtgacttgtgaggaaaggtctgaggaaagtgaaagaactgctgtggaagacagaacmaaggccccaggattgttcacattctactccttggaacctgtgaatgtgttaccttatatggccaaatagactttgcaaatgtgattcaagttaaggattttggattatgttggtgggtccaatgttatcaccagggtccttatgagagggaggtaatgtgtcagagccagaaagggatttgaagatgctacgctcctggctttgaagatgaaggaagggtccatgagccaaggaatgcaggcagcctttaacagttggagaaggcaaggataccttctcgtgtacatcttccagaaggaacacagttctgatgacaccttgattttagcacaggaaggtctgtttgggacattcgaccccagaaatgtaagataataaatgtgtgttgttttaagtcgctgagtttgttatgacttgttatagcagccattggaaactaatacagcaattctgtggctatctggcggaagagatacccaggcagggagaccagcaaatctgcaggctctgaagtgggggtgggtctggtgtgctccaggatgccagtgtgcctggactgagctggagtgagtcaggggagcttgcagtaacaggggcagagtgcagatgacatgagattacatgacacactgtaacccggaacaaggacactggcttcactccaggtgctaggagatcgcactggaagctacgaagcagaggagggacatcacccagttcacgtttcaacaggaccgctctggccaccctgggggagggtggtgaggaagaggatgtagaggtatagtcaggagatgtggagcagttaggaggattgtgttttgatccaggaaaagatgattttggcttggaccaaggtggtgggaattggataagggtaagagggtaagaaacagttatattgtgaatgtattttgaagatggaggtcattaaccagaaaagggtaaatgtgatacatgtaggctgaactggaggagacagtgaataaaattcctttgctaattaaactttctttttttttctttttcttttttttttttctttttctttttttttttttttttttttgaggtggagtcctgctctgtcacccaggttggagtgcagtggcacaatctcagctcactgcagcctctgcctccctggttcaaacaattttcctgcctcagcttccgaagtagctgggattacaggagtgtgccaccacgcccagctaatttttgtatctttagtagagatggggttccaccatgttggctaggctggtctcaaactcctgatctcaagtgatccacccacctcaacctcccaaagtactgagattacaggcgttaactgaactttttttttttttttttttttgagacagtctggctctgttgcccgggatgaagtgctgtggcgtgaactcagctcactgcaaccagtgcctccaggttcaagcaattctcctgcctcagcctactgagtagctgggactacaggcacgtgccaccacgcccggctgatttttatatttttagtagagatggggtttcaccatgttggccaggctggtgtcgaactcctgacctcaagtgatccacccacctcggcctcccaaagtactgagattacaggcatgagccaccgtgcccggctaattaaacttttaatgtggaaagacagcacatgcaggagataagaggtagagtgggtgatggtccaggctctgagyggaatggcctgtgttcaaatgctggcttctctaacttaccagaattacgtatgtccttgagcagagtgtttaaccttcctgtgcctcactctcctcatctgtagtatgggatacatcacagaaattgtgtatcaaagggggaaaatgtttgcaagacttagtgcctaattcacagtaagtgctcaaaaaatgcacacagtmagtgctctgtcattttctagaacacattgatgtttaaaaaaattttcctacttgtaaaacagtcaaagagttcagtgtgaagtatttgcaaaaaatttgaaataaaaaattactcctttcctgtggggcaagttcacagaatagctggtatgctgacaattttctcttggtcccataatagtttttcagagtttcattataaaatagttgctgtatttgccaatgcagactttgaagaaggagactgatccttctggcttttaaagaagaatgagtattacacgaccattgaatatttataacactctcttctctttttaaagctgttgttgttttaccatcctaacatcaaaaccactgggcccagggaaacctcagatgtgggagaatatcaaatgtggaacttttccttgtttttcctggtggatctgacacaccttggaaccttcaaagaacacagtaatcaatgacgtggggagacgtgagacatcgcatacattattgtgaagaatttattaatgtaaactgcatggtgtggaatagaggttggggctgaatgaaaatgtgaggctctgtaatgcgacaaaaaacacagagcagagagaagagagaggccaatgaaagacactttgctgatttgggacttcactaaagagagccacataaaagagaaattattgtttaagtaggttaaggcaaccctagtgttttaattaaaatgtctttagcaaaaaaggaagaagaatagtacttgaggtttggggaaggcttcagtgaaagaagaaatgtaccaggcggtggcgggggtgggcgggggaaatagtgtaatttaggttaaatattgtgaataactccccaagccgaataatgttgaatttcagtcgtaggagatatttaagaattggttgaacaaagggggcaattgactttggtggttagtgtgggagacagctttctaattttagagtttgcagccataacattatgaagctaacgaacaaaaacaagccatgtagataaaaccaggagaaataaggatctgaaaaatggaccaaatcgatcgagttctggcaatgagtgcttccttttcgtaaatacaagggcagtgctctgcatcttctccctctctcattttctctgagaaaggaacgtgccattcttttttctctctctcttttggcattcctttttttaacttttaagttccggggtacacgcacaggatgtgcaggtttgttacataggtaaacgtgtgccatggcggtttgctgcacccgtcaacccatcacctagatatgaagcccagcatgcattagctattttaagaggaggatcgatttcaccctttttggaaaactcaatttggggcctgctttccccaggatcaccgtaagattctacctgaagagctgagttttcctaagaatgaaaaagcaaagagacccctggttttgtatttgatacaaagtcaaacgctgtttttctctgagtctgtcctggaataatccagtgacatccaccatcatctgcatctcccatggaaccaccacatgtgaagtcgaggctgagcgcagggtggctgcaccatccacatcaacagccagcactgccttctgccagtttatgaggcaattcggctgccagggagaggagaacagtgtcccttccaatccgatgagtaaatgcctcaggtgttaggtaaaaccccaaggtttttctcttctctggggccaccctcaggaaaggaaaactccaaaaacttctttgggaaaaagaaaaaagaggttgccatgtgatattagatggcatgaattaaatagatactacttattaaagttaaaaaaaaaataaagcctgcatttgcatggtaatgggacctggcagatgaaaccagaagttgatagaaaccacccccaaatcatcatttaacctgtactgaagaatgacgcacataatgtacaacaggcagccattgtcatgtgtgtgtatgtctgtgtgtatctgtgttatcaggcaggtagtgaagaccaggagggagaaagtagtgagtcagcgaagatggtatcccagttagagaaacgacacaatgaaggcatgaagtcatgagacagtgtggcatgtttgggcaacacagatgtggttgggaccacaaaagttgtgatcaaggaaatgtgttggaacaatgtccgccttcacaagattaaatttgtttccagtgatgattttattccactggtgggttatttgtcaatatgttacaggacttttaaaatgttcataacctttgatccagtaacacctcttttgctaatctattctaaggaattctcattacagaaaaacaagcaaaagcaaatgaaactctacctacaacgtcactttatttgcctttcatttatagtaagaaacaattggaagcacttaacatacaagcaggccaggcaccatggctcatgcctgtaatcccagcactttgggaggccaaggcaagtggatcatgaggtcaggagttcgagacgagcctggccaacgttgtgaaaccctgtctctactaaagatacaaaaaaaattagctgggcatggtggcatgtgcctgtaatcccagctacctgggaggctgaggcaggagaataactagaatccaggaagcagaggttgcggtgggccgagatcacgccattgcactccagcctgggcgacaaggcgagactccacctcaaacaaaacaaaacaaaacaatacaaaacaaaaaaacaagcatatcaagggaatgatttaatacatgttgatacatccacaagatgtattgtgccgcaactaaaattatgtttacagaatctttgacgtgggaggaaagaaaacttgggaagtatcattaggttcaaaaaccaaaatacaaaactgctcacacccttccacttcaacttaaacaaaaagtatattacaacctggaaggaagtccactaaaatgctattctgtttgtctgatacaggatggtaaataaatttacttttcttctgtgttttaatatattttttggagtttctctgatgaacctattctatgtggatgattttttttttaaaaaagtataatctggtgtggcagtatgagcccaacatatagtgcatccctcctaccgaatgctaagctaaaactctgggcagacacacactcaagtgcatgcacaccccacacacagacagacagacacacacacacatttgaaaaatgtgaagagcaaaccaaagcagttgggtaggtggattgaagagagtcaaaacttggagaggtgatttcactgagaagagtttcctacattaggttatttttttcttcttaggctttgccttgggactgggttctagtcatactgcagggggttggccaggcaggtagctaagagtcccgttgaatttccaaccttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccaccttggagattgacacactatcttccaggtagaccaatgcagccttctttccagtacaggacaagttctgtttctccactggacaccagaggaagtagtttgcatttaggagggtttcatctgaaaaatagggaaactcctatgtttacacactagagtcctcttcagtgcaatgagcattcacagtatgagaggctgaggaactgaaaacaggtgaagagacagctgaattctctttctctctgtgtattgattctggagcatttgcgtagtgagtggaattttaggtgggttttttttttttttttacaatcacataattcattcctctgactctttgtccctcctcttttcttttcttttttcttttcttttccttttgcttttcttttcttgagacggcatctcgctctgttgcccaggctggagtgcattggtgtgatctcggctcactgcaacatccgcctgctggattcaagcaattccctgcctcagcctcccgattagcaggaattacaggtgcctgccaccacagccacccagctaatttttgtatttttagtagagacggggtttcaccatcttggacaggctggtcttgactccctgacctcgtgatccacccaccttggcctcccaaagtgctgggattacagacatgagccaccgcgcccagcccctctttttctttttatctctttctcttccttcattccccgggtatgtagttaaggccatggttgtgaagtatccgcatgatgcatctccactatacaccgtgcttgtggcaatggaggaggcaaaggaccmcagaggaaggacccttaggtggaaaagccaactctgtccatgccccacctgtaaatgtttgtgttgcagaactttccccttagttcagctaaaactgagttcttgtcaaacaaccaggaaagactgggctcacagccacataaaagggtgagaaacagaagytattggacaaaaaggaataataactctcagcaaagcgagaaagggtcctgcttgcaggtctcccgcctcatagattgaatcccaggttaccacagaaacaagagaggccaggctcctccccactgcaaagggcacaaacttccttaggctccaccccatcctcccagtgcacaggtgggcattatatagaaagagttggtcgggaaagggtgggcttcatccaggaccagcagtccagtttttcagccttcaggctattttaggctcgaaggcagggttttgctggggacccttggctgtctcttgtctgtatcacttaggctttgcagttagaacacatcaggccagtctctgcatttatttgccttatcacaagcctagagaatgtgtacccatccctaggagagtcctcagtaaatgactgatgggagctgggatataaatcccccagctcccttgcccttccgagtcacaggttctgccctgcctcctggaattctccagtgggaatgtacttgttaatgcttccctcatcagctcccttcccctccctgcctcacttcctcattctcctgcccacatttcctgggatgacccaccaataaagtacttgctgttaaatcctcaatcttagggtctgctcctggggagcacagactaagagtattgaggtcctggttgtcctgattctactatccagtgggctcatgtacaaaaaggaaaccagaagtcacgaggatccctcaggtggcctacagtaaagcagggaaaagatgaggatcatagcagggaatgtggtcataaagagggaagggatggattcctgggaaattttcccaggtggaatctgtaggacttggcaaccgctcgtgagtgcagtatggtgggaaccaaagaagcctttcatacgatgtgagtgtctaacccctcaactgctgagaaaagggatgcaggaaaccccatggctttggaaggagtaagtgggaagggccggattttcagttaagtttaggatatgttgagttttaggtgcctgtggatagtcatgtatcatttatggtgacagtgccacagggaaggtatgtgtcaaacccctaataaatacccactgaattgaaaataattctttttccaagtgcgggttttctaacaggggccagccagacatttatgagctcaggcagatgaggaaagcatgatacctggatcacrtgtgctcacatctggaatacatgcgcaaattaacacagctgtggaggcaggagtacatatgtgtattagaaaaacaagccccacctgtagagcgctgcaagatgcctccagctggtcacaagtagctattgaacatgaatattttatcagtgccagagcagatagagggaaactgtatccattatattctcatcaccatcacatgtggttgaaygggcttccgactaaagaatctaaacatgtttaaaacatttttcacctccagtaaaactagcaagtcttgatttgtgttgttattgctcctgctagattcgtgaaatatttcagaggcaattgcatcttggaagtgtggtttggcaaattttcatccaaagcgtatgtttttgttttattttttaactagcggttcaaacgtggggaagttgacattttagagcaaatggtagaatatgtggggttattttctgttgctgtttcatttttaggttcaacttttcaaatatagagctggattaagtctcactagtagcagaaaacaaagtctgtttaagtaaatgtgttttcaggatggcccaactgtacagaaacttgcagatctcacgttctgatcactccatcaastgctgcttctttaaaatactcaagagtcacttacgatgtttaattggcatgtctgtctttcaaaatgaaaagctacagggtagcttgtgttaaccacacaacagctggttttggtcacttggtaggtgacaatccagtgaccacaaccaaggaggatttaacaagggattttatgccttgcaatgcggaagagcactggggaaagttyccgaaggggtgcctcccagaacacaaatgaaaacagggcttttactgggctggcgagctgagtcactgtatgtagaggtgtagtgaaggcagcacatgctcagtcaccgatcatgctgctacatacttgtacatacttactgtctatacattactcactcatgtataggcagtggtgaataagctcctccctgggcctggttagtagtatggtaatacagatagataaccgaagtacatttccaactcagacatctctggatccaaccagcttttgttttgccagggtcgggcttctttctgaaatttttgaaacaaaaaaaaccaaggtgtgacagttacaaggggctacttcttcacagtgcataccccaaaaccttgggaccctggagcatacccccaaaaccctgggaccttgggttagacttggacttttcctgttttcttgttactcagcaaccaccacaatgcctggtccgtggaaaatggtcaataaatatctgttggctggataaattaatccctaaatgtatgtattaggktgttgcaaaaaaaaaaaaaaaaaaaaaaaattagccgggcgtggtgtcgggtgcctgtagtcccagctactcgggaggctgaggcaggagaatggcgtgaacccgggaggcggagcttgcagtgagccgagatgacgccactgcactccagcctgggckacagagcgggactccgtctcaaaaaaaaaagaaaaaaatagaaatggcaaggaataaaatttgccttcaatgtgcttatggtcttgggaggagyagagtaaaaaaaatccctaatttctattgatataatatcattggatagwgccatgatagaagaatgtcccatgtgcagtgagaatctagagagaaaataagtgattrcacttaaagtagagagtcagggaagacttcctgggagaggtgacatttagactaaagcataaataatrttgatttgtttgccaaatggaggaagcaaagaaggatcctgagtgaaagcatgatgtgtctgaggatttgcaagtcgatcatgaggttgcagcatacatcacatgggagagagttgctgactsttcaggagagcagatcatggtatgctaggacaatcagagtctccactagagcatatgaagggcttaacataagggagtgtcataattacatttatgtttggtcagagcactcaggcattggattggagaatggagttgagatgagaagcagtgaagcacttgctgtagccatcataaaaacctggatcatatcaatagatcrtcataacttggcttcaacaagaattcataaaaccaactcctctctatttcatagtttcatcattttatggaatatcaaaaacctaaagagaaagagaaataaaaataaactatatgaacttctccctgatgaagcattcagtcttgttttcctggatctcatgcatgttaaatacatatttagatctaagccactatatcaaggaagtgaaaaactcttattccttaaatatcaatatgtgcacaaattttcttatacccacataattttagtaaaactttggagaaaaaagtttccagagttctagggctttgttccatttttggaaacagtaattttagaactctctgctttgctttacttattcattttatctcccgctgggtttccttcttgatttctatacctttgtgtctgcattaattaatttttctttcatttattcacacatgcaaccattgtgtatttggtctatgtatcagttagggcaggctaattactctagcaaaccagcagttaacaagaaaccaatcccgttggcagggaactgcactgtgtgaagacattcagagatccaggctccatctatcctaaagcaagcaaacaggatctgagagggagacagagacagagacacagaaagacagagagaaaaagagagaggaagttcttggtgattagaaatttgtgtttctgtgcggtatgtgtatacacaggtggtatttttctatttggagggcttaatgtgtttttaggtgtttgtgggttaggagttagaagaaatagccaaaaaggaggtgtaattaaccctttatctctttctcttgatgggtaatgtggttacttcctttttgttagtttccccataatattatagtaaatacctgagtgtattatgtgtgtgtattttgattatttctctgcactgtgttcctagtagttaaattacttagtcaaaaagcatgaacactttaaaggctatcaaacatagttacattgtttttcagkaaaatatctgtacctttttctttagcatcgaggtatctatttaccagaccttcgtgagcaccrtgcagtttattttttaaaaatatttctcaactttatagtcartatatttggctattaggataatttcaggatatttgaggaggaactttaagaccggcttataaattacagcacttataaaggaggaaaacatgtggaactcatgtctggtacacatgattctaggaactggtggtgtttggatggcagaagttacaaggaacgcaaaagcagggagcgtgagccaacaccagattgacctcaggcagctgatgctatcgaakgaaaaagggaggacttccatgcaactccagaaaacaaaaccaagacacctgcggtagattctggtttaacaaaagggagaattttctaaaaattttctatagatttggttacttcacaaagcattgagcaccccaggataaaagaatccaactgagagtggcagctttactcttattagagagaagatttctctattaaagacaaaatcaaagcgaaatcaccaacatcttactcatttacttattagacacaatcgtggagcaaatactctgcaccagctactgtgctaactccgttacctggattactcaaattcttacaataactctatatttatttcataattgctttatttagtaatattttaagtgctttttagacacctgctctatgcctgtcttgtgctaggcaccagggggcgtagcagcagaccaggaaaatgtagagtctgcccttacggagctgggagccttgcatgaaagactggcactgaygacacagtggcactgaatgaacgtgtgatcagaagctgagacagggctctaggggaaaaaggcaaagtgcagccaatcctcatagcaaaagagaccgaggaagcctagaagtggtgcttgagtggagagtagaaggatgggtggggggttaaccaggcacaagaggggagggacgggaagggaagtcacaaggtgagaagccctcagacaagcacctgcaattggagggtgcgtgcasctgagaagcagagccaggaggacagtgatagcacttgaggtcagagtggtcatcgggatccaagcctgctggatcttcctggccttaggaaacccagaggcttcatcctttggcaaggggaagcctatatacccygtaggcttaatgacggggagaagaatgtttgtaaaagatctcgctggctgctgaagagagaacatctggagttaactctccaatttcagactcccctgatgaaaactgttacttctgttctccactcccttatttgggcaaagcagtttattttctacccgaagcatatctactaatagaaatgactgagatattcattacgttaggaatgtaatgtaatgattcttagatggtgattcagatgattagttattggaccttcgatgcattttttattttaattttgagattggccgtccccaacgcctctgatgtrtgactttcattactggagatgttgtttctgatgttgctggcggtccctactgaaaaggatgcatgcatgaagactcaaggcaacagtgacttgcacccatttctaacaatgacttgcacccatttctccygtatgggggtgcttgataagcactgagtggtgtaatttacaacagcttattggcttgatgccatcctatgaatccaccaaccatcatcttctctgaccctttaaaatgacttccctcacaccccctgccatgagatgatatgaagaactaacaacagataatttctatatcaccacattttattatcagcataattctatacagtaaatctgcagtgggtgacttagttttgctgatatgtggcctctagaatattgggaaaatagatacatggaaatttaggragcttgtatcttgcctctccaaccttttaaatttgctgcagaaagttggatatttgttgggtttttcttccttaagtaggcaaacttcagccccaggaggcaatgaagcaaactttaaatgtagccccaggtacttcaaagctggctgaaccatgtgtttgattgcatacaaaatgtgaattgagtagcacagaactgtcctcctagcaactttgtagcacaatgagatcagctgcaagaacggaataaattggagattggcttctgcagttccattcatttgcaaaaatttgcagacaattaagctgtccccctgcagtataggtagctccttttagccaggggctggagatttgttctctcygggaaaatgttaaagctgtgattatctagttatacctgartaaatggatcaaaggacctctccagccaagcacagacctccttgaaaaggtagtctccagcagcaaccctggggaggtttatagcaaagtgtttttagagcagatggttctggagttacagaggccaaagagctgaatgacttgggatgagtcttttacatcttttaacttcaggaaaacagccatggtggttctgccagcaagtcgttgaatggattaagtgagataatcrtacaatrtgtttagcactgtgcctggcatgtaataaatactcaataaatggcagtattttctatggcagacttggtgaatccaggactaggatcccaggcaaatcttagggttataaaggttagaaggaaccaggttatgtcatcttgagtctagaatataagcttcaaactctccaaaggaataaccctcaggtccttgaactcaaacccgaagcatcacatctttgcgtgaagcctgcaaaggctcgctattgccttggaagcaaatccagtcttcttaccttgacttacaagastgtccataattgggctgsgctgactgcatgagtctcacctttcactgttctcccttaattccctgcctgccwggaagacgtatttcagcttctgcaatgctttgccttgctraaaatatctcctcttagcaaacaagtttgcccagaagttatgaaagtaggagagggaacaaagatgatagaggtttgtggtttgtttatgaggttttcactatttctccctatcactttttctattatgcaaagccagggtccaggagggcagaaagagggaatgaggacaaattatctggacactgtttgtctgtttgaatgtcagcgtatttaggagatcctccaacaggtggccagcccgggtcaagctgcgtctggccttgtgttcaggtgtgcaggaagtaggatcattcctctcaaatctcaccacttccttcagttggctgttagggaaggcttttatgcccttggctgggtgtgacggaaaggggcagggacagacaaaacttggagtgcggtcccagctgtagaatgccagtctggsagacataacaaaagtgagcacttcttcgcttttgggacaccttccccatttggtcttgacattgagcaccatgctttggcaggtgtcagaggttggctcccgggaaatagaccacgcaaccggggaggtgttatcagcatccayacctcacggggagggaggtcagggggatggggcggggaaggaggctgatggaggagttgctgactgcaggtasctggaggcctcagccttcctgggcagcagggatacgggcagggatgtcccctgagcatggtcccacctggaagccagggggctgaccttgacasactcctgaccagtcagtggatggcgctgcagccccttctgtttagtcttcacatcagcaatgaaagagggtgaagttcatggaaataytgtggggacatatcgcatggtttctkttcatgaaatgtccagaaaagacaaacatatacagccagtggctgtggtaaagtgggaatgactgctaatgggcatgaggtttcatttaagggtgatggagatgttctaaaattakatgtggtgrggattgcacaactctgtaaatttcctaacaatcactgtgttacacacttaaaacgggtgaatttcatggtacgtaaattatacctcaataatacttttaaaatactgcaggcgagaggggctccagccagagaaattgactccaactctccctttccacaaatcaaatgctcagatttgcattgtgggaggagcctgagtgttcactgcaggacaatgtaggttcttcagggagtgcagaccactttcacatgcagcttctcatttcgttctgataacctagaggacgggcaaatcatcgtaggacgatgagcgctgagctacagtgaatgtagcttgttatcttacgacagacctgggagaaggaggaaatccaactaatttatttacttttatccctttgagtctattctccacaaagcagctatgatctgttttattgcaactggactcctcagctcaaaacccttccagggctcactsctcatgcggagtaaaagccagggccctctccatggcctacgtgcctctccagggtctgacttcccttcaccaggtccagactgtctccttcacctcacagcgctcaccttgcccacgccagcagctgccacactgaagctccgccatgcccggtaggcttctgctgctggcagtgcctcctcctcctgcccccttggcccattcttcctccatcttccactgccatcctcctcggtggaccgcttcttgcctccctgtctaaaacatcagcaccctctccccctgagcacttccagccctcctccctgctgatcttttttctcttgagccatatgtgttctctttccctttctgtggtttgccccctctctctacaattgaagcttcatgagggcacttgcttcttttaggcactgcaccatccgagatgcctagaattatacctggcagagagaaagggcttggttgatacgttttgaagaaatgaatgaaagaatgaatgaatgacttagttaatatgaatctattctctcgctccttctcacgttctttttctcttcctgccttcctgtttccctgggcctccaccctcccttcccaccctcaacccctcccctgcccctcactgtttcaggggtctcccctttatttctgatatgtgttctttggggcgagtgttgtggtgcttccagacagcgtgatacttgcttcccctgagattgggaaacagggaggaaagcaaatgaggttttaacctcaaatgccctaagacaggaagatgaagaccttgcttagctgcatgaaaccggagatctttgtgtagggatgacagtcctcctctaatagaatccagcatgcgtgaggctccctgaagacacaacactgcccctgtgatggaagcaaggctggatgaggctgcagcaggcctcggatgacctaggstaaagatgctgcggatcactgtccggagactgctgtsgggggaatcccacaagwcacacatggtctggtgttggtggcggccccagaacctcactctcctctgcacacctctgcgtgcctacgtctgttcctgtgactgaggggattgtgttcagcacactggaagtgcgaagacgtgtggcatatgtccgtgggtctaggcagctgatgcatgtctgttgcatgtacatctgctcgtgagtgtgtgtgtatgtgtgtctatcagatggattctggtgtgtgtgtaaacccgcatgtgcataagtgtgtgcatttgatgtcacagagaacatttgacatctgcacgcgtctagtaaatctggaaagctggaaggggctgcgtgtctacatgtgtctgtgtttcagatctggccttaggccatccacagccgaattactcactcctgatacagactgagtggctcaccctcattttctcacttcctccgtcctggtgttaataagactcatccttcatttttctrccgtttctgcrgttctttagagagtgcagaccactttcacatgcagcttctcatttcattctcataacctagaggacgggcacattatcctcctttacagatgagaaaatttccttcaayccctctgtgtcctgtctcgaggggagcagtrttgggcctcttctctgaggctgatgtaactgctgattcctctcacacctcctgtgggcatctcctctgctctcttgcatcttcattcattctgtgtttctttcttcaccactgtgctttctttcctctgaccccttcttcctcaaggtcagccccattccttgtctcccatttaactgaagaacttctttccatagctctccttttcttctatgccagagtcctcactgtccatgtaatcgcctagcacacaccaaaagctgctctttctaaattcagccgtcatctgttcatggtcaagcctagcagcctccgtgattttggaggagacctctgccttgtgtaacgtggctgtgcactgttcctttttggaattctcctctctgtgcttctggtttttctgctacgctgactaaactttctgtggcctttgctgaaactcatcagatggttacgttcctcccttttcccttttccctcttcccataatctgggttgtgccattgtctccatgtcttgcagctactcttgtatatgagtgattgtgacatttgtctccctcctgaatgcaattcctcatgtcccctagaaatctctgcttcacgtccagcaggctcctcaacgtcaacaggtctactctagcactggtaccccaaaatgcctttttaaaagcctttgcccacttggtaatggcaacaccagaagtcaagagatcttattacctccctcctttacgctgatcttcagttctttcccatacactgctcttctgccttttgtaactgtctcttgaattgattacattatttttgtcaccaccatttttgtgttgtccttctctgagtttctggccacggattggcaccctcacaggcttcatgcatgaaatgacagatgcaagtacaccacacgcacaaacacagagagttgtcccgaagcagggtatatggatgtcagtcaaatcatgtatgatggttcttacacggtcccagtcatacagaaacatatggcagaacacacaaactcattagcacagactcgatcaaaggtgggtacagccacaaatatagaagtagacacttggccacaaacacatacttatagatatacacataaatcacaggcaaagatagaagcagagccacaggcccagaaacgcagagccatggataaatattcactgaagtttctcctaatgtcagacaaaaacttaagcatcagaagaagcaggatgtcctgacttcagtcgttcctttaagatgcccaccgtgacgggcccagagagtcgacatgcacatggtgacttctctacaatcaatacctccagcagcccccsaaccctgtcccttccaggtactgtttttcccgaatcagagcytcctgcttcttttcttgggcactttagatccacggattaacacaattgtgccacttgccatacttctgggatgcgccgtaataatcaaggaaatggatgggcagctgtggagttgatgagctggtgagctgggaggacaccagaggtaggatggggatgggaytcagggagctgaccactctggacacccgtgaggacagaaatatcacccatktgtgggtatgaaaacacaagaaagcaattcrtgacactctatgcaaggttcattattgatgacacrgtgtgctttgtcattactttggacacatttagacatacattgtcatcatgaactgaggcctatgtttgctctaggatgaagcccattcaccagtcctttacatctgcacaaagtttacgtctttttaaagtgtttctctagaccagctctcatctgaggctcaagatatttttttaataatgaatgatattcagatattacaaatatattttacgtatttcctatttttgccacccttaacaaaccaacagaatcttcatagatgttaaatatcagttttgtgtaaatacaacgcgctctaattttctttctttttttttttttttttgagatggagtctcaccrtgtcacccaggctggagtacagtggcgcgatctcagctcactgcarcttccatctcccaggttcaagtgattctcctgcctcatcctcccgagtagctgggattacaggcaggtgccaccacacctagctaatttttgtatttttggtagagacggggtttcaccttgttggtcagcctggtctcgaactcctgacctcgtgatcctcccgcctcggcctcccaaagtgctgggattacaggcgtgatccgctgcgcccagccaatgctgtttctttgtttagtgttgggttcgttttgggtggttggcttttttgttcgttttgttatattattcttgctttttcttctgtcttatacagaatctagttttctttgcctgcatattgagtccttttcacttcctagagactaaagtgtctcttacttagtctctttcattgagattttaatattcttctgtgatcactatagtgtatacaaaatagaatgcattgaatatgatattctatattttcctacatagcttgtcttaaatattctctctgctagctaggtaaattggagcagtttgcatgcaacctctctgaactttcttcattgattaaggagggataagatttactttggaggtctgttggaaatatttgagggkgctcatgccaagtgcccagcacattgrccagcatacgcttgctgtatcattattatagtagtttagagtagtgatggtgagggcattggagtgatgatgatagtggtcggaacatggtcttcacagttgccttattggtcatagcctaggagtattgcctactaacaaacccaaatgtaactttgtccctgctatggaacatttaggatgttttccatttttgccccttataaatcrtgtctcactaaacgtcttccttcatacagtwttattcttcttttgaatgtaacgtttggatgggttcctagcagtaaaattactgagtgaagggatatgtgcattcataaagctctcgataaatgaatattgcctgattacttttcacaagggtgctatgaatttatactcccacccaaatcaagagaatggctatttatagatgctttcagagccttagcttatcttgtttcctgtttgaactttattacataaattttcctttaaaactgtcacacacacacacacacacacacacacacacamttttatggggccttggggccaaagatggaatgaaactatcatttatcacatgattttgataggaagctgttgttaggattgagatgcttgcttctgatgatgcagaagacagttttaattagyatgtggcattaaataagatcagtttgcatattggaaatgatattctttttcaattatctttcagtcctctgatcagatcaaagaggaagtctcagcttggtgctaacacgcctttaacaccgctctggcccctttttacctgtaagatgaagagctttccataggcaacagtttctagctcaaatttaatggtgtcattaggtctccagcatgtttatttttatgttttccttcttttatgtgaagtgatactaatgttttatttaaaatgatacaaagttttcattttgaacacatttaattaaaaatatgagttacgcatagagcaaacaccctgacagtgtcactccaataactgaacttgtgacatgctacttggagagtgcattccaacagttgccccactgatcatataataacaacacgtttcccttgacaatacactgaatacaagtctccataatgcctgacatagtttgggactttgtgattgtccctttatccctattcatttgtgagtgtaaggaccttgcagtggctcatgaagagagttgctttttattttttatttttaaaattttttttgaagactcttaacaaagtataaccattttgaaaatgcctatctattaccctagataaaaattacctagtatcggaagagtatctaaaaagatattcaaggggtacaagtgcaggcttcttacatgcacacactgtgtagtgggaagtgtggccttttagtgaacccatcacccaaagagtgaacgttgtacccaacaggtgatttttcagctctcaccctcctcccaccctcccactttccgaagtccccactgtctcttattccactctgtatgttcacaagtacccattgttgagctcccaccaaaaagtgaaaatatgcggcatttttctgtttgagttatttcctttggatcatgtcttccggcttcatccatgtggctgcaaaagacatgattttattctttttttaggcttgagtagtattttatggcatgtgcgtgtgtgtgtatgagtatgtgtgtgtgtatatatgtttttgtgtgtgtacacatctttatagatatgtttatatatacgtatagatatatttacatatatgtatagatacaaatatatatatatatatcccacattttctttttttcttttttgagactgattttcactcttgttgcccaggctggagtgcaatggcgcgatctcggctcactgcaacctctgactcttgggttcaagtgattctcctgcctcagcctcatgaatagctgggattacaggcatgcaccaccatgcccggctaattttgtatttttagtagagacgaggtttctccatgttggtcaggctggtctcaaactcccaacctcargttatccaccctcctcagcctccsaaagggctgggattacaggcgtgagccactgcatctggccccacatttttttttatcctgtcttctgttgatggacacttaggttcattccatgtctttgctattgtgaatagtgctatgataaacacacaagtgcaggtattgttttgatataacgattccttttcctttgtgtatatacctggtagtgggattgctaggttgaatggtagttctgttttcagttctttgagaaatcatcatactgtttttcatagagtttgcactaatttacactcccaccaacagtatataagcattcttttttctcttcagcctcaccaatatttgttgtttaagactttttaatcatagccattctgactggtataagatgatatcgcattgtcgtttcaatttgcatttctctgatgattagtgatattgagcatttttcatatgtctgttggcccgtcgtacgtgtccttttgaagaatgtctgttcatgttgtttgccccactttcttttgtttgtttgtttgttctgagctggagtctcgttctgtcacccaggatggagttcagtggtgtaatcttggctcactgcactgtccgcctcctgggttcaagcaattctcctgcctcagcctccctagtagctgggattacaggtacctgccaccatgcctggctaatttttgtgtttttagttgagacctggtttcaccatgttggccaggctggtctcraactcctgacctcaggagatcggcctgccctggcctcccaaagtgctgggattataggtgtgagccaccgcacccggcctacccacttttaattgggtcatttttgttgtttgagttccttgtaaattctggataatagtcctttgttgaatacatactttacaaatatttttcccattctctaggttatctgcttastctgttgattgcttattttgctgtgcagaagcttttaagtttaattaaatttgaattgtccatttttttttttttttggtcatgtttgcttttgaggactaggccataaatcctttgccgaggccaatatctrgaagagtttttcctagggtttcttctagaatttttatagttgcaggtcttatgtttaggtctttaatccatcttgagttaatttttgtatatggtgaaagctgtgggtccaatttcactcttaggtatatgattatccaattttccatatgggtgtttaggccaacaccatttattgaatagagcgtcatttccctatcatatatttttgccgactttcttgaagatcagttggttgtaggtatgtggctttagttctggattctctgttctgttccattaatctagatttataccagtaccatcctgttttggttactatagctttgtagtataatttgaagtcaggcaatatgatgcatctaacttagttcttttcacttaggatttgttataaaaccaattctttattggctgtaaatcaaataaaattttatatctaagcaagtcctccagattcctgaccaggtgagtaatccagtagcttggcagattaagaacagcaatatgcaagcaatgagggatgagtaaatcaagactgtcattgtgaatagaatgatttggaagttgggtgttcaaatagcttaatgatagttatagtgaataacaatgtcagctttagtattattctagtaatgtacttggtaatgctaatagggtttgatggaatacagtgaacactttccaaacagctgtatgctttcccaacaaaggaactctatctcggagcagactgatacatcatttcaatgggagattttaatcaatccttttgttttcccttttaggatatatttaaatttgcaagaacttctcctgtcccaagacaaaagaggtccattgtggtatctcccattttaattccagagaatcagagacagcctttcccaagagatgttggcaaggtaagtcagacaaacagcaaatgacaaaaacatgtttttatgaaaagaygagcacagcagactgagtatgactgtcttggtgaccagctggaattagtcttcatctgtctatgataagagaccaaatggtttagtcatgaaaagaatgttggaagatcattcatatgcaaaagaggaaattggaaaaaaccaatagcagctttgaatattaygggatcaacatggtagatgatgttgaaattamgcaggaagatgtcaatggttaagaaacaaggctcattgcttttatagattatattcaggtgatcaccagatagggccccctaggatggtagtatgttgacatgtggccttcactgagatcctgtttttcaaatatttaggtctacgcgtaccactgggtcggttttccaaaaactaaaccagatcaagggaataaaatcatactaatcatatccagaatcggatatggaaaacactgtcccatgaatcagaacaatagcttttccaggaagaaatagtcactgttaaatgtgccaaaatacggatactgcctcatcagtacattctcccctctttaagagagtcaacatggagaatcaaattttgagcagtttgtactttttggttgttagaaacaagtgctcagtgccgcaaaggagaaccagcactcaggaaaagagttttctcagcaaggcaatttacttctgcggaagggtgctgcttgyacttctggccactgggagagcacaccaaacaaaagagggaaggggtttttatccctcacgtggttagtccctgcttctgtgtcctgtccccattggctggagttggattgcacaatctaagctgacctgattggctactgtttaaaattgaatatggctaattaggcaggaagggagaggctgtctgttatggtacaaggcatgtttgggcatgtcagggcacggcaaaggcgggaagggtagtttcattgggaagagctgttttggctggaggggcagtttacagaatgggtagccaggattaaagaggactctttccaaataagaaagagatgtgagtcacagattgggactaatgggagaagttgtttatagagcaggtagcttaggagaagggacaaggaagttgatctcgagaacaaagaacaagggagtcagaaattaaacgtttgaaaaggaacttactgtatcagacattggtgagcctggaattcgaaaaatggtggttggttaaatgaatgatcttaatggcagttgctgttgaactactaattcattaaatacacagtacatgtgatatgctggactccaagctttggactgggtgtgaagaagcagataataaagctaacatgctagtgggaagacagaaacaagaacattgcagagtatgacaaatgctgtgaaaatcagcaatgggatgatgtgaaaaaaagagcaaatggcaggatgaaggagtagagggaggagggaatcttcacgcagatggctgtgatggctggttggaggtactgatatttgaggggagactggaagggtgagaaaggaacagttacaggtatatctggttgaacagcatctttggcagaggtgagtctacattgcaaaggcctgaagatgggaaagaatagcatgtagtagagtcgcaacatgcctgggttgcatgagagtaagcaaggatgacagtggtaaaagtgaaatcagagaggccagcctgcccttggatgaggagttggggtttcatcgtgcatgcagcaggggaccactggaagatttccccagaagactgcatgttttgaaagatcatcctggctgccttgtagagaatgattagtggtagcagagcagtagagaggagtggaagcaaagagacccactaagaggggagtttggtggtgatctgaacaaaggtgacttggactattgaaaattgatcttggacgggcatggtrgttcacgcctgtaatcccagcactgtgggacgctgaggcgggaggatcacccgaggtcaggagttcaagaccatcctggccaacgtggcgaaacccygtctcaactaaaaatacaaaaattagccagtgtcatggcacgcctgtaatcccagctacttgggaagctgaggcaagagaaccacttgaacccaggaggtggaggttgcagtgagccgggatcatgccagtgtactccagcatgggcgacagggtgagactctgtgtcaaacaaacamacaaacaaaaaatcgatctttattgcaaattgaaagaagtgctaatccaatatcctggtaatcattatatttatcattttaaactcccactgtgccaaagatacctttctctaagcaaaaatctttttaagagtctgggacatgatacaaagggaagcagagctgctctaaagggatagccctgtccccttgggcagccctagccactgtgatgatccttttctagacaggtttcctgggagcccaagatgccagatgccaagggacctgactccccacttcttcaaaactcttcccaaacagtttctgagactcaagatgcattctcgtttttcagttttcttttagataatcctgggcttctcagctctcaccatgcatcagaatcagcagagacacttaaaatgcagatgtcagggctccaccctcagagattgattccactggggtgggggtgaggaccatgcatcaatatatgttaaaatatccgaggtgattcagatatgcagccgaggtggaggactgccggtcttaagcagtcctccaagagtggttgtggaccagctacattagcatcgcctgggagcttgctagaaatgcatatttycatgtcccaccccaaaaccactgagccaaaaactctggggttaaagccaggaatctgcgtttttacacagcttctaggtgattgtgatgcacactcaaatttacagagggctgacctgaaatgcactttctcctcctgtccaccactagtacacaatactttcagttgcaattccattaattaggttataataaggacaatcacatttcagttgcctggaaaatcccagtttacacctgtcgtccaaatctgtcatgtccagatttagacaataaattatgtagccatcctatagttttcttcaattacacacaatttcctccggggtatatttgggtgaattttctcacaagcctcttttcttgagctattcaatgggtccataagcatgcagctaattgggaacattcttctgcattgtttttttacttattacagcttcaaaaagcaatttggtttgcaagctgaggactcacttcttcttagccccttatgtgttgcccatacttgttctcaacttagattctctacaaagcaactgcttttctaagtgtggtaggctactaactagacaatgcgcaagagccttcaaaacctctagawgttttttgtagaattactgcactgctttgcaaaaactatttatttgtccctgctttttatgcctttgaaggtacgtattttcctttttgttcctgcttgtttctatttatctgtcttactctttatrtctcctgtcttatcctcatcaactccaccacagctgacgagctgtgctctgcagagctgtggaagaggacgtaggtgttttcagtgagtgctggggaggcagggagaagggaaggaagaccacagaggcagagctctggcctccaaacaccaccacgctcccaaaaaatgtctaagtcaggacacctctaattttataaatattacgtattagacttcgatatagaatgccatttgaagaagagattctgcagctctaaaagtataaagacgtttgtctttggcttcccctagaagtggaccgcaagacaagaattcaaatgaaggcagttcatttcagaggtggaggaaatatttgtaataaagtaagggagagacgtggagaagggaaggcagctaggagagaagcttgtttatgaagccagctacccctgtgggtgactggattgtaatgtcaggggctaactttaacatggtgtggaacacactgtcagcgttacaccacccccaggggatggcactgggatactttgacaccagctggggtatttctactcccagcagtcactggtggagggccgcttccaggggtgtaaattccctggcatatctggtctgccctgcactctgtgcactgacgcgacagcctgctgaggtttggaggagaaccttagacaaaaaggattctgtacagcagccaccagtctgctggtctgcactgaaaagctgacacatagaggatgtggacagggcactgatcccttctgcttcatcaccaaaactaatatatctatattattttttgcatacttcatttcatcctctgcttttacctcatttcctgaactagcattctcatgtcctgggcttttgaaaccccctgtacttgcctctctctctccattaataagtagttcctgcatcccaggagggaaaacctctgaaattcaacctaattcatatcaacaagcatatattcagcatctgtttttataaggaactgtgctaggggctgggaatttaatggaggagaaaacagacagaatcattgatcttgcgggattacaaaagaggtgacaatatcagcacatagtcattatttgtccagcactgtgctaagcacttttcatctattatgttgaattcttatgataacaaccacatgaggatcattttccagcatgccaatgaaggtaatgagactcaggggtgacgtaacctgtccaaagccacacagctagttcataacagagccaagctttgttactgctttttgagatttcaaagtctgtgctcttaaccagtatcctcaggaaatactaagcccaatctgagaatactcttccgtggaatgaaatatcttcactgacaatttctctttttaaaacagcattaaaattgagtgcaattcttggcaatgcactcaaaaataaggtggacagagggttggatcaatagatcgatatctgatatgtgataaaggaagtatattaaaatgttagtggtagaatataagttggtgaacatatgggtacttgctgtacaattctttcgagttttctctgcatttggaagttttgtaataaaatgttgggaaaaattaagtttaactaaatataaaattatcataaaagacacaggagttagcatgctggcacaaaaacgccttttaaatcatttgtcttgcatttcaagagggtgaatggagacaaagtacrtaactggttcttgatttttttggtcatattttattacaacctgaattcctgtaaagaaaggagactcatatcctgaagaatgaagacatcaaaagcaaggtgctgtggcaagttagcccttggtggagggtttttcacaaytggatatcctgctgtgtagaactgaayacccacagcagggttattcaggcagctccagggatgagagaaagtgtcttgactgatacataatttatctgtctgccaagtaattagttggttggtaagtagctaaactactagaatttgggatctgcttttccgtaatacgagggaatcatattacaaccctgagattccaaatcactgctactcacttagatagcaggtggggagtataagggggggtcattgggaacttcaaatgagaatggatgtgaaaattgtctgtttagcaattgtgcatcaatagaccaagtataactggtcatttttcatgtggcagatcttcctttatctgggaaaaaaatacattgctgggcattcttggtgccttaaaccttgggtcagtccgttcccaggagggagaaacaagggtaagaaacaaaaatcgtgaggtgctcttcattcattttatgtcatgctctatgccttannnnnnnnnnnnnnnnnnnnctttttttttattttgttttgttagaaaaaaataaacgggcgcgcgcgggggggggacagacaaccacccccacgagcaaccgggcgcaacgcccaacaaacacacaacggcaagggaaggggggaggggagcacagaaaaacaaaaagaaggggccgcacacacacatgggggggcggggggggaggggaagaaaaaacacaccaccgcagacccgcccccagccgcgccaagggggcgggggcgcgcaccgcagacaaaaaaaaaaaaaggggcccccccaacacgggggcgagcgagcaagcggggaggagaaaccaaagggcaaccacaaccgacgcgggggcacggagcggaaacggggccgccgcgcggaacgcgacgggggaggagacgcgcgggcggcaccccccacgcggcgggaaaaaaggaggcaagaagagggggggggcggcgagggagggaaccgcagcgacgggggcggggcgcccccccccgcccagaggggcggggcggggggcgaccgcaaaggcccccccgccagccctggggaaaaagaagtaggcctccaaaattggggctcctttgcaaggggcatgcagcccaagaccatcggtcaaggtttggaagacaaggtaaaacacccagtcgtgaacatacttgctcagacctgtgattttctttccatttttgaactctagacagcagggaggagctgacagtgagtgctctggagaggaacatgcagatcccaaagtggctttttcccctcccccttcaaagtatgactatttcaaaatttgggccataaataatttctcagttttaccaactttcactgataactaattgattgcatctttaaagatttttgagttcttgggcccgaytgattgagagcaggggactttaaatctgtaagccagcagggaggtctttgggagatgtattttattctgttttatattaagtttgaaagacaagtcatttatgaaatgcttattagagattctgctttcatcacaaacccttttcatcaaaaccaatgaaagtacttttttacagaaaatcctgttttaaagaccctataaattggtagaatgggcatttagaaggccatctttaacccaggatagaagaaatatgtaactgggccaagtgctgtttgtaaagggaatcaacattgatcattagactaaatcatgaaaaccactcaaccaggactccgctttgattgtgtcatgaacgtaagtcagacatgacggtaatttacatcagctytgccatgttcctcagtgttctgtgcatctgattcttagaggtctcactgcatccagatactctgtacctgagatttatgcccacctatgcgaataggtgccaaggagtctgatagtcttggaatttaatttgttttattctatttaatagccatttgcctcactttgaagacccacgaagaccaagctatatccttagaggctgaaccagaaagctggtactgaagccccagcacctctccatcacccctctcctgaaatgcagactcagggttacttgctgttgcctgattgattttatgatcaggcacttactgggttgtctagggtaacccagtaattgctgtcatccctctacctcttttaaaatctattgttttgtrccctttatctatgtctaactatatacacttttctcagaaatttacatctgcttaatttctaccccccacccaccccccaacacccccccctttttttttttttgagacagagtctttctctgtcaccaggctggagtgcattggtgcaatctctgctcactgcaacgtccgcctcccagcttcaagcaattctcctgctcagcctccctaactgggactacaggtggatgccaccacgcccagctaatttttgtatttttttagtagagacagggtttcaccatgttggccagactcatctggatccatctgcctcggcctcccaaagggtggggattacaagcatgagcacctggccttaatttcccccttttaaggcaactagcagttttattcaataactgaaacttaccataggctagagtataggagaaaaattggaatacagagtatctaagatgcctaaaggctcagtgctcaaaaattcttcttgagatgaacatcacagtttatttctacattcagcagccatagctacacataagcctttcctatttccaagtctttgaactgtcagttcttcctgggatacaccctctgtatccttattccttaggagcagcccacattcacactctaaggctgcactgtcccatggaacattgacattattgcaggaagttctgcctctacacagcccaatatggtacccactaaccacatgtggtcaatgcagttataaagtctttactaattttaattggggctcaaaaagtaacacttcattccattattgggacaacttggcagktgaatgtacctttttcmtgatacattttaatctatttacagataaaatattttttactgaaaacgcaatgtccacactgagatgttttgtaagcgtaaaatacacattggatttcaaaagcttatcacacgaacacaaaaagaatggaaaatgtctccttaataawctttgtattgatttcatttggaaacaaatcccttgtatttcttttcactttttttttaacgtggctgccagaaaagtattaaattattaatatggctcacgtatttttatcagatggtgctaatgtaaataaggcctatttttgatacagtctctcctcagtggaattatgtttttgagacagagtcttgctctgtcacccacactggaatgcagtggcgtgatctgtgctcactgcaacctctgcctccggggttcaagagattctcatgcctcagcctccctaatagctgagattacaggtatgcaccaccatgcctggccaacttttgtatttttggtagagatgggggttcaccatattggtcaggctggtctcaaactcctggcctcaagtgatccacctgcctcggctgcccaaagtgctgggattacaggtgtgacccactgagcccggcccatggaattttacttgatctcttttatacattgtttatacatctttgatggcacttaacacattttgagagacaatgtccttccctgccttcccactaactgtaattcatcagatgcggtggcccaggacagggcctaacacagagtagcgactcaaatattctctgaattgaattctagccatatgtatggctgattaacatagacattcactgcttactgattaattaaagtgatcatagcctgctttgttgttagaatggaattaatagaccattatatgatcagtctggatatttccagcaaattttaattttctaaattggtaatgaggccaccagataaattgcttggcagtcaactattatgtcaggtcatataagcattcttagtagatttgttttttttctttgagacagagtctcgctctgtcgcccgggctggagtgcagtggcacaatcttggctcactgcaacctctgcctcccaggttcaagcagttctgcctcagcttcccaagtaactgggattacaggcgcccgccaccatgcccagttaatttttgtatttttaggagagatgagctttcaccatgttagccaggctgctctggaactcctgacctcaggtgatccacctgcctcggcctcccaaagtgctgggattacaggcatgagatgctgtgcccagccagtagatcttgatagatttgatgttgatggattttatgtggggatggggtggggggagagagagagagagagagagagagagagagagagagagagagagagagtgagttacatgactgtatttctgaatttgcctatgtatatgatggtgttttaattccaattaaatgaaaacactcataacttttatcttttttcacaactgaacacagtcaattctaacttatttttgctaagtctaataaaagctatgttcaccattcgcaagtgttgccctcctgcaaattttaattaatgacaaaacataatcgggtggttttggctttttgccaaatacatatatatgcaaaacttccctccatgatctacatcccgcaaataaaggcatctgagcccaaggaggaagcaatatttttaaccctgagtttatcaccctttcggttctccattttaaaggttcctagaactttattgttattatgaacatctggcctcagactgaatttatatttaattatttgtgaacattcaaggaccwggcatttcagcttgaattagcatccagactcagggttgttgaagaattttcaaattggactagaatsttcactacctaatgaatgtctggatctaagccaaacatggctaaccctactgtcctgcttagtttttacaacagccytataaagtaggcaatcctacactcatttctcagatgagaaagtggaaattaagagagattaagtaacttgcccagggtaaccctcttaaagaacggcaatgctgagacccaaaaccaagactcttcaatgccacatcagtgatctgtccaccacaacgtgtgtgaatgcttaaagcttccatgggtctttgctgtttgcatagcacactcacacaaatggtcatttgactctcataagtaccctcagaaatcaatattatgtccccattgtacagtggaggctctgaactgagcatgaccaaggtgcagaagcatcttgcaaaacagtctatttgtggtacaaactgagttgcctttctgtgtcacctgcaattgtaccagggctctggatggattttaaaatagcacatggcatgagttaagccactatggaaaacagtgtggagattcctgaaagaactaaaactagaactaccatttgatccagcaatcccactactgggtatctacccagaggaaaagaagtcattatatgaaaaagatacttgcacacacacgtttatagcagcacaactcacaattgcaaaatcatgtaaccaaatgcccatcaatccacaagtggataaagaaactgtgacatatgtatatatgatggaatactactcagccatccaaaggaatgaattaatggcatttgcagcaacctggatgagattggagactattattctaagtgaagtaactcaggaatggaaaaccaaacatcatatgtccccactgacatgtgggagctaagctatgaggacgcaaaagcataggcatgatacaacggactttggggactgggaggaaaggatgggagaggggagagggataaaagactgtaaacaggatgccgtgtattctgatcgggtgatgggtgcaccaaaatctcacatatcaccactaaagaacttattcatgtaaccaaacaccacctgtacmccaacaacctatagaaattaaaaaaaaaaaaaaagaaatagactttgtctgggcacggtggctcatgcctgtaatcccagcactttgggaggccgaggcaggcggatcatgaggtcaggagatcgagaccatcctggctaacatggtgaaaccctgtctctactaaaaaatacaacaaaaattagccgggcgtagtggtgtgcgcctgtagtcccagctactcgggaggctgaggcaggagaatggcgtgaacccaggaggcagagtttgtagtgagccgagatcgctccactgcactccagcctgggcgacagagcgggactctgtctccaaaaaaaaaaaaaaaaaaaaagaaatagacttcactagaggaaggagaaacatacaagccaggggtgagccaaggatgagaagcatagctcaccatccccctcattccacagggaggtctgccaggggagaaactgggctctcatagctgttccttctctgccggacagcttcagtacaatcttgttagtggacagacgatcaaacaccagggatgttccgcagcctgaatgcagacagcttcagtacaatcttgttagtgggtagatgatcaaacaccagggatgttccgcagcctgaatgcaggttcccagattcgtaggagtggtctgagattccaaagttcaaagtcagatgctttgggtagggatgtgctggaaaactggctctcggaggctggaagccttgagttggagtgtttgcagctactttggcataaattctcccacagcggccagtttcaagctagcagcttacaaaatctctgaatgtttaacaatggacttccatgaaggagtagggttgacttcagcacggcactggccttgggactcagggaccgtgacactggaaggggtcagggggcacatgggtcccaggggagctacgcttgagtgaagccctccattgtggagaagtggcttccacacccacctgttcaccccgggttgcagctggtctcatgcccagtttagcagtgaggatcattttttgacaactctgcctgttgcaggtgttaagtaacttgtccaacttcatgcagcaagtgcaacataaaagcaaagctccaccactcttctccttggcacagaaaaatccaagtcactctcctaaggctggaaaattctgcagcaattgtcccagttctacctggaaaatgaggaagggagtgataaaattctctgtgaagtgaggagaaatgaggttaacctcgccaacatttatttgatgtgcgtgtttgtgcgctgagtcagggccggaggtcgtgtcttcgtttaacaaatagaccacatgttgacaagcaaaaaacggctttctttgtctggcaagaaaagccactgcctcgcttcagacaaygcttttttttgttggtgtctccgctgacaaccctgttcaaagagagccacaaggaatgaaagtgaaagcagaaaaagccaacttcggtgtaattaagagatatcactgcccgtttttctcagtgatgaggccgcagctgactcagtcgataagggccgtgaaggagtggggcccagggcgcagtggggatggactggccttttcacggtccaattactggtccaattactagtccaagttttgaagaggattgaagtagaactggatggagatgggaaagagaccaataaagtgttttttgttttttaggttttttttttaagaggggaggartgaatgaagaacttcttttattttcttttccggcttggagctagctctggttcccaaatagggtcctgggggaaagacgtgatgtgagtctgggtggctgggaacagtccctcctgggtatctgcgcttggcccacttctgcaaccagtaatggaggagacagaagaacgcttgaatgtgggtttaattgttcccatctgtgagtgttgcattaaagatgttgctgtcttctgttgcatcgggtggtttgggacaagtgatgaagaaagagagtcagttgatgcctcttgagcaggcatacactctccctaggctgaaaattgagctgcattaattcagaaatatttactgagcaactactatstgtcaagcactgcactggctactgcttatggattcccccgagaagaatgcccgtcctaggagagggggcagacctgtaaacaggcagacaagcgctgtgatggggtgctgtgggatcttggaaaaatcgagaaggcagaagaagtaattccgaagaggactcctgaaggacgcctaagagcaggcaacgcgaagctgagatgggaagaaagcgctctccaggcagtgggaagaacatgatccagtatctacgggcgagagggacggtggtctgtccagagaggtgagaataattcaamgtggctgtgatgcaaggaggaaattgtcacaaataaacttggagaaatcatcaaaggctggaagaggaaaaattgtaaaaactactrtatggaatttggacctttttctacggatgactaagtgttatacattggggaatcacacgatcagatttgcatttcaggaagtttagtcctgttacgctgggtaacacctgaaggctgagaaaaccaggagcaggggtgacaaagagggaggctgtgacagaaatccaggagggtgacgaagggctcccrggcaggggagaggcagaaggactggaaagagggcacagtgaagggccatggtgggggataccaggcaacactggcaagcaagtggacagtgatgagtgaggaggtagaggaaggtcccctcttagctgggacattatgcctctataggacgctgaacaaagtaacctgcggaggtgttactttgtgggaatgtagactgtgaaactgaaggaactgttttatccacctccccgtagtttgctctgtgctgaggctgctgtactgctcctctttgaaataaaagagaactcttcccagaggtgacagatccacctgcgtgctgtatgttgcatggaggtgggcgaacaggttatgtggagggttgttcttggaaagacggattcattttgcaccagtgacaggcttgagggaacaccagcgtgtcacacgtctcttcccagtgtccctgactcatccatgcctagggattttactttagtccttccttgctgtgaatttgaaaacttttattttatttttttctactagctaagaaatgtgtaacagctgtgttcactgttggccttctagcctcaaatttattttaaatacatttcttcttagtgatctcttctttgaatgctgatgttggctatgcattagtttacacaattcacaggctctgtgttgctcaatttttagttcatttatttgacaacttgaaattcatcacaagtggtgcttttattttgttatttgcatctggaaatcattcctaacatgccatgaaatacatctgttttttccttttgcaaatcacttttttttcttattataagagtaatatgtgtttattgtagaaattttagagaaaaatacacattgaaaaataataatataaaaatayccggccaggcgcagtggttcatgcctgtaatcccagcactttgggaggccgaccgggtggatcacctgaggtcgggagtttgagaccaccctgaccaacatggagaaaccccatctctactaaaaatacaaaattagttaggcatggtggtgcatgcctgtaakcccagctactctggaggctgaggcaggagaattgcttgaacccaggaggcagaagttgtggtgagccaagatcataccattacactccagcctgggcaacaagagcaaaactccatctataaataaataaatatccctgagtcccaccaytggggataaccgctgtagacatccgagggttttrcctctctatttttaaagtgcgtatacattcataaagacacagcatcaggstgtaccaccagaggtttagatcccataggtctggggtgacacctaacagttaacattccaacaagcctcctggcactgctgacaagcccagctccatggccggcccacactttgaggagctccacttctaatcatacctattcctacacatgaccatcttgtgctcatgsattttccacttgccaatgtctcagaaaccttcttcatgtccttcatcaacacgtggtatggcagaccrttgctatggccaacactgagtttcagggcttctaatgtgggatctactgcctctgcagggacccannnnnnnnnnnnnnnnnnnngggggccacgcccgaagcccagaacaacggagccgggcaggagaacgccgaacccagaggcgaagggaggaagccaagacaaccaggacacaccaccgggcaacaagagcaaaacccagcgaaaagaaagaagaacccagagccccaccaacggggaaaccgcgggagacaaccgaggggagcaccgcacgaaacaaaaagcgcgaaaacacacaaaaaggacacagcagcaggccgaaccaccagagggagacaacccagaaggcaggggcgacacccaacaggaaacaaggcaacaagccaccaggcaccggagacaagcccagccccaggccggcccacactttgaggagcaccgacgcgaaacaaaccaaaacccgaacaagagcaccaagggccgaaagcattttccacccgccaatgttccagaaacacggaacaggaccaaaaacaacacgtggtatggcagaccattgctatggccaacactgagtttcagggcttctaatgtgggatctactgcctctgcagggacccacagataggtctgttcactttctcatctgatgtatcttttttcttttttttgagatggagtcgtgctcttcttgcccaggctggagtgcagtggtgtgatcttggctcactacaacctcgctgtctcaggttcaagtgattttcctgcctcagcccccagggtagctgggattacaggcgcctgccaccatgccctggctaatttttgtacttttagtagagaaggggttttgccatgttggccaggcttgtctcgaactcctgacctcaggtgatccacccgcctgggcctccaaaagtgctgggattacaggtgcgagccgctgcacccggccgatctgatgtatcttaaggcatagagcatgacataaaatgactgaagagcacctcacgatttttgtttcttacccttgtttctccctcctgggaacggactgacccaaggtttaaggcaccaagaatgcccagcaatgtatttttttcccagataaaggaagatctgccacatgaaaaatgaccagttatcttggtctattgatgcacaattgctaaacagacaattttcacatccattctcatttgaagttcccaatgaaccagagtcactgaagtatccactatttcccttcctgttgcagaggaatccaccttgaagctatgaatacttttttgttgtatttatatttatcaacacttatatcttctccctctcctgattcagtgagatcagagaatattaaagccggaggggctctggaggtggcctgctccaaatacctcacttgatagataagacacaaaatgatttttctgggatcacaagatgggaacagtccttaataaatctctactccctcactctggtgcccttttgcctacacccagtattctgagccttcattgtcctaggaatggctgccctgagcctggggatgtcccagggtttttaggagcctcagcataagcttgacataattgatgtcagcatgttcacaatctctataggatcatttctactgagactaatcttattctttatattttcatttctcttcgcagtgttcttagaggttgattttttgtttgtttgtttgtttttactttaagttctgggatacatgtgcagaatgtgcaggtttgttacataggtatacatgtgccatggtggcttgctgcacctatcaacccatcatctacgttttaagccccgtgtgcattaggtatttgtcctaatgctctctctccttttgtccccaacccccaacaggccccagtgtgtgatgttcccctccctgtgtccatgtgttctcattgttcagctcccacttacaagtgagaatatgcggcatttggttttctgttctgtcttagtttgctgagaatgatggcttccagctttatccatgtccctgcaaaggacatgaattcattcttttttatggctgcatagtattccatgtgcatatgtgctttcactttaggagctcaactagcaactcccccatgcactccctcctccagtgtcagagcayactgcaggacccacccagtctttgaataggaargcactggctgaaaagccccagaaagtggggatgtaccagtacaagtttcccacctgtgtatcccactgttttgtttggggagaacaacggatataaccgaaacgggctatctggtgagcataagttctacattaagttgtccctgtgcctgaaccatttttgtttgtttgtttttgtttttttttttttttttttgaaatggagtctcatcctatcacccarctaaagtgcagtggtgtaatctcagctcaccacagcctccgccttctgggttccagccattctcctgtctcagcctcctgagtggctggaactacaggtgtgtgcccccacacctggctaagttttttattttttagcagaggtggggttttgccatgttggccaggctggtctcgaatttctgtcctcaggacccacctgggcctcccaaagtgcttagatgacaggtgtgagccacagtgcctggttgccttgggccattcttcatccagctgcctcctactcatcccttgggtctgaggttgaacgttacctcctcggggaagctttcctcaattccccaaactgaatcaggtccttcctcatgtgtagccgttcgcctagtccttctccagagcactgatcacaccagtgattaattaagtatttgttcaattgattatgcagcaaaccccaagatagcagaatctcagtttttcttatttacccttttatcttcagcatctaggatatgtctggtggactaggctctcaataaatattttttgactgaatgaatggtcaaaaaaggccaactccagtggtctctctacaaggtgataaaagagtaaaggggccgggcgcagtggcttatacctggaatcccagccctttgggaggccgaggcgggcagatcacctgaggttgggagttcaaagaccagcctgacccacatgaagaaaccccgtmtgtactgaaaatacaaaattagctgggtgtgatggcacatgcctgtcatcccagctactcaggaaggctgaggcaggaaaatcgcttgaacccgggaggcggaggttgcsrtaagccaagatcgtgccgttgcgctccagcctgggcaacaagagtgaaactccacctcaaaaaataaaaaagagttaagggcaggctgtcttggacacatctctacccctatcttacatgcagaacgaatggtattaattttgtgatgaataaaaaatattttttctttggatatattttaaacttggatatagttcacatattataaaattgagtatatttgatccaatatgtcaagtaccattaaatggataaaatgataaatttggtagaagaaaaaatatttaggaaagtctcagaaatttaaatgtaataaatgaatatgtattcatatacatactataaaactcattatgtaacatattacataaagcacattttgtgttgaggagtgagttccctgtatttagcttcatggaaaaaatagtttcttgtagataaatattacaggtgactgaactaaaaatattttgacaatgtgaactacttggatagcaatattttgagttgttttatacactagttccttatcttaaacagaagttaacatactcatttatcaatggagaggtggcatttatcattaggaccatcaaaacaattgtgttaaaatctcagggacaagaatgagtgcagggattgtaagctcctctgctgggtgcttcgttctgctcttctatrcaacctgctctgcatcctcttgagtgctttttaaacttccctcgtctcctccttcgtttccaggctttctcacccacyactcctctttgccgttcctctgcctgactctattaagataaactaatccttggaatttgctgctttgaagttgatgtcggctgggaaactcatacacaggcgtgtcccagtcctgtggtctagaatcaacatagtgagamgagacagaaggctggtggttgctgctctgctggttaccagctgtttaaccctcggataggtcacactgaaaacccctgggccctgtttgttcttgtatgagataaggctagtaacactcacattccacgtttggggaaggataaaatgaaatcgcctgattggtcatacttgacccacagctagtgcttggtcaacgtgccccttccttctttctctccctacctggagagcctacagatgtggtaagtgattctgaaggtttctcccatgaggaagtgacacaggcttgtacttatttggatagtcaaggcaccttttgttcctgcggttgacactcttccaaatagttgaagttacgtgtaagtgaacaccacctaaccaatatgctactgtatttataaaggatgctaacttgaattagctttgcccaagcagaatattttaaaaaataaaaataaataagaagcagtagtccattctacctgtctgccaatttctatgttctagttaaggacatgggaacacatgatcagcaatacatgatcagatataatcaccaygagacaaggtgtgttaacaactttacgttcagggcctggaacataatagatgcactgtattttttgactaaataaatagctattcctggaggtgtgatgattatactatgcccagatcctgccaaaggcaaaaaggcaaaaagttatattcagaccagctatctstctatttttttccctgctcagggctaaatttttccgaaaaaatcacataagagtccaactgtcagaatgagttcatcacctgggctggggatcccagattctgtgagcagaagacttcatccacccaggtgtctatttcaagaacagtctcctcttttgsaaaagcgttcatggaaatggccttctctcctaacagacagcagctacagagcctcctttccctgggctgcagagggtaggttaatggagactgaggagccctctggagaacagcaaaaggaacacgatttcacccttcttagcatcctggggcttgtgatacagatggcccatgttgcaaatggagacgccgtggctatgttgccacttgcccttgcagacacaagtacggggacattatattcaattttgggtctccatccatatgctgctcctccaatttatttgtctacatgaagggatatgaagcccaaagccagaggacatccaattcggctttaattacagtgatgagctgtttgtcagggtgccatgagctgcaacgccaccttggtcgctgacaaactcggagcaggggtgacaccaactcccctgttggctgctgatcattgaggcttgggcagcagcagcacttagttcaatatttgttgtttgaaacccaacagttatgactctgccaagcttaatgaaagggagaaaataattatcagagagcttatgcaattttgaagaccaggggcttttaaacaaagttaccatgccagaagtgttcttggcatgtcatgaggactgttgccgttattagcgatgacaatgcagtcattatttttacactggcttaattgttcagcagacaccaaggaccgtgtcaacacagttctgcaaatggaaacaaacacgccatcattcagggtcccactttgatattctgcctttgcacttgtttcattttttcyttgaagaacattctatagatcgaaggaattattccagacctctgattcatgctaggcttattctcttcctcattcagtctctcaatcaatcaatacttactgagtacttgtcattgcaagacctgaggaatagaggggctagcagaccagcctgggttctgcccttattggaatctttcaccttctactgcagaaggtcccacctttaggtagaatgatcagagatctctctgaggatgtcacatttaaactgtgactctaaggatgaaaagaagccagatttgtaactaatgaaaggatgttccagccggatgctggaactttgggaggccgaggcgggtggattacctgaggtcgggagttcgggaccaacctggccaacttggtgaaaccccatctctgctaaaaacacaaaaaattagccagacatggtggcagcacctgtaattccagctactcagaaggctggggcaggagaatcgcttgaacctgggaggcagaagttacagtgagccaagattgtgccactgcactccagcctgggcgacagagcaagactctgtctcaaaaaaaaaaaaaaaaagaaaagaaaaggaaggagggaaggaaggcaggaagaaaggaaagaagaatggacatttcaggtggagggatagcaactgcagaggccctggtagttgaagacattatgtctagataactccatcaccatggcttatgccatgtaggggtttgtctgtctcacatagcaagaaacctaaaagtaggcaaaagtttaccagtgcagccatgtcaggaccagcatctctgcaatttgtttggtcttcccttatggttacaagctgcctgcagcagctcaggccatcctatctaaggctggggcaggagtaacaggaaggttttaagctaactatatctgtcattttttgtttgttctatttcaagaaagcaagatattttccagaaactttgagcagttatmtgtgtatgtcacgttaaccagaatggtattcaacaggcatccctaactgcagcagcagctggagaagtaagatttagttgsaaataccaataattcaarcacaattggagtttggttatcaaaggacaaaataggccatagatatttcaaaaaaaatggtatgttcaaagtattattttaaaaaggccagggatggggccaagcatggtggctcacgcctgtaattccagcagtttggaaggccaaggcagacagattccttgaggtcaggagttcgaagttagcctagtcaacatggtgaaaccctgtctctactaaaaatacaaaaattagcctggtgtggtggcacacacttgtaatctcagctacccagcaggctgaggcaggaaaattgcttgaactcaagaggtggaggctacagtgagatgagatcacgccgctgtactctggcctgggcaacagagtgagactccatcttaaaaaaaaagcccatggaggctgcactccaaagrtggagcgatagcatagtgtaacatgatttttgagatgtgtgaagaggtcaaatccacagaaactgagggccgtgatcagacatcaccaactgtagtcaaccacatgttaaagttgaattgttccgtcttctgttttccacatccaccttsttccgtccaccctttcctgaaggtccgtgtgaggcctgaccttgctttgattcttgcagtcctcttctaactgtgcccctttgcctccacttcctgcctgcacccttgcatctcctatctgtgacttttaaagaaagtaaatctcaacattcctcagggctccctatgacgtaaattccaagcttctctgtgtgacctcaagtcatttctgatctggtgccttatcctgcagccacagcccctgccacttcctcctttcacgactatcttatcacagctgtcctgttatttgtgattstcccaacatccctcaggaacatttgccttccttgaagtcctttttcttcgggtcctttccagagtcagagtgggcttttcttgacatccttatgggaaagggacaactcattcctttgcctttccaccccacttgcgttccacccctaggttgctacacattcccctagagggcttttgtttgtccacctgagtatcttcttcccactggtctctggggtcacagggggcaaagacctcacctcactcatcttggtctctggctctgagcacagcaccctgacaccawcataagctgtaactacaaattcaatggaattagtatgaaggtaaggagccagcaggttctggtggctcaytgaggcattactgttcttgtttttgagatggagtctcactctgttgcccaggctggagtacagtggtacgatgtttgcttaatgcaacctcagcctcctaggtacaagcaattgattctcctgcctcagcctcctgagtagctgggattacaggcgtgcgccaccacgcctggctaatttttgtatttttagtaggcacrgggtttcaccattttggccaggctgatcctgaactcctgacctcaagtgatccacccgcctcagcttcccaaagtgctgggattacagatgtgarccactgtgcccagtttgaggcattgctgtttaaggggccagagagaccacaataggcacagaggctgagacaacatgggtggtaccatgtagacaacatgtagacaacatgggtaccatgtagacaacatgtagacaacatgggtggtgccatgtaggctcatccctccatgatttgctggaagaactaagacggcagtaggagaagtggataaaataatgtctgtggagtcagactgcaagggttcaaatcccagccctgccattcaccagccagatgaccttggtcaatgtacgtaatgcctctgtgcctcattttatgcacctgcacagtggaggtaataatagtgcctgcctcataggattttccagaggattgaataagataatctttgagagtattccagtacatggtaaactstcgcaccatattaactattgcagtatggtgttattattattatgaatatctaatacagttaatatctttgtacgtaggagttttrgcaggcaggtgtgaatggcacttttgaagatgcagagacagatttatccttatactcctaatatttatcctcaaagacactatttaactcattcaaaaatatttactcttttttaaagaccgctttcagctcctttttatacaaaaaaaaggaattctatcctcattctagcaatagtagcctaaagaaaatcttattacactcattatcttaaattaaggtaattgaaaaccactgtttaagagtagaccccaaatgtatcataaaattaattcaattataaataacaagaattgactgtacttgaatgtgcatgaagtatagaatcatagtggaacatttaagaaatatgtccttatcttgttactatggctacaygttactccaagatacagtagttctatggtaaggttggaattacattatttcctctctatattgaaatattcagcaactaatttcctgtagcttcatagtaaatcatgctaatgacctcagaggtggaaaccaaggtggtgagactktctccctgctctaaggttattccattaaacaaagcagagaatacacatttatactcatttgatcaggaagcataaggaagcttataatgagaaagacatggcaatgacatctcatgaggcgatgttaactttaaactcaagtatttaatattatttattcattgcgtccatgataggatcacaacagtgagaaaactagagattcatatgggcaggaactgagaggggatatggtacaattgaattcaattccacaagtaattcatggaaacttatcatgtgctaggtacgtattaggtaggatacccccataccctattctttgtctactgaaattattataatatttttgtgtatatcactaaacattcaaarcagtgggaataatgaagaaaggaagttacactggtttctaaaagccctatcatcagtagcaatttctcaaaagctcttcatgacatcctagagacatcaaagcattggaagcactggggtgctggggctggctcacggcatcttgcaccagcggtacatatctcttccaaactctgtattcagcgatgtcttgttggtagttgaagtccaccatgatggtaatatttacaccacagaaacaaacaaatattacaagtcaggtctttttttcttcttcccagagaattggctattaaacagttagcagcatgccactgattacaagcagcgatgtgagattgtatcttcttatttcaaagactgctctttccactttatgtgtttgtttccctttcccaaacctcttccacattcacctgtaagactgatttttgcctctctagatgaaggtgagataagagaggtttgtaagcttgtctctgtttacttcaccctgagtcaagccaccaacttctcttgctggactttgtctgtaactttcaaattagtccctttgtgttgatgcttgctcccctccaatccaatctccatccaccaatgagagtgatcttctaaaattgtaagtcacttaagcaaacagaagaaaagtaataataatgacatccctaattctctctctctctgtctcatgtctatgtctatgcctatgcctatatctgtgtctatatctccctatccctacccacttttctctcccttgctatcattatctctgtccccaatatatgcttctgcacatctcacattctggctttttcttatgctgctycccataagacccttcacttctctattgacatcattttcaccttcaactccacactcagatactgactcatacatatgattgattctcaccwgcctgtgtcttgttgatccaggtctcagcttagaaattacttcctccaggaagctgtctccaagtcctgttcagatatctgtccttayagagcgttttttatctyacttactatactttttgttgtcttacctatttactatatgcttatatagtaagcaactcttaggaattagacaaaagttcccatttctgtaagacagatttccaaaacaggacagatgcttgatgaggaatgcttgagctggatttcaaccttttcttcccaagtattttgtgtggtgaacaacctgcatgactggcccttccccttaaccatttccattatagcatacattctgtcattgtagcacttagatgtgtatagcaatctttattatctgcctctgtccctgaagattatataccccatcttttttttacattcccagtgcattgtgatcatatattattcatctttatgtgaaacatggtgacaagcatatagtaggtgtgtacattttgcttgaagtaaagtgaaatcaatcttgttcccataccactcaaccttactacctttattcacccagatactaatcaggtactgcttcattccagatgcttagaaagatgagcaaggcacggaatatccctgtaggaaactcgaaggcccatcagagagacagacacataattgaacagtggtgacacaatatgctccatgacaaacatgtgtgagactaactgcattagaattccctggcatgctttaatgaagatttccagactgtacctcacacctaatgaattaacatatttgtgctgcttcttctgtcttctctgtgcccctcttcccatcgtttccaaccaactcagccagtcactgctccctccagcagggaatatgcccctgtgaartgtacctatgggaggatagccatcattggctagacctggaaactagttattctaacccagttaataacaaacccagaacaactgaacccctaaaaggcggtggatttggacaagaagttctagagagtatttgctaagaggtgttgatatgttgcaaagaatcaatcacttatttttcaaggatagctttaaaaaaaaataaaagcccacctacttagtctattagaaataaagtcagtaggccaggcacagtggttcacgcctgtaatcccagcactttctgaggcagaggcgagcagatcacctgaggtcaggagttcacggccagcctgaccaacatggtgaaactgtctctcctaaaaatacaaatttagctgggtgtggtggcacatgtctgtaatcccagctactcaggaggctgaggcaggagaatcacttgaacctggaaggtggaggttgcagtgagccaagatcgcgccattgcgctccagcctgggcaacaaaaaaaaaagaaaaggaaaagaaaaaaaagaaagtaaatcactaagtagccttttgcaagacaaacaaaaaaaaaaagaatatttaggatttagtctataaccattgacttttggaaatcctgtccttcctaaggaaaattagaggaaaaaaaagagctgaagtctctgttgcatgagaaataccatttgtgattaaactgctgtgaaatacatactcaaaactgtgggaaattcttgccacatctttctaaaattgctgtttgatgtcttacatgccaaaatgactgtgaactagtgctctcttgaaaaccacctaaatgatccacgacaaggaagtcattaattaaataataaggtggatgtggactactatgcaatcattaaaaatctattctcaaataatttttaaacatatagaaaaatgcataaaaatactattaagggaaaatataggttataaaacaatattatagcattgttctagttttactaaaaaatcgtgtgtattcaccaaaatgttgacagtagggtttaaaatggactggtacttaaaggtgattcctttacatttttttctacttgaaatatttctatatttatttgacttcttcataatggccatgttttatttttagggctgccattcaattggtcatccaatctgggacaggtttcagagtaaaagaggaaaccttagcaataatatgggactataggcaaaagcaggactgttttggacaaacacgctatgtggttgttacgggctgaattgcatcccccaaaacccatgtgttgaagtcctaacctctggtctctcagaatgtggctttccttggaaatagggttgtggcagatataattagttaagatggggttatactgaatgatatagattgggtctttaatccaatatgactggtgtccttagaaaaaggaaaaatacgsacatagacacgcccacaaagaaagaacactgtgtgagcaggaaagcagagattgggatgatgcatctacaaggcacggaatgccaagaacagacagtaaccaccaaaagccgtaaccgcttagtgggttcaccttacctgctgcctacccagagccaacttctcaagacaggggaattgcaatagagaaaaagtaattcatgcagagccagctgtgtgggagactggagttttattattactccaatcaattcccctgagcatttggggatcagagtttttaaagacaatttggtgggaggggaggggcagtgagttggggagtgctgattggttgggtcggagatgaaatcatggggtgtcatgttcttcttgcactgagtcagttcctgagttgggggtcataagatcagatgggccagtgtctctatctgggtggtgccagttgatccatcaaatgcagagtctgcacaacacctcaaacaatgaccttaggagcagtttagggagggtcagtatcttacagcctccagctgcatgactcctaaaccataatttctaatcttgtggctaatgttagtagtctaatccccaggcaagaaagaggtttgtttcgggaaagggctgttatcacctttgttttaaactataaactaagctcctcccaaagttagttcagcctatgcccaggaatgaacagggacagtttggaggttcgaggcaagatggagtcacttaagttggactgttttcactgtctcagtcataattttgcaaaggcggtttcaatcctataagaccaacatacaacagattctcccttagagactcagaaggaaccaaccctggcattaccttgatctcagacttctaacttccaaaaccatgagacaggaaatgtctgtttaagccactcactttgtggcatttcggttttttgtggtaggcctaggaaactaatacaatggtcattgtagttattttatatttagaaattaagagcaattctggaggtgagagatgggcaggagtagggaagaatgaagttcagtgcaacaaaagaagcttgttcactcaactaagactgtaaacaatgctgtttttcaaaaatacgtattccttctttctgcctggcccctctttagagagccatgtcctgttgatatcaagcttgaccatgtgacttgcttcagcctgtggcgtgtgagtcacagtcacatgttccattgagaaatgggagctttaaagaccatgctacggttctgccacctttgtcgtttgccatgacacgagcttatcctaagggagagctgcttctttagcctgaaacagagttgaaactgatctgcaatgaacctgtcacatgagataaaaatgtatcttttggccaagtgcagtggctcacatctgtaatcccagcactttgggaggctgaggctgggggttcacaaggtcaggagatccagaccatccaggccaacatggtgaaaccctgtctctactaaaaatacaaaaaaataaaataaaattagcaaggtgtggtggcatacacctgtggtcccagctactgtggaggctgaggcaggagaattgcttgaaaccaggaggcagaggttgcagtgagccaagatcgcaccactgcactccaacctggcgacagagagactccatctcaaaaaaaaaaaaaaaaattgtatcttttactagtgttattcaccaagattaggaggccgtagtgttactgcagcagaatgtagcctaagctgactgataaaacattgactaagcaactctcaggtaccatgccaggatgaaaaaattaattagacacagaccctgccagtgaagaactaacattatactgtgtaccattggcctttaaaagataaagatttttggccccaggtgtgttctatattttctgtaagacctgcaagtaaatgttaaatgatgttatttcaaccggtttttctgtagcaaaaatctttaaaagctctcatattcaaagtggttcttgcaatcttgaactacatgtacagatataaaatctgccaattaaaattttatggtttagggaaaaaatcccctctgaaaaataaacctaggtcaattatttcattatttaattctcatttggaaaataagatgttcagacattgagttatattagaaggaagaaaaccacttctgtgggaacagtcaaatttatttcatttactaytagagaatgttaatttcaagaagcaatctttgaaagcaaccaaatttggcaaagacaagtagtcttccctgagaaatattggacagcaacagattatataaggaaaggacagaggggagagacatctcaagtgtaggtctggatggaggtagaagagtcatgttctagagtcagcattgtaaagcaaaaattgcatggtgtcaaaattatccttgaaagtcccttaaatggcccttaaattgtctggacctgtgcctttagaggttgaaaggccaagaattaatgtcttttgtttctctggggcagtgaaggccaaggtctaatttgaaaggggcaaaggacgatggggaaaataaaggatctctgcctttcttggtccatcttttggtctcctgtcctctctctaggtgactcttcctccagctctcctcctgctctttcccctcaacagtgcatatagctaaagtcaaacaagttaaatgtgcatgttaggcaactctagtccttacaacttaaaaactttaaaatggatgcattgggggcctattgtgtaccctgtcctaggctagatatggaagagatataaagcagggatgggggtgagatgaggagaggaaacaacagacctcacaggagccaggaagactgaactgcaaacagatgatataaatacagtgtagtcaagtcaaggcagtagctcaggtaaacacacaatgccacaaacaggagttctcaaaccttggctgcattttagaatcacttgagcttccaraagcttcaatgcccaagacacaccccagatgcaccccaattgccagtgaccctggaatctttggggaggacctggtcatcagcatgtctttgagctccccgggtgagtccacatgcagccaaggttgagactgggggctacagctgtgtagaagagcatctggtgtgggtctgaaggctgggcaggaattagctggtagcagtgtgcattccaggctaggggaaccccagtactaaagcttcttcagcacaaagwggcttggtttgtgctttgaacatagcgtggttataaattaaagaataaccaaactccttgagttgaatcagtacacaccataatgcatcagctcacattgacatggcaacctcttttcatctctctttgttaagggccactggttctttaaaagcatgcgtattaatggattctatctgatgatgattcactccatagttccatcatgtatgcatctctaaccagtataagcaaagcattttcctttcaagagtctaatcctagcattgtgccatatccatggccctctaagatacacaccccatctacaaaggcgacatgtactcttaaggtacaaagcatttcctttaggggagtgattgcctgtgtgtccaagctgatgaagggtgctcttttaagttggagaaaattgattttgttgtggttgttgcacaaaggtttatgttttcaaagcctccagataaaaggcaccatgggcagctaacaagcccctaataggactacatcaagttttactcacctgctgccagggcttgacttctgcgtcttgaygacatgaaaccaggctttgacagcattcatttttgctgaaggaccctcccccagcctccttccataaatcctatgctcctttattccgtattcattcagcacagatgtttttatggccataatatatttatactaattcagaggcttgccatcagtagataggctcatctctctgatccggaaggcggcagaggcactccttctgacattgcagatgaaaataaggtctgcttttttcccacagygctcttcaaaggagcaattttctaaaattcgaacaagggtrtcatagttaataagatggaattctccttttctttttcttattatattttccaaatcaagggcagtagattccagaactccaatgacgtcaggccactgtactttsaaaatgctgttctcagtcaggtttcttattatctgatcctggttcagtagattgtctcagaattgactttttagattaattttgattcttagttaaattactttttaatagctaattaccacacagtctatctgattaacggtattgtgattcagatcaagcggtgagatgactacaggtaacagacccttgctatcatttgggtgttctywcaaggaacaggagccaggtagtgaaccatgtgcctaccctttgggcagggaatgggtggctctaagagatgacagatgctgtcatccggaatcagttctcatcttggtcaattggatgagtcagagagattttggaaacatcttcaggctaacccaatttacattatagttatattttaattgccttttaaagtctaaatgcagttgattgtgaaaactgtgtcacatcatttaagggaactagagctttctttttatggaaacgcaaaaggacctagcaggaaaataccacattgcctaagcagtaaagaaatatgtccggccgggcgcggtggttcacacctgtcatcccagcgctttgggaggccgaggcgggcagatcacaaagttaggagatttagaacatccgggctaacagggtgaaaccccgtctctactagaaatataaaaaaaaaaaaaaaaaaaaaaaaattatctgggcatggtggtgcttgcctgtagtcccagcaactcgggaggcagaggcaggagagtagcttgaacctgggaggcagaggttgcagtgagccaagatcatgccactgcattccagcctgggtgacagagtgagactctgtctcaaaaaaaaagaaagaaaaaagaaaacagaaagaaatgtgtcctcaaagcttcctcagattgttctagaaaagagcactagcagcccccaaccaatgcatgccgtgaactcattccaggtatcatgcacctttgattgtttcactttccttgggtcaaacctttagaaagtgggttccctgtctcaggcactgagctaggtaaattcaggggataagatcaggaagagtcccttcctgaatccaggtactcccactccccccggacaacaaggtcagaggcaatccctcgccttcacctctcatcttatttttaaataaaagtttctctttctttatgttcttcgctttctccttcaacaagattgtttcctgctccctccccacccctgctgcctctctgaatgttgtttctcctcactgcactgtgctgtgcagtgaatccatatttcttttccttttttccttttcacacttgaccacgtctttattcaataactctgccccttcacagcacagggcccggtggaggctgcccttccagggagcccaggctcacgtgtacttgccagggctggctgtccctgtccagcaggkcacagacctctcctggtctgacactgaggagtgaccagtgctgactcagagcagcccatcyacgggcgcactgttcagaaagtcgtggaggtagatatactgctccagcgttggggtcataaggccacaggccggggactgctgcagagccacgttaaacagatccacggtacactcagtccctgcctggtgctgcagctgctccatggccaggaaggtgcccagctgggtcgcacccttgctcgagtcactgagcagtgtgcctggcttctggctcttgccctgagagcagcactggcccatggtagccaggaagggcggcggggtggtccttggtacctggagccatcaaatgctgggctctctttgggcttcttcgcagcagccttctttctttactttactcacttcctaaataacactgttctcaggaccttcattactgcatatatattaataattcacaaatctgaatttcatcctttgcctctcatttggtttycaaatttattttcactcacaattcctacatagtcagacaycttcaacttcacgtttccattttgattctttgtcttgccttccatgtcttgtagcttatctatttttttctgtctcggtaaaagttcccatttgcccacagtagaggattgaaaataatctggcttttaaaaataccctgggggaaacaaaaaaaaagaccattcatcagtctgctgattctatatctctgagtaacactgtgaattcctgtgactctagttgagttaaatttattcctagcttttaaaaataaagccaatgaaagaccagagagattattacaaagcctgcattcttgtgaagttgctgaatccacagttttattttagtcaaatcacatttccatattgcaaaaatattttctaaacaattaatgggtatcatatggggtcagtcttgtggcgtttattcttttgtaacactgagctaaagtctctatgggaaagataaataggttgttggagaattaaactggtcaagaagtgaacattgatgcctaaacctctcctctgaaattttgagcacatgttaacataggcacataaaaaagagccttagcagaaagaagaaacgatatttccattgttgggtcacagtggtcactaaaggggatataactttaatttctcatttgaacgtacatggcatccatttaaccaactcatttacagcatagccgcctgtcaagcatataaaactgtaccacattgagctggatcggtttttaaattctaatataatgcacctgggcacggtgggtcatgtctgtaatcctagcactttgggagactgaggctagtggatcacttgaggccaggagttcaagaccagcctggccaacatggcgaaaacccgtatctactaaaaatacaaaaaattagccgggcatggtggtgcatacctgtaatctcagctactcaggaggctgaggcacgagaattgcttsaacccaggaggcagaggttgcagtgagccgatatcacaccactgcattccagcccgggtgacagagcaagactctgtctcaaaaaataaagagaaaaaaaaaattgttacataatgcaccctcgcacatgctgttggatgtaccatgattcaaactatgaattctgtaggaaagctacattttaaacatgtttgggtgaaaatgatgtgtcaatgtaggttcaatgactgtatcaaatgtaccactctggtgggggtcattggtaatgagggaggctacatgtggaggcaggaggtatatgagaaatctctgtagctgactttcaattttattataaacctgaaactgctcttaaaaaaaccgtaaaaaaataagtttgatgaacttggttttcaagcaggtagcaattaagactgtggttgtcatagagacagacctatggcaatggagatgaagggtgggagcttggctttatcagaatggcaattctgcatttttgtgaatgtcagcaaatgaatttgacccatgacgtatggacgtagatcaaagggcacatttagcatactgtcaatgtggtgctcgtgtggccttccaaaaggccagttccacagtgataaccaccactaataatcctacaaacctctccagctgctttcagtgacatgacttctgatctggagggaaagaaaagaggggtgatattttataaatatcaattttcaaaaatctctgatctgttggtattaactgatgagctcagagatgctcggaaacctcctgcctgcacaacaactgtaaccatggcaacctgcatttttaaaggatgttaaagatgtttttaaacatcaggtgagaaaaacagtttccacacaagtgtttgtctgggatgttatgtctaattcctccagtacacatttttccgttactgggacttgatacaatgctggaagctttcctgttagggcagaaattgggcaacccaagacagtcacagatcttgagatcgctgccattgctatgaaaatgaggcattcttattgcatctagactgagcatcagcatgcctggtgttcttatacgtcatacatgaaagagattggcaacccttcctgaaagctttgaatttttgatrtcatttgttccacgtgattttctaaggctatattggaccactatacattctagaacaaattaattaaagcctccagtttccagggagatatactaatatctcaataaagtgctggatttgagtaaaagacagagaatcatgtctgtaatcctagcactttgggaggctaagttcaatgtagtattcagaatttgaatattgagcttctatattaaagaaatcatcaaataaataaataagggtctatcagttttctgaagattcagatttttgttgtttttaaatgagtaattctaattgtattttaaatgagtatagggagggtccattttaaggagtcagaatgtaatcaaagatgcctattactattatattttcagatagaaacagataaagttcaagcagtgcaaatactaaataagcaaattaagcattatgtcttttttttatggtctgccactcatccacaaccaccagcatttgtcttgasaaaccaccaacatttccctcccccgccttgactstgcatggatttgcatatttatakagttaaagaatcacccaccatggttctctttcttatccacattcttgtcttacccatccgtctctgtcactctcctgatatacctcttccctactaattacattaatcaacaacaaacaacaactctaaaagwttccccgagatgagagtttcagaagcctgagacgctatgtcaaacaacccaccgtasttattcagggacactgcaactcaaaatgaggtagccatcgatccagagaacaaatgatcattattcatgtaactctcttctttgcttaagaatccatctttttctatcagtgccaaattctctcactactttcctggttctaattcagaagtaagtaaagtcagctagtccctttgtttgggggttaggcccattttataaagaattaaaggaaaataggttaaacatgaactgcttctcagacgtggcatttacatgcctggtgcttccttagctcatcatataaccaagtacyggaatctgttttacagataataagaaacattcacrtgttccatcttttacatatgtgaggaccaggcactgactagaaaattttcatcaccattgtcctcatcatcaccatcattagcatcttgtcgtcatcattgtcacgatgacaaagatgctttcatgatgatgaaagcatcatcatgctttatttacgtgatatcattgaatccttccaacaagataccagaccattttattgtagacattttacagatatttacactgaagttcagagttgttgagtggtttacccaagaatacgtagcaagtaaatgatagagctgaaaattcaatctgtctttctctagtgctaagcctyagtttccctaccaagttttaaaggttgaacaaagcaaggtgttgaaagagcaccctgagtctgacagtcagaggggaatcagggcaggaagtatctactgaagwggtcctcaaatttcaggttgcctaaacagttactgaatgagcttgtcaaaatgcataaagaaggccctacaccactaccactaccaccaccctctgacacacatacacacagattgtgattcaataggcctgagattagtccaaaatctgtatttgtggcaaactccccaggtgatttcaacagagacagtctgtaggccacccttggagaaatggtkttatagctggattggggactgttgagatgcctaaatccccaacttgtagagctagcttgggctgctcccaagtcyagcacactcattgatatggtttggctgtgtccccaygtaaatctcatcttgaattgtaacccccacaattcccatgkgtcgtagraggaacctggtgggaggtgattgaatcattgaggcaggtctttcccatgctgttcttgtgatagtgaataagcctcacaagatctgatggttatataaaaatgagaatttccctgcacaagttctcttctcttatctgccaccatgtgagacatgccattcaccttccaccatgattgtgaggcttccccagccacatggaactgtaagtccaataaacctttayttttgtaaattgcccaatctcgagtatgtctttatcagtagtgcaaaaaatggactaatacactcacctatgtagggaaacctctttgttccctacataggttctctgcattggttcagagtccatctcttccactgggatgtccatcttgtggtcaaaacctgcaccccaggtaacataaaataaaaataacaatggctataattgtgaaccgcccgctaacctcctsttgtagtgctccaggccrgacgctcatcaccttgttttgttgtctttgccatcagcattatagtagagccattggcactcacccatgtccagccccgttcctcctgggcacacagaaatttccgactctgttttctattgcctttgcagtcagatggaaccatatgactagtgctagccaaagtgtgtcatctccactctctttctttccttggtaccatggatgtgtttgatatggtgccagctgcaaagtagtggaggcttcttcagygtgggttcttgagctgtcatatagcataaagccrccacccaccattctgaattcacagcatgagcaagagataaacaaacctttgttgwgttaaggctctgggattttgttttattttgttcagtttttaatttctgtaccatakcctaacccatcctaaccaataaaacctcrtcgctgtcaacatcatcatcatcatcgcaataataaaatgtattaattatgaacataaaaccttaccgtgtgctgaacattagactaagcattttgcaaacattatctaatttaataatcacaccaacactataaaaaagacatagttgttatctgtrtcttacccagctggtaactgatcgggaaaaaaatgaaaacccagcagcctgactccaaagcccgtgtgcttatccaaacactacagcgtaggttgcttagtgccagcttcagtggttagtkctttacatgcttatcataggtaatcctctgtcaacctgtagaagtaggcatgattaacttaattttccattgtgaacactgaaggttggacagattcaatgtctggtctgaggccacacatcacacaccacacactacataccacacatcacacaccacacatcacataccacacaccacacaccacacatggtggagttaggtcacaatccacgtccctctgactcttgaaggaagcatcatttattgaaaaactagagtgtctaagcaggtgattttgattccttcaagtctgtttcagaaatgtctaggggccccacagatctcctgaggtcaggggttcaaaaccagcctggccaacatggtgaaaccccatctctactaaaaatacagaaattagccaggcatggtgggggcgcctgcaatcccagctactcaggaggctgaggcaagagaatcgcttgaacttgggaggcggaggttgcagtgagccgagattgtgccattgcactctaggctgggtgacaagagcgagactctgtctcaaaaaaagaaaaaaaaaatcatcgttttactgatgatatttacaataacagcttctgccagtaatagagactaccaataaccaatgctatttattaaatactaacagtgtgtatatatatatatgcatgctggctagtgtcacgccctcacaaagtggacattattatcttacagataaaaacactaatgcttggagagtttcattgtttgccacagggtgcccaggtaaaaccatggcagaactggagacaatccaggcagcctggctccaaaaccttgcagttggccagcacactctctgcccagagcccagcccacgctctgatcacagaaagtgtgtgggagatgagtagaagcaggagaaaaaaaaaaaaaaagtaaaatgtaggctaaggggttgtcctgtaagaatttaggaatccctaagaaggagaactagaggatcaagggaaaaaggccaagtccagtaagtccctccaaacgtcaagtggggacatctcagtagagtatacccctacaactgatctgccaagatgttccacaatacaaaaaggattctgttggcaaaaacaatgcccacccctgcctgtcttgaagattcaaaatgcacagtagatgatagatgatggatattctaagatttgttgtagcaagaggctggttgtgtgcttaactcttcctttctaatttgcttttgaccacagcaccctttttattatgcaaaacctattaacatctactgaaaggcactcagcatttgagggaggggactagcaggctgcagaggagggtgctaagttctgtgctgaggaaggtggttggttgtggaagatgtagtggtcacaaatgagaagagtggacagtgggtacagggtagggatgatgagacctggaattgatgacctcagcagagaaggggaggaaggataagaagcaaatawcagtgacatatgtgtaagttaaaaagatggaggtagagctagtttccaagatggcttaaaaatacacatgggtgccggtttgacctcaaaatagaaattagagacctagaattcaggagagaaggcagaactagcaaatggagactctaggtcaccttacctctccttttcttggaggaatggtggaaagagaagaacaactgaaaggcttcagcacaatcgctctrtaggacccaggagagagaagagtagcctggaatcaacagtggtgggagaggctggagggcctcaggaaattcaaggcaaaagagtagttagctctaatgaccattctttaaaagtagaaaaaatgaaagtggagatgtgcattgtttgtggaaagatagaaccttcctcagtcagaaagcattttgccattagcagcaggcagtgatgctgacaatttgcagttggtgrccaggttttaaacagtagtttgggcaagaaagggtatccagcaaatcaatttgcaatagctgatccctgtcattaagggagtcaattcttgatactgtaagtgaataaccaagtgctgctctggtacaattgaggtatgaaataccagacctgactattttatgtaaatctctaacatggtgtttaagcaggacagagcagcggggaggaaggggcttaagcagaaatgggctttgaggacctctcggcccagacaggaagagtaattgggctaagatgagagaggggcaaaactcagcacatctccaaagccatccaaggttgcggacaattaacctcttgattcctccctcctttccttccaagatcagatttttatcgtctcagaaacatatgaacttcaagaaaatgtgaggaacacagactttctgagccagcttccattgacatgccatttgattaatttatgtggttgggacagcagttcagagggaatatagattgtgctcttacctgccccatttccatatttaatatattcaggcatggttatgatagagcatctcatgtttacactaactttgtgtcttttgaagttcacttttaactttgtgttgataaaatactattttctaattcagatttttcaaaaaatgcccgttgggcatcaagtagcttttacagaatgaggtgttcttagcattattatgaagcaaggacaagtgtattaccgccattcacggagacatttttgcagtgttgcaaatctcccaaatgtttcaaaaaattacagcggttgcctgttgcacctcacaattagctgcctaagattctaggagagaagcagttggattttatatgtgaaaatgcctctatttgctgcatttttactttttgagaagttgcaagttacatgaaaataaacatactatataagraaacacggcagatttctcctggtgttttaataattccccgaaggtttatgaatattggcaaacgtatttgcagtggtacttccctgctatttactttgtagactttgagtcttagattcttgtctgtaagtgaaatgtagtattaaaaaaaaaaaaaaggccgggcacagtggctcacgcctgtaatcccagaactttgggaggctgaggcaggtggatcacttgaggtcaggagtttgagaccagcctggccaacatggtgaaatcccgtctctactaaaaatacaaaaattagctgggcatgctggtgcatacctgtaatcccagttactcactaggctgaggcaggagaatctcttgaacctgggaagcggcagaagttgcagtgagctgagatcacaccattgcactccagcctgagggacagagtgagaccctttcccaaaaaaaaaaaaaaaaaaaaaagcattacaagttggagtagcctgggctcccgtgttggctttattactgagctgtgtgcaggtggatgttttgctaaatctttctatgttccacgttatcaagaccctttctctcttttcccaaagctctcgtatcaattccatttaagccaaatctcattatttcattgcttttttttttaattatcctatttttaaaattattctccctccttctggtttccattttcaaatagttcaactggatagacataatagcaaaggcatagaatcaacctaggtgcccagcagtggtggactggattgaaaaaaaacgtggtacatatgtatcatggaataccatgcagccataaaaaaataaaatcacaagctttgcagcaacatggatgcagccaggggctattatcctaagcgaattaatgcaggaacagaaaaccaaataccacatgttctcacttataagtgggacctaaacagtgaatactcacggacataaagatggcaacaatagacagtggggactactagagtggggagggaaagaggggtaygagggttgaaaaactactagatgctgtgctagctaggtgacaggaccaatgatactcaaacctcagcgccacacaatatacctaggtaacaaacctgcacwygtacccgctgaatctaaaacgaaagttgaaattataaaataaataaataaatgtggtgcttatttttaaaataaatgaacaaaaaaacsccaaagagcttagctaggtgttaagyaccatccaatggacggtgccatccattatataatatagatatttacacacacactcaaacacgcatacatgtatgtatgtgtatatatatacacacacatatatttacgactgtagccttctttccagcagaagcagtttgccaaatgcctctgcccttccttagcccaaatgctaatagtagctatttcatgaatagatacagaatracagagtcaactttacctaacttctccaaaatgccgactccagtattccattttcaaattaacttattctgattataaaagtaatgttcagtattgttagtaaaataaatttwaaaaaaaacgaacttgtaatttccccactyagagatagcttctgatamcatattggtgcttttacttctatttttttctatccatatgagtataattaaatacatattcacatctatatctatactcattcatatatattcatatgtaagattaaactatatgttcaaattgtattctgctttttaaaatyacactttattttctgggaatgttctcttcataaagttcttccaaaccatgatatttaatgtccacataagaaaacatctcatggactctcaatttattgaaacttttccctagttttggttattctgtttcccaccagtcattaattactttaaacaattctgtgaggaccattcaggtacacagacgtgggtccacagttatctattttcttagcctcagtgcttggaagttgaaatttgtattgaataactaaattcctttgacaattaaaacataatwatcaaacttttttgcaaagaaataacactatggtatatgacatctatggcatatgacagtccctgcttaccttatgcttgccggcattcagtgcttaggtttccttttttttttgagacggcatctcactttgtcgccaggctggagtgcagtggcgggatcttggctcactgcaacctccacctcctgggttcaagcgattctcctgtctcaccctcctgagtagctgggactacaggcgcctgccaccacacccagctattttttgtatttttagtagagacaggatttcaccatattggccaggattgtcttgatgtcttgacctcataatctgcctgcctcggcttcccgaagtgctgggagtaaggtgtgagccaccacacccggccaagctttcttaaatgggccactttgattgatgaaaatgataaggtactgtggcctttttttttgccatttaaaaaacagtggtaaggttttttttttgtttctccatgtcttgggaagcagctgcctgttcaagccctctttccttttcctatttgggtgttaatggcttccctattgattcataaaggcccactacttattgtggatattaatctcttgcctgtcatatgtttgttgcctttcttttatgccagctagttatttgaattaattggatttgatgttttgaaatactgaatttttaaatctttagacagatacaataccattttttccttatgcgtattctcttgtttatacaattaacaatcttggcctgttccaaaatcaaagtcacatgaatacatatatttttctaagtttttatggcttcatattcacatctgattcttcagtccctctagatcttactttcgatgtatggtttaatgtgaagtcccatttcaagtttttacccttcaaattaattttccttccaaatgttattttattttattttaaatacccattctttttctggttttgtcacatagctttcatgtgatgttaagctctaatacatacaacaatttactttgggaccatctcatatattaaattttgcaaaaatgccatactgttccaacactcatagttttataatgtgtcttaacacatgacaataaacccttctaaaatacacacaggtttcagaactgccttaattattttttgctttgatttttcctctagaaaaaaaatgtgatcattttctcagactcccaccctacttgttttctcaaagctactgtcacactctggatgtacaaggtcaggggtggtgagagatcagggtgtttaggagtgtttgcttgactgatggagacacagggttcccaaactggaagatgacaacataggagaagcttccagttttccagtcaaagatactatgtttcatgaggcaaagcgtgagaaactcaccaatacaatttcccccaattccactctatcagcctttgagattttccggacagctatctgtcagtcttagtacttaaaattgttggaagtttgaacacaattcttcaaagatattttagtgaggaacaagagattttgctttggaagatcctgaacagatttccttacaaaaagtatttctaagcacccatccctataatatatctaaatgttaaatgcttattgatggagtaaaatggaaagtccaagagtcgtaacattatctggtaacagtgtggatgagaggtatgggagatgtaggcatgtgcatgtttcctgatttgaccaaacttttcaacatgagtgacccttctaactagttttccaaaaatagagagaagagatccagcatcaatgaaaatgacaaaattgacaaagttttgccttggccctcttccatcgtcgctatcctcttctcctctactcaacctccccatcagtctttttacccgcccgcctccttttttttgagggaagctgtattaggccattctcacatggctataaagaaatacctgagactgggtaatttataaagagaagaggtttaattcgctcgtggttctgcaggctgtgcaggaagcatggtggcttctgcctctggggaggccttaggaaacttatagtcatggtggaaggcaaaggggaagcaggcacttcttcctggcagaacatggcagaaaaggggcatggcggaaacagggcaagagaatggggtggggaagtactacacacttttaaaggaccagatcttgtgagaactctatcatgagaacagcaccaaagggatggtcctaaaccattcatggaggatgcacccccatgatccagtcacctgccaccaggccccacctccaacatgggggattacagttgaacatgagatttgggtgaggacacagatccaaaccatatcaaaagcttttctaattaggttactcattctatgaaaatagactgcccataaataatctttgtttttcagatgaagatttggcaagttctgtgcctagcacgatggctgacatgagataagtgcacaggaaattttgaaatatctgtgtctctatcttcatttccttgtttgtgtctccaatttcctatatgccatcaggggatttagtgacactgcaaatagcatgctctttggcaggcacgcctctcccatttccccagaacctcttcgtctttctgaggcatggagtcccaagctgtatgttttcaggtagtattgtaggaagattaacagtttcctgacatctttcttgcaaaggcatgaatacctccaccggtgcagatcaacataagaaatttaatgtttaccttgccattttataatgctatcaactttctcaaaatctgtccctctgcactctgttatttaagatttattgtcatcctgcatggtgagatagctggtggacattagccccattctcaggggtagctgctatggttgaaacatgctctaccaaaattcgtatgttgaagtcataatccccagtaattcagagtgtgaccttacttggacataggatctttacagaggtaatcatgttaaactgaggtcatttgagtagaccctagtataatatgactgatgcctataaaaagagaaatttggagatagactcacactcagagagaactccacatgaaaataaaggcagatggccgggtacggtggctcatgcctgtaatcccagcactttgggaggccgaggcaggcagatcacttgaggtcaggcattcaagaccagcctgggctatagtgaaaccccgtctctactaaaaatatgaaaaatttagccaggcgtagtggtgcatgcttgtaattccagctactcatgaggctgatacgcaagaattgcttgaaccccagaggcggaggttgcagtgagctgagatcacgccattgcacttcagcctaggtgacagagagactctgtctcaaaaaagaaaaaaaaagctaaaaacacaaaataacagcagaaatcaggatgatacatctataagcccaaaaatgccaaaaaatgcaaaacaaacaaacaacaagaaaaatccatgagaagctaggagacaggcttggaacagattcctcctcacagacctcagaagcaccttgatctcagattttcagcctccatcactgtgagacaatcaatttctgttgcttaagccacccaatctacagtactttgtcataacagccctaacaaacaacatagtagataaaaacaaaaaacaaacaataaaaaaagaaaacaaagaaggctaaatagcttccttctgaatgtggatcgtttcatcagaggatttgatctactgaaccttctactgcactaaaaattctcatttcatcaagtataatgaactgaagtcaaagggatttatttgatgctgaaccaakccaacactctccccaccccaccttagtctaccgttaacgtgtccgaaattgcatgcgttgttttgcttggatgttactagcccttgctgggaaaggtacttggcactaatgtgactatttaaactaatattcacaaagcagttaccstgtgccaggcttatatggattcatgtaattctcacattaattctgtgagactggtgccatgactatgccacttacatatgtccagccagaatctctagttataacttgttcctggtcatacactctgctggttgtgaatccagcgtttgaactcaggcagtctgaccctgggggtgacatttaaactactttattgctgggttctatgttctcaaaagtttagaaggtatttgttaaagagaattggaatatttgctatggaacttgtcagagcttttaaatatgctattatcttagggaatctctgagagtgtggtaaagtaagcagcatttctagcacatagttaaccgtgggtctctttttattaaggcragatctcttgggactggtgtttcttgaatagacttgccagacaaaatacaagaccccattatgaaatttcagataaacaatgactagtgttttagaataagcacatcccaactattgcactggacatattaatactaaagaatttgtgtttgtttatctgaaattctaattttactagggcgttctgtatttttatttgcaaaatttggcaaactatatgaaagatgcttcgaaaactatagagwacacagccaaagatccctgcctctcccaatcttctgggcctctttctttaggaaacaaacataaacctgcccaaactgaggttgtaccckttttacctgccctgttaccttcctagcatccatcttgctgtccttcattctgccaccctggggttcctatcaaactctgcttcctgtctcttatgacttagaacatgccatcccagacccagggaacagaacaggcatatccctggttatttcaaagccagyatcacaccagcatgtagagatatgaccagacaataacaatcctcctccagttatcactcgagggaaaggagagggacttatggggaacagatgcagataaaacccaaatctgatgccttgaggctggtcagtatgaagtctgtcctgtggtatccctctgcaacatttccatttcaggggagttgagggcttatcaagcttaggaagcaatgtgtactgaaaaggatgaggtcagttcggggtctgtcaaatcaattgaacatatcttgaaccctraattctatcatcaatctcactttacaatccatcccttccaattaatgctgcatataataacaccactcaatgatgttcatacatcccatcttcttacttggcactatcttttttttctttttaagagattaatttgtctttccaatatattcaagttatcttgaccaatgtttcagagttacttagagctttatggattgcagcaagaccgaagcaaatgaccactcataattcagaatatttctgagccagaataaagtttacacttcatgaccataaagaggaccctttatgcttgtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttccttgactcacatttctacatggttkgggaggccttaggaaacttaacaatcatggcagaatgtgaaggagaaacaaggcacatcttatcacagtaaagcaggagagagagagaaaaagagccaaggagaactgccaaacacttttaaaccatcagatgttgtgtgaactcactcactatcatgagaacagcttgggggaactgcccccatgatccagtcctctccaaccaggtccctcccctgacacatggggattaaaatttgaggtgagatttgggtggggacacagagccaaaccatatcaccatgctagccacatttcaaatcatcagctacgtatcgctggtggctattatatgcagtacatacatactgcacagtgtagatatgaaacgtttccatcatcatagaaagctctcttggacagccctattctagatgctttattctcaaacatgccacaggataacacataagatattggcatggataccattctatttgrtttgggacagaagaaataaggaaaaatgtttctgaaacagggagtccattttagattattttatatgaagttatcaatagtttattaatatattgattaaaagatgacaagttctcaacccccacgatagcccactggtgaagacagaaccatgcagacactattaattyggctctgtttctttttctaatgagccagtgtggagactggggaagaggaagggattgtttggaaagatcagagcatccaggagaaactgtatggggatgggggcaccactgactgaatcagagcctccagtttgctktgggtgaccacagagggactgaacaaacmcctgtgttgtcagtccttagttttgagaatagccttgaccagcacacttgttcactgaggaaggatacgaaaatgcagataagttaaaacaaacaaacaccgtcattcttactctggcagccagatgagtcaccaacacattaaattctttatagatctctataccttcctttatgtaaatgtgtataatatgctcacaaaaataagatcataatatacatactgttttttcaacctgcttttttttttttttttttttttttgagacggagtttcactcttattgcccaggctagagtgtaatggcgcgatctcggctcaccgcaacctccgcttcccaggttcaagcgattctcctgcctcagcctcccaagtagctgggattacaggcatgtgccacaatgcctggctaatttttgtttttgtatttgtatttggttttttttcaatagagacggggtttcttaatgtaggtcaggctggttttgaaatctttaccttaggtcatgcacttgcctaggacttccaaactgctggaattgatgatggacgcttggattttcaggtcttctggttggtttgtagcatacaacgctatcatatgattaggtgagatggatgggacgataggatttgatgttcgtgacccgtctgtatggacggactggagtgtatttgacgggaagctgtaaaccgggtccggatatgaaggagttggagggcattggatgttgtttagatacagtaatatggtgctcggtgagattcgtgatagcgtatctgaacgcgattctacattgatagggaattgatgtgtgaaaacggggtgggtttagggtaatggatagcgcaaggtggatagggtcgcgaataccggtgtgggtatttggtaaagagggtcccgttaggcgggcgttaaacatcgtacgttggatgtagaaaccgtaatatgcccatagcaaactcgggctcgagttatgtgaaaagatgaatgcgtgcaatggcaatattggattagatgcgctagggcagcttggataatcgctgataattcgaattactgaattagctcggagcgacggcttttcgcgacgattgtgagatatagttggctcggcggtgttgatggatcaaaggtgaagattgttgttgatacgtgcatatacgnnnnnnnnnnnnnnnnnnnntatgacacctacatccatccactctaccatatctactcaacttgaactataatcagaaaataaactgccaatctttataccctcacatcaatcctatcaactacacctctcttataacccagctatgtgccacagtaaatctccatcttactacccaccctcctacactatattcattactcgcttgagcgacacatgctatatattcaatgctctactattatgctgtgtcccatgaaggcaacagactttcatctccacctaccaagaaccccactacactaaccctacatgttgacgaaccccataccctcctcccgaaagattccgctaacttccctcagcggggttaggcacgtacacatcccggaagtgaggacgttatgttttgactcgagcgagttccattttataaagagacacggggctttgcaaccttatacgcgcctgtttcttgaattatccactaggttctcccctttctccgttctccgaagtgctctggcattacacggtgggctaccatgcccggcctaagcctgctcctcaaattaatatgttcaacacatttccaagccaaaatgacttgtaaaacgttgtacttagagattgtggctacgcttggtggctcacgcctgtaatcccagcactttgggaggctgaggcaggcagaccacgaggtcaggagttcgagaccagcctgggcaacatggtgaaaccctgtctcttctaaaaatacaaaaattagcctggcgtggtggcaggtgcctgtaatcccagctactcaggaggctgaggcaggagaattgcttgaacctgggaggcgggggttgcaatgagcccagattgcatcactgcactccagcctgggtgacagagcaagaatccagctagagaaaaaaaaaaaaaaaaaaaaaagtccttgygcattaatctgttctataggtgtttttagtggaacatttagtgggggtccagttcatccccaattataaatataattccactgagcatcctcaactttgtgcwcattcctaataatctgcaaggaatacatttatggaaggagaattactgtcttaaaagggggttggggtgggtatatattattaaagtttgcgataaaagtctttagttgcttgatgaaatggaggcagaagtttaatccctaaggacccttctaattccaaagttgtctgagtgccggattgtagctctgttgagcctgggtcttaagtctgagcgagcccttagttaccttcctctcccatcagcctgagccagagttagcctgaggtcccaaactatgagcaggagaatgtcaccctaggaatggcaactagaaagtttttaccccggatgccatgatgaggcactgccrtccactggagcttgctgtgattatggaaatgttctctatctgcacatccagtatgataagcactgaccacatctggctgctgaggacttgagatgtggctggtgtgaccgaataactgggattttaaatcttatttaattttaatagccacatgtggctagtggctaacattttagacagctgttctaagagcatacctctgagactcaaatactcagatctttgccacattgttttatcttaaatatgacaattgataacattgctcatgctcagctgcttgcttcaaatgacatttatttccctcgctagttcttcaaaggtagggactaatcaccaaatctccaatgatagtctgatgccatccccaggtctgctacagcacaaaggggaccctcaatgaataagcatgtcaacatcaatcactttcctcaaagtttaactcagctatgatagatcatggcatatcygcaagccaagctactcatccaaaatatggagatcttgtaagttggagattgtgatgataatagtacctgtcccttagtattgttgtgaggattaaatataagaagagcacttaatattagtgcctagtgcagggtgagtctccagtgaatggggaccattactcttgcctccaacattgtagcaaggtcccctccacatagggataagcctgtcaagacccacgcctgttactcaaaatctcttttagggttatttaaatacgtggtcaagtattgcattaggagaaatggcttaagaacaagagaatgtcaaaccaaattgagttccccttattgtgtgctctcatgaagcacttaccacaatgataattatttgcagtagtattacctaatacctgcttttcccaccatgctataaacacaccagagcaagactgtttatcttgttcactgatgtattcccagtgctaaacatatagtaggtgtttaataaatcctgaatgatagattgaggatgagtgggtagtagatgggcaggaataaaggagctacgggaaaccctagcatagaaaaaaatagtaccagaacccctgaaatctagtcctgtttaggttcacagctaactatcggtccactgaaaagccctggttttggcttctctgttttataaagtgaaaaaggttgatccagattagggtttttcagcctcagaactatagacatttggggcagataattatgttgtgggaggccgtcctgtgcttataaaaggatgtttaatgcacctgtggctgtacccattagctaccagcagycctcctccsccagctgcgacaactaaaaatgtctccagaaaaatgttccaagcagggaaaactcccccgccgcaccccagttgagaaccactgatttagatcctgtctgaagtcccctctggcactgatagtctaagattcttcttgggaccataatttctgaacatgtgaattttctgacatttcatagatggttatagaattataagaatatttccagctactcacgcaaataactcagacctgattatcaatttaatatttggatcagtgggccattaaaatgctgatttgaaattcaattttccatttttaaaaatgatcactttgtgaattctgttagctggttgattttatttaaatggagtgtgtaatttttcccgctctgtgttcatgaataacgctttatagttgaatgtcagaatgcctgctaatgaccctaacaatcatagcttatttctagagaatccatacagtcattgaggctttgttttttttcatcttccactcktttccttggaataagacctttaattaatgctcattaagatgcacaaatagcctggccttgaatcctcccagtgtttggttcactctcccctaacttattaaagttgcttctggaagtyacatagagacgygcagttaattyctggaacagtgtgtttgtgcttctcattatgcaaaaaatatacaccttggtcaaaaaggaggtatatttttacacaactatttgttcataggacatgtatgcattaagcctcaacaaatgcgccaccctattggcaattatggaattcgagtctcacatcagagcaaatgtggtggtggcctagtaggactttcaatccccttccttggaaaactgccttagtaaggagttcagggattccaggaaatacaggaaagcctttgggatgtgtagtcccattcatatgaaatccacatttcccagaagaccacagaacttttgtgttccatgcagtgtccctagcactacaagctattatctccttaaatctctcaaccctatcaggcacatgctaacaggaccatgattttactatcaacaaaagggaggatgggcgcggtggctcacgcctggaatcccagcactttgggaggccgaggtgggtggatcacctgagatcaggagatggagaccatcctggctaacacagtgaaaccccgtctctactaaaaaaaaaaaaaaaaaaaaattacccgggcgtggtggcgggcacctgtagtcccagctactcgggaggctgaggcaggggaatggagtgaacccgggaggtggagcttgcagtgagccgagatcacgccacggcactccagcctgggctacagagcgagactctctctcagaaaaaaaaaaagaaaagggagcctccctagagaggtgttaagtaacctgcctgaagtcacagaaccagagtttgaattcgtctccccagatttctggaattgcagtcttttccagtgctacattgcccctagatttaggataaaatacaaatgacttatattttccacttaaaagaagcattccttagcatcaaactaaagttagttcaacatatattcctatcaaaataggttaagtttttttttttttaatttataagtgcttatgaacaggaaacgatgggagaatagcttactttcaatgactgctttgagcgtctaattttaatccatatattttctgtaggccactgtttgtagcttttagagtagatttccctctcttaaaagtaaactttgttttacttagaaaacacagwgaccttggagcatagtgattgttgtgtttttaaatttcattggtttaattgtcgtttaaaagtaaggttttttttgttgttgttggtttgtttgtttgttttttttattaggaaaacattctcttcatcacatagccctaaatcaatcaacatattttaagagaactgaaatggttttggggtaactttatttttgctattgtagtctttggaggaaataaatgcaaatgaaaaaatcagttaagatcagacgatggatgtattttttttttcacatcctttcctttataaggttaggaacaaacaaacttcctaggaactatcctaatatggattatcataatctatgtttttacaaaaatagtgccaaggaatggaaccaatttaaatggcttagagcatgagacttttaacgtaggactcaccttttggtggtagctaactgaaatgacatcagatctgtaaagaagtgtcccatcatttaagatttcttcagttacaacctaaaagaagccatatgtttgaagtgtgtgctttgtacattttatgtgaaaacatggtcccagcagtccatattatcttggaactatgcagactcccgaagccatgcctccttttcacagacgtaattattagactatgcatgccaattttaattctagaaaaacggtcactctaggtaatgttctttaagacaaacaaacaaaggctgcttaatccatgatgctgtagtcatttgttggcttgtttattttaatccccaatttacaacaaaatgtgttttttttttcttacagagaacmcacaatcctattaacagcgaacttctcttgaatgaaggcattacagcagatttaaatccatgcattacaattttagcaatttaatgaacatcctatttggcgacattattgctttaaaggaataaatcacaaacattttacttcccactagcactcggtatttcaaatccattttctctacagaatgatgtgtttaaataaattgtcctgttgactgaattttgatcacattattgggtatttgggatagaaatgtgtagacagagagtcagaagtcatcacatctactgaaggctttgcagccaagaaatgaggcctcaggcaagtcatttagtattaggggacttaatttcttctcagtccaaggcaggtgtttaattgcaacgtgtcccaacttgactaggggagtttgttcacagaatcaagcgaattcccatcctcaccctcacatttggatttgataagtctgcagaggggtccactggacctccttgctaacaagctgtgggtggctctagcctaggtgcccaggtgccccataaaggaaccactatgtggttaataccagaagtcccgtcaagttggaagcttctctaaccacatcttgggctgtagtacttgacaattggcttttcttcaataaagcaaaaataccctcagttatgtcatcattaaaatgtacatgagctagaatcttatgcctgcctggttctgtgagttcaaaataagagaaactcaggaaggttgagttgagcckcatgctgaaaagagggggagaagaggggatgacttggagccaggaaggcttgtgggacagagcttcttaacctggggtgttcacccttggtccctggatggacttgagggagtctctgaatgcctgaaatcacaggcaaagtgagtgtgtgtgtgcatgtgtgtgtgtatgtgtgtgtatttttctggaragggaaggaccacagtttgcatagatttcccatggagatgttgattgcaggttggtcagaaccatccttctaactaggtggtgatttggagcacaggcgtcgggcacagagaccctgacttagagcccatctcttctattaattagctgcacacagaagctggattcccctccaagcgtgctctacctgtggcaaagtgctattgtgggactmcttgggaacataggaaaagtgygcattgtctggtactcagtaattgctcaataaataccagctacatcctaacaaatattttatggaggtccttaaactgagcaagagcaattttacctgatgcattttgaaaggaagtgatgattaactaatccttcctgcctcctgctagtcacgccttacatcaccatattgtctctttctcctcatctggatctttcgctaaagactgacaaagaaagcttcctctgatggctctggtctccagctaaggccataaactgtgtattgttgaggctgcaggagaaggtggaagagtcataatgccaggttcagaccccttggtcttctgtctgccatgggtttgctgtgctctgctagggaaaataattcatcttttgaacccctctgggacatttctgtgagttttgttggatggtcatgtgtgttcactttatgatctccacgtgaaaggtgaagttcataactgccaccagtctctaagctttgtcctttaaagtctgcggacacttgaagccctctgttagtcatgccatgctgtgatcaaaaggattgtgtttaagaatgtatagtctaaatgcttattgtgatcactaacatttgtatagttctttggggtttaccaagtactttacytgtattttctcatttaatcttcacttaggactaaaaaagttagtaacactaatgggaatgagcgaaaaccaaattcagacagtattaaatacacaaaattataaagtaaaatgagactgatttcccacgtcatgaggaaaaatgtctctttactttgtgattctttttatcacatayttaaaggcatttgcatttttccttttctgaattttctgcttttagtttttcctcttgtwttagatgttcagtgtaactcaccaattgtggcagttttctgtttgattcacagtaaaaaagaataaaaaataaaaattaaaaaaaaactgtgacctgcattgtccacctgattaaaattagtttggatttttcagataaggttccttctttttattattataaacagactttatcttaagagtcggaagaaacatttaagggaactattcgtcttatttgtatttcaacctgataaaaggaaaagggatatagcaaaaatttttagtcgtttgagtgggaagtgctttatttgagataaacacaaaaggttttaagtatcgttgatattagtcaaacataatagcttttggctattgtctgaagagctcttgtctgttgacttgcagacctgtgacctctagataaagtttcaaaatgcagaaaatatttatcttcttgctatgaccttcyacgcacacgacgtgaagccatggatttgtttcctagggaactagtgagtgaggaagatctataattaaatctgtgagttatatgctacacatgggaattgggtacgcaccaagtcctttagaaaaatcccataatatcaccatagcctcaactggtggaattaaactcaatttttcttcacacatttttagaaagcatcattcagaatcttaatatgggaaagttcttgtgtttctttccaaagtcagggtgtgtttagtttggcttccatttcgctctggatccagtgtccctccctgatgggacggcacctgccattgctactcaggtgagtgctttatatggaagtcttggaaaagcgagtggtagtctagtctcagacatcagcacgtcagagctggaagggatccaaggcagtgtttggcaaaagttttttgatgttcaaaatgtgtccttcaaataaaatctaatttaaaaattcactgagtgaagcagacattaggygaattggttttgactagaagtaagggagaaagaaccttttcatcaccaccccaatcccaaaattccagagcaagaagtctctaaggcacccccgtttctcaacttgaacattaacatctaagccatagcactgattgtagagggggcagactgaggctcaagagatgttgccattggtcagccatctcatagcctctagaggttaaacacacacacacacacacacacacacacacacacacacacatacacacacacacaactagtaaaaaaaaaaaaagtcagaacaatgaatagctgtttccaaatctggcttgaatatattttgtagtaaatttccccatctagaggctcatgagggccaagatttctctacggtgcttttatttttcaccttttgaaaccaataatcagcctcttacattaactctaaaaagtaaaactctgtcgactctttgctttcaatgggattgtcctccccgtatcattcctcaaccaacagagggactctatgagagggaagcagaacctcaggactaccagagaagagatatttcacagataccaaggcttgacgtagatgtgaggccaggggcagggtgcggtggctcacacctgtaatcccagcactttgggaggctgaggtgggtggatcaactgaggtcaggatttcaagaccagcctggccaacatggtgaaacctctcctctactaaaaatacaaaaattacctgggcatggtggtgcacgcctgtagtcccagctactcaggaggctaaggcaggagaatcgtctgaacccaggaggcagacrttgcagtgagctgagatcatgccattgcactccagcctgagcaacagagcgagactccatctcaaaaaagcaaagatgtgagtccagggtgggtgttgatgaggacggtaataatacctgatgctttcgtagcagtccctgctccagactatatatacattagctcatttagtgtttgtgatgtctaagccgtgtgtgtgtgtgtgtgtgtgtgtgcgtgtgtgtgtgtagtagcagcttattttttttctatttctctttgattttttaaatacacacttataagtgtacatgtgtggtgtgtgggtatatatacactttcctctatctttctgatatacctatctatatatttatgatcttcccaccaacctggtaaggccgatactactactatccctattttatatataaagaaactgaggcacagaatcctaagggtcctacagctggtcgtggcagcactgagatttgtatccaagcagcctggcttccaagtctgtgctctttgctggtctacattcataccccatcttttatttttctttttgaagtatacgctatggggctttgagcaaaacttctgatgtgaaaaagaaataagaataataactccaaagatttttgctatgaggataaagcacctgacctactgcaccttgtaatttctggcaactaataatttctcagtaagtttctgtgttgctgtaaaaattgtcaaccatgtacacaaacagatctttaaaaaaaattgagacaaattaaagtgaaagacttcaaaatcagtttgtcacatttgatgctaaacgctrtattttctctgagaattttaaattgtgcaggtaatttctcaccacggtaagtcatgatttttcatacttgaacagtatcacttcatctaaggaattttccccagtgcagtacactcccacccatgcctctgaaaacgtctaatctgtttctcctacttacctgttggtccaattcatttctggaaatgttctgcaggttatcataacgagaacaggagtgatctatggaataaacaggcactgttgtttgaattaattaccaggaacagaatcataagtggtgacaacttacaacagctcattccacattctcctgccactgatggatagatttatgcatttgaaacrttttttactgattgcctgcccatctcctgttcacatactccctgagaacctctatgtcttatccatggagtatgtccgaaaaccaattatcatcccctttttgtttctgtattgtctaatggaagaaaagaaattataccttagaggagatattttcctgataaacagcatttagtcatttagtcattaaattagctcttttaaaattgtattatttttaaaggcatctttttattttattttattttattttattttattttattttattttattttattttattttattttatttgagacagaatctcactatgtcaccaggctggagtgcagtggcrtgatctcggatcactgcagccaacctccgcctcctgggttcaagcaattctcccgactcagcctcctgagtagctgggactacgggcacataccaccatgccaagctaatttttgtacttttagtagagatggggtttcaccatattggccaggagggtctcaatctcttgaccttttgatccacccgcctcggcctcccaaagtgctgggattacaggcctgagccacagcgcccggcctaatggcatcttagtcattcgacttttcgagacagccttatcagtagcctctgatgcttgaggttctcttgtgttgcttttygttgtcatagtatttttgttgttattgttttgtttttctttctttttgttatttgctttatgtttgtatttgtcgtacgttgtgtttaatctaccccttctctgcccaagactgtagtatgtcgtcaggrttgagaaccactgggttaaggagttacaaaaagttaaatttctcagggctaatgttgaattcttgcatcggatgagctcattgtaacttaggaaaatcaaaagcttgacttgaaagaatgagacaagtcaagctcttgtgagacaagccaactctttctcatgtggaggaagagttctgatggggagaaggagctgaagaagtggtgcccccattgaagcaggcagctgggatcccctgtgaaggtggtgaagggcagatgggagacggagatattttaatgaaaattgtaacctattttatgaataaaatttattttttattactgtaatttttttttttgagacggagtctcgctctgtcacccaggctggagtgcagtggtgtgatctcagctcactgcaacctgcacctcccgagttcaagtgatcctcccacctcagcctcctgagtagctgggactacagttgccygccaccacacacaactaatttttatgtttttagtagaaatggggtttcaccatgttggcctggctggtcttgaactcctggcctcrggtgatccacccacctcggcttcccagagtctggaattacaggcgtaagccaccacrcctggccccaaacaaaatttaatttaatccttacaacagtcactcaaaggaagaaggatatttgcattattagagcaccttcatgagcttgacatttttatgttgctctttgaatcctctcaaatgccagctgatttaggtttcatttttcccgtcatcagtgataaaaccatgacttgaggcaaaggtgactattcagaaccagggtttctgattctactgcctttttctactgcttggatacagcctggcctgaagcctcagggactttaggatgtagattggcaggggaaatcccaggcaggggtgttttttgatgggagaagctgtttgcaacccgcagctctggagtgactcagagagagaaatgactaatttctccattcagcaaaaatgcattgagctccagctacatgatgaggactgctgtaaattccgtggacacagcagtgaacagaacagaccaagccctgtcctasagtccacctgctagtaagggaacctgacaaatcaaaagttaataaaayacatggtgtgtcagttgctatgataggtcctgataggggctatggaggtcaatggctagagatgagagtaggttgcagttttcaacagggaggccctcagtgagaactgatgaactgggatgagtgcagggatgcatctatctgggggctgagcatcctcgataaaaggaactatgagtgcaaaagctgggggcagtagtgtgtccagaatattctagaaactgtaggaaggctggtatggctgaagcagagggagcaagggaatgttagataggagaaaagctgtgaccagatcacagaaggtcttggagcccaccatgaggactttggcctttattctaattgagtgggaaagccactggtgggctttggtgaagacagatgtgatctggcttatgtctttattgaatggctctggctgacggatggagaatagaatagagtgtggatggggcaagggtaggaacagctgcaatcactcaggctctagaagcaatgggggcttggcccagagcaatggtggtggaaggggagaggcgtggttatggccgtattctggatataatttgaaaagatttgtcgggggaagtgaggattttagctctgttttattgagtgtggttgcctgcaaaccaggctctgcgcctctctgaactgtcatgcattctttttgagtcctcttggtggttttgtaaagaagccagcctcgctgcccatctcccagaggggggaaactgaagctcagagacattcarggatttgcttaaagccccatgccaggcgttggccatggtcctggctcccaaacctgtcctttttctactgtaacaggctgcctcccctccaaagtctgcaggaaatttaagcctcctggaatttcttattgtatcagcatgaatattattaagtttcctataaactcaaattttgtgtatttaaaaagactatgaatctttctttttagaaattgaggtggttaggattaatgaccaaccataaaattttataagcaattattacggtttactgtaccttcttcagytgcttgtcgccttgccttcttttctttctcctgtagtcggggtgagttttcacatcactgacaaagatattgggctgggaagaggcacgcttggagtgagacccttcaggaagcctctgtttttaactttagctgtgacactgggmtctcagtcatggaagttcactgacatctactcatcctgcattagtaatatgggcatggtgcattttctgtatttattagctatgtttaacagaatctttagaaaggaactcratgccctgtttcaacaaagtacattgattttttgctttgtgatagataaggcaaaagcggtcactttgttcggtgtgtgctctcatcctaatttagggcccctttctgcctagaactctgtagattyccgccgtctgtgtttttccatcatcccagaccctcagctgcaagctcaggcctccagcccctcatgcacaactgctcctttagatcaggattactttgcccccagtctccctgggacttgctgcagatttatttcaaagttgtaaatcctctgtggattacctcctcatgctattctcaacctctggttctttctttttctgattgcccccartattaacaaagtggagcaaaaataactacagttgctggaaagtggtactgtgttagtcagaacacagaggttgtatgtgacagatacacgttcacatggctaaggctaaagggtattyattgactcccatagtcaggaaatccaaaggtgcatctggctttaggacagctggatccaggcctcacacagttgcactttgtactctccctttgcgtggtagcctgatcttctcctgccacagacacttggtcaaagaagctggtcacaagctgcatccttctagcactgtgaatattaaaggcaagaggaatcttccctctgagcctggtgtggtttggctgtgtccccacctaattctaaccttgaattgtagttcccataatccccacacgtcacgggagggacccaatgggaggtaattgaatcatgggggcggcttttctcatactgttctcatgatagtgagtaagtctcatgagatctgatggttttataagtgggagttcccctgcacaagctctcttgcctgcccccatgtaagacgtgactttgctcctcattcaccttccggcatgattgtgaggcctcccccaccatgtggaactgtgagtcaattaaacctctttcctttataaagtactaagtcttgggtatgtctttattagcagcgtgagaacagactaatacacacatctaacaagaataccccaaggagaatactgtttggtataacattgggcaaatgcccattgctgtagccatctctgaggccaaataaatgggttccgcttggctagaagtacatctcattatgagtggaagtgggggaatgtcatggcaccatgattgtggtacagctgattgtcatggggcaagtgggagggttgatgtaagaaggggttggaaagcctgctgggtaaacaaatctatagctactgtccttcaccatagttctaccaaagtcaaattgcatttatagcactggagtttcacttaaagggaatgcagcactggggacagaccctagtattttttccaattgtcctttattttcarttgccaccatgtcttgagcgcctgccctatgcccccatactgttctaggtacatatgatggcaaaatgatgaataacacattgactctgccctcacaaatgctgttcattaggatgggtcttcctaaattatagagactgatcaatttacatgccaccctttgatgctaactaagacaatggagaaatagccccaagtgytaatactctgtctcttgaattgagttatttttccaaggcagtaaaatgtgaagattgcaattagttaamcattatgaagacaaatcttcaaatatttttctcactgtggtgacatttaaaatgcttcctgctcarccaaacagccaattgatttctttcccatcttcttataatggctaattgctaagcaattgattgaatcctcttttgttactatgtaattactaagctggccaaaacgactctccckaccatttctcagttggctcattttggtcacctataggacaggtttggggtgggaatgttcttatttggttaaactttttgcaaataatcaatcaaattgctttatgtagtgattccgagcaaaggtccaactggcagaaaggcttacatattacttggatagtttcttaacctaaactttggtgaagtttttgttgttgttattgttgttgttttgtctttgatatggaaagaataagaacctgcctcctgaaattttgggaagggtcatacgagataatacattttcagtgtttagcaccactgggacagaataagcctgtaacaaatcacaagtgttaatagtttgtctaggcyacctctactgcatgcttatgggaacatggtcaacattgwtaacttttgtgcctcagtttcccaatctgtaaagggaggataatagagccactcatcatcaaataaattagagtttatttgatgattgtattagtcggggttctttagaaggacagaactaataggaaatatagatatatatatatatatatacatatatatatatacacacacacacacacacacacacacacacacacacatatatatatatatatacacacacacatatatatgaaggggagtttattaaatagtatcaactcacatgatcacaaggtcccacaataggccatctgcaagctgaggagcaagggagccagtccaagttccaaagctgaagaacttggagtttgatgttcgagggcaggaagcatccagcatgggcgaaagatgtaggctgggaggctaaaccagtctaggcttttcacgtttttctgcctgctttatattctagccatgctggcaactgattagatgatgcccacccagattaagggtgggtctgcctttcccagcccactgacacaaatgttcatctcctttggcatgatcctcacagacacacccaggatcaatactttgcatccttcagtccaatcaagttgaggctcagtattaaccaactcaatgataaaaagagagagcaaaagcatgtagaattgatatgacggttaaaggggatagttaaggcacctgaaggaccaagcccaccagcaatctgcacggatactcggtcactattttgttatttataccacctggcacagttcctrccttctaattcacactcaagcctcaagcaagagccrttcctttgcctccattcctcccagagattccccttcccatgctgaagccttggaaattattgtgaatgcaataatggtggccgcttctgtaaacacygtacttgaccttcatgcccacagtattcagcaggtaactacgtagtgtctgttgtgtgtcaggractgtgctgtggattcacttctgcagagagcagagggtagatgcagaataaagggtcttctcctgccttgagccgttcagagttgtggcctttggaagacttgctcagaatgatccagtgcttttttgacatttctggatatgatcactagctgcaatcttgcatttggtgctttttgtgattcccagctctccctccacatgctctgagaaaagtgatayccccagagctgtatccaaagaagaaatgtaaatccagaggctataaactaataggatctgagtttccgtggttgactgtatgaaagtagatttggcttctctgtgttgctgactttaacagggagcttaaaatgtgagatggagcaggtgtttgcgtgctgtrtcaccaagccgttcccatggctgtgaattccgggaagttgagggactatacagacactttatcttgtggtgacctgatgcatgcaccaggccactgttgcccaacaactgccccctaagtktgggtggaacggccattgcaatcgactcggggsgaacagtgcatctaaaagatgaaggtctgattttctttgcagagtttaaatggtgcatgtgtctttaccccaaaaaccacagaaacaatttctcttaaagagaaagagaggaactatgtacttgggctttgtatttggagattttggcaaagatggaggctgcccatcatgggtgacggtagaatctggtgtcagatggcacactcggagttgtctgactcacttggagagtacaagggcatctgcacctacaggcattgctgtgaatgacagaatcatcaacatccagggaaatgctatacttgaaaaaaaaaaaagatcagggtattagccgtggcagctatgtggcttctagatactgagccatcctagatgctagctctttacctgcatgatatcatgcaaatcttggaagcaagcctccaggtggattttattcctattttacagtggagggagctgagggctagagaggtttagtaatgtgttctctgacacatagattaaaaagtggctgagcaagaacttgaatcgcaagccctgcatgccagttgcgagcyccaaaccctacctcctggggagaagacacacattgtatttctcttctcttcatgggggttacagactccgttatttcagagcagaacctaggttctctataggatggggaggtataaggactcctttctatgcagtggaagcctgtgtggtctccctgagaccttttcccacaatctctgaatcccattcatttgtgcaagagtcaagttcaaaagcagagagcttgagagctcctgtcttcatcacattgttgacttatcgttacatctgctcttctaacttaaatcactggctccttttctttcttcctctgcatcttcaccaaggagtggtagaaaaagaattcaccttggcatagacaagcctagatttgattaacagctcttaaaaaaatcattccacctatttagtgttctgcttccttctctgtgaatagggctaacgatgcctatttagattatgaaaattaatataaaaacagaatagaagtccctagtaagttgcctgtcccaaagcagacacttaactaatgtcaagtctccctaaacgttgccctcatccccacaatacgaggagggaagagtccgaygttttcattagaaaagctgccacccacacacaggatgcttttctctacttctgagtgtttatagtttcagtgattctgtgccttacaattttcaaggacagctcgttccaacctttgcgaatatgaagaatggtttttctaaattatataatagtgtgacctacagatagccttgggctttcctttcttctggctgcagcctttgctaggtacacatagggacatgcaccctgacaatccacgggggccccctctggcctgggtcctcagaatgagaacctcagcttttaggactcacaatgcaaggatgatcacgcttgctgttagcagcgcagatccagcgtaattttaaaagcaaaatgactgactacatagaaagaaaaaccacattgttttcctgtctccccatggaatgctgcctccattagagaaaaaggagaaaacccgattaggaaggatagaaacataaatggaactgtgtcaggccttccaagctgtcactgattattctaccaggcagatatttctcacctcccattcagggccatctcctgtaacagccatttctatagccgaaacaataagggataaattaggctggtcaatttgtcctttccctttcttgggtraaaagaaaaygacttaactaaatcttttttctttaggatgaaaagagattttaaaaaacattctagtagcaaataactgtcctaaagtaggtaaaatgggaattgattttacttacctgacttcctagttgggtagttgggagcattacctgagacgggtctgtggcaacactttgtgacggccaggcctgggtggctattacggtcatcatcatttcaggaggcaaggtggcttcattatgcttcattcctacaatctcctttttgttcattgatgtgcattctcctgctttgacatacaaacccataacaccatgaaattttaaagcgaatggtaatattttttcatataggtaaaaaaagtatgagaatattccaatagaaataaccataaaacattctttctctttgtttgagtaacccctttcctgggtgtctatcctaaggaataatgtaaaatgtggagaattatttttttcagaggaagatgttctttgtagctttatttacatcattcacagtgtttataattaaaacagttgagagtccattatgattgaagtggttgttaaatgatggtatatctgtcttaaatattgcatagctaaacaaaaggagctggtaatgatagaagaaaatgctcatgatataatatgtgtattatagtctgttcttgcactgctataaagaaatacctgagatgaggtaatttataaagtaaagaggttgaattgactcatggttccacaggctgtccaggaagcagagtaagcagcttctgcttctgggatggcctcagggagctagcttccaagcatggcagaaggcaaagtgggagcaggtgtcttacagggcaggagcaggaccaagagagagatgggggaggtgcyatacagtttcaaacaaccagatctcctgagaactctatcacgagaatagcactaggagggtggtgctaaaccactaatgaggaaaccccccgccatgatcccatcacctcccaccaagccccctcctccaacattggggattacaattcgacatgagatttgggcaggcacacagatccaaaccatagcaatatgtaaagaatcaccctagcaacagtcatcaagatagcatgatacagcaggggagagatacatggatcagtggaagggaatagacaacccagagatacagccacacaaacgtgtccaactgcttcttagtaaagatgagaaaggaagtcagtggaggaaggatagatccttcagcaaatgatgctggagccattggacatctgaaggcaagaaatgaacctcaacctaaacctcactcttcatacaaaatttaactcaaagtggtccaggcccagtagctcacaactgtaatcccagcactttgggaggccgaggcaggcggatcacctgaggtcacaagttcgcaatcagcctggccaacatggtgaaaccgcgtctctactaaaaatacaaaaattagccaggcttggtggtgggcacctgtagtgccagctactcgggaggctgaagcaggagaatcacttgaacccgggaggcggaggttgcagtgagcctagaacacgccattgcgctccagcctgggcaacagagtgagattccatctcaaaaaagaaaaaaaaacaaaaacagaaaatgttaactcaaagtggatcacagatataaatgtaaaacactatgaaactttaagaaaaaagtaggaaaaaatcttagggatctaaggctaggcagagttcttatacttgtcacaaacaggtgtgaaccctaaaatgaaattttgataaattagactttatcaaaatttgaaacttttgctatgtgaaaaatcctgttaagagaatggaaagacaagctatagactaggagaaaatacttacaaaccacatatctgaaaaaggattagtatctaggatatagaaagaactctctaaactcaacagcagaaaaccccaatcaaccaaattaggaaattgacaaaagacataaacagacatttcagcaaaggggatatraggatagcaaataagctcatgaacaaatgttccaactcattagccatgagggaaatgcaaattaaaaccacaacagactaccggtacacacctattagaacagttaatttatttttaaaaagcagtaacatcaaatgctggcaaagatgtgcagaaaccatcactcagacattgctggtagaaatgtagagtggtacagccagtcaagaaacgagtttggcagttttgtataaaactagacacgcacttaccatggaacccagcaattgcactcctaggcgtttatcccagaaataaaaacttatgttcacacaaaacctgtacacaaatgttcatagcagcttgattcatatttgccagaaactgaaaacaacccagatgtccttcaacatgtgaatggttaaacaaactgtggtttattcatatcatgaaatatggctcagcaataaaatgaatgaattattgatacacagcaacttggaagaatctccagggaattatgctgaatgaaaatgctaatcccagaggttgcatactatatgattccatttatatgatattttctttgaaaatgttatgtttatttttaatgtttgtgggtgtatcataggtatatatatatatatatatgcatggggtacattagatacagacatccattgtgtaataatcacatcatggaaagccgggtatccatcccctccagcatttatcctttgtggtgcaaataatgcaattatgtgattttagttatttttaaatgtacaattgaattattattgactatggtcacctgttcaccccgttatgctctcaaatactgggttttattcattctttctaattttttgtatccattaaacaccccttcgtctcccctccccaccctcaattaaatgaaaaattatggaaatggagaacagatcagtggctgccagaatgtgtatctgtgagggaagaggcagtctctgcaagagaggaagatgtggttgtgaaatgacaacacgaaggatcccagtggggatggaatggccttgtatctcaatggtggtgatggatacgcaagccaatacgtagataaaactgcaaaaaactaaatacacacacacacactctcacacactcacacactcatatgctcacacactctgacacattcacacacacacacacacacacaaagtataagtaaaatggcaaatctgaataagatctgtggattgcataaatgtcaatattttaattgtgacattgtaccacagtttaacattagggaaactgggtaaaagagtattttttgcaaatgcatgtgcatctataattattgaaaaagtaataaaagtcaattaaaatatgtttatgcagttgtatgcatttaaaagactagaaaggatttatcgacattttagtatagttaactatccagtaggacattgagcatcttgctttctaccttttactttactttctctgccaggattttcctagtgagcatgtgttagttttgtaaagaggaaaaaaagcaaacctggttttaaaaaaaaaatcccattgccaagtacaacaatttacagcactctttttagtatattctgaaatagtctcctcatgatttctttctcttctgtactccaaatgtaacactaaatcacacacatgtmcacacacacacacacacacacacacacacaatcatgaccagctcaagaataaatatgtggggactaagcatccaaagctcgacaccaacaatttgcagstgaagacataatgaacttttgttagyggatggaccagctgggaagactgtaaagttggatgtcttgttgtgctttctatttattattcagatctcmagtccagtgtacagacagaaggtgcatcttgatggatagttcaaaagggtaaagacttagacaaaataatgagaaagggactatttggcgacatatttcatcctctccatcccactctgtggcttcctccctttgatgcacacataatttcaggaacccagagtgcaggattggtagaaacggaataaatatatagtctgttgtatgggaacaggctcagaagcctataaaagattcaactcctgctttcccttaggagaggtacccaaccagtattaatattttagaaatactggaaggtagaagaggagccattattcatcactggcaactctgtggtactaaaattaaataatggggttttttttaaagacagaattgtgaaagttgtgaaactataaaaaatattcctctcttggggatgttgcattttttgcttttatcttttcttcttctcttgagaacattttgatttactactgtgataagcttataacaactagggaacttgggagaaaagacgaggcaggctgggaggaggggtgttatggcagcttacaaatgggcccgggtacatttgcctggcttcaagtcagaaggtgctggarctgggcttggattcatttccattgtgtggcacacatatctcatgcatgggccagggacgtgccttgtgacagttagcacccacggtgccatgtgggcttgggatgtgagcatgcttgtctgctcagcaggaacttttcataaaaggtctagtcatccttttcctgaagcctggaaataatcagccctgctccttgaggagatgtctaagctgttaggactttgttatccaggagttggcatctgaccagcatctggagttttggattgatctggatgatttcagagtgttctgtacctgttcctccccctgaactagctgtgtaacccattggacaaatgacttcacctctctgggtctccttaactgcatttgtgaagttaaaaaaagcaatagaaaccaccaggtaaaatgcacacgtagctttagcacagtacgtggcctgcacaaggcctcagtgaatgcagttattacctaggatgccacttgaaaaacattttaaacccttttaatgataaaattactctccgtgactgttacatgttgtgtttcaatgcatactcatgagtgtcgttaacatttattgagtgcctactatgtgcctgccacggtacaatgtgctttagggatgcagttccattctgtcctcccgaggacctcaggaatgcaggtctattattcccaatcaacagaagggagaactgaggcttagaggggtgaaaagatttgcccaaggttaaaaccaagggcacattagagccagcgtacaaactgacccagaaatcattttctaaaccactgcaccacgggggcaggaatggtggctattgctcgggacctagagaaatgaaggcacagggaatgaagacgaatccttgctccacccatggggagacagtggctgggccagatttaagcagagatccctggacagcgcctcattccttacctgattcacacggtgctgatacgcttgttcagggctgcctcaagcttcagactcagagtcagaagggacctcagagtctrtgtggtgctgatggtctttgtaacgccttaacaggatgagggtgtgagcctgggcgctgggtggcagccttgtccatcaccagatgagcttagcaccgtcggccaagttttcaaccccaggaagcctgcctccttttgagctgaaatctgtccattccatagcttgcatcgattggcttttctgaaagttaagactaaaccagtctccttttctgctggtctttagatgatacccaaaactgtacctcgtgttccatgtctctaagcattcaaycacttactgggttgggctgtgctcatcttacacagaacagatctcctcacttttctctcaaatgttttcctccttagtcccctgtctacacgtagcctctatccatccctgtatccttgtgggttagaattcaccacacaacatgatctcattaggagtcatcacctacaaagcaggtattgggcaattgtgtttacccagggtcgttttggggaatattagtaaccgaaacttgagaggaacttaaatctacatataccacccaccaaagacttgcatggatggtgcagtttccgaaaaactttgccaaagcatttattgactcacagctactatgatcttctcttgttgagcttcccttagggaaaacaacaacaacaacatattttaggtagccagagcttcagaggaagagagatattcatccaagttgatctcattgtatccatgagcctgttaattttcagggagcaagattctctagtcttaaaaatgtgtgtgtgtgtgtktgtgtgtgtgtgtgtgtgtgtgtgtgtgtgtgtgtgtgttattgggatcttttaactaggagaatcactcagaatgactctgttggaggataccagaatatctcttggaactcaagcccaagaagcagaactggtccttaccagaagttggcaagccattttgaaaccagggtagctgtgcctgttcattgatttatgcattcattttccttttttcctgaccatatggtctctcatttcagcttgtcttagcatagcttctttatttattaaaaaatatttgagtttctactatggaccatgcactgttcacagcagagaacaaaatgaaaattcctgctagcacagtttatatttaaatggtaaatagagacaacagatataaatatgtcaggaagtatgtcaggtactgagggttcggtgaagaaaaataagacaaggatgatgctggaaggaaargcactactttctttcaataaggtggccagggaagtcctctgcaaagagatgagtataaattgagatttctgtagcaacaatgtaatgagccacaggagacccatgtggtaaggtcctggcgaattcaagccattaccagacaccactgggaaagggggctgggatacttcagtgtcagagcataatttgggaccaaggctgaggaataagattgagtaacgttggcygggcacggtggctcacgcctgtaatcccagcactttgggaggctgaggcgggcaggtcacgaggtcaggagatcgagaccatcccggctaacatggtgaaaccccgtctctaataaaaaaaaattaaaaaaaaaaaaaacacaaaaaattagccgggcgtggtagcgggtgcctgtagtcccagctacttgggaggctgagacaagaatggcgtgaacccggaaggcagagcttccagtgagctgagatcacgcaactgcactccagcctaggcaacagagcgagactctgtctcaaaaataaataaaaaagattgagtaatgtcagagaagattatttaccagctgtagggtggtgtcaccatgtttgagcctgcatgggattcatttacacaagcattaagaactctatttcagttttccctgtaggctgttttctttgccaaggtctctgctaatggccccatagtgtcccctgaaaatggcggactcgactttcaagctggtaagacttcaaaggtcctcagtctctccctgtcccaatcccaggcttccgaaagaaatgatcttgccaggctcagctttggataggacrctctgggtcacaaagggcagcccgggactgacatagtgctaggcccaagcatggcgcttttggggaaaacggctgcaaaataggatgaggggatgtggacaaactcagcaaaagttgatgctgaagacagaggcagggatatggctataaagagccttgctttcctgaggggacttgaatttttcytgaaatcaatggggtggggggccctggaaagattttaatcagggcatgatccaattggaagagacagtagcggcttcacagagtgagaaacctcaaagctgtctacacatccttccaatgaaggcacatgcaaggcagaacagaatgtcaggatttcggatgaaaatcatggaaattttatttatttttgatactatttacatttccaggcatcagtcttcatgttaaaatttgtcctgaatgataagaataataagagtaagtgttaaaactctcagggaaagggcagtcaacgtgaatttccagccagaaagtcttcagttgttcatgttgattactagcaaatgggaatagtgccaggttcataatgctgattttattacattactttctctgaactcyggtttaaataagtgcgtaaatatttggtacagggagataaacattgagtacacatggacataaagacaggaaaaatagacactgaagactccagaggtggggagggatggggtagggcaagggctgaaaaacttccttttggggccaggtacagtggctcacgcctgtaatcccagtactttgggaggccaaggtgggaagatcacctgaggtcacaagttcgagaccagcctgaccaccatggagaaacccatctctactgaaaatacaaaattagccaggcatagtggtgcacgcctgtaatcttagctacttgggaggctgaggcaggagaattgcttgaacctggcaggtggaggttgtggtgagctgaggtcgcaccattgcactccagcctgggcaacaagagcaaaaccccgtctcaaaaaacaaacaaacaaaaacaccaaacaaacaaatttccttttgtgtactatgttcactatctgtgtgatgggataattagaagcccagacctcagagtcatgcaatatacccttgtaacaaacccacacatgtaccgccaaatctaaaataacatagtaaaataagatttaaaaataaggccaggtgtggtggctcacgcctgtaatcccagcactttcggaggccaaggcgggcggatcatgaggttaggagatcaagaccatcctggctaacatggtgaaaccccgtctctactaaaaatacaaaaaaattagccggctgtcgtggtgggtgcctgtagtcccagctacttgggaggctgaggcaggagaatggtgtgaacccgggaggcgccactgcattccagcctgggtgacagagtgagactccatctcaaaaaaaaaaaaaaaaaaaaagatttaaaaataaaaaataaagcaaaatctatacactaataaaaaaatttggtttaacctttccctgggaacagtaatggtctgaaatgatggaaagaagaattgaacaactccagggaagtgaagtttggcaagttagcaagagagtaagcatgtatagttcaacagcatccgagggcatgattaatttattgtccttttagatggcagaatgcacacraaacccttcaaattacaccattattatgacaaagctcagggggtgtgagaagttaaagatgttcctgccaagagtttgatgtacagaggaaacgggcaacccactggatacacataaatctggaaatcgagactttgaagtccctcgtcctggctctgccactgacatgggcctgagatgaatgttcctgggccatgaatggccatgtcacacggagttccgattgggagctcttccatcagtgtcgggctcaatgccttgttgggtctactgggttgagtgctcctacccaactcaggacacgcttatctgttgcccctatgaagtatgggtcaagaccatgggctctgggggatttggttccaatccaaaatctttatctagcagactttggcaaggtttgtgggactcagtttcctcctctgtaaaacagattattaccaatacctacctcatagaattgttgtgcctgtaaaatgctaagaatagcatgtgccggagtcagtgttcagtaaatggtagcagctgtcattgtcatcatcaccatcattttaaactgttgagcatatttatgtacctaagcatttcctatgtctcaggtcattcactcaccatgagcctttccattattttcyattgtgcagaagacaggagtgaggctcagagaggccacacagctttctataagtccacgttgtccgtgagccctgaactgggatgcagatgcgtttttatgtgtctctaaaccctgctctgctaaatactgtgtgtgttaatcaggataggttaggctttggtgacaagaaaccccaaatttcagttgatcaaaaaaacaaaagcttgattaagctccatgccctcagaaggttaggtgggaactgtgttcctcattgtcattgtcctttctttgggacccaggtccatgaagtcactacaatttggaacattgctggtcaccatgaggaaggaaaagggaatgtatctaggcacactagagttcctaatgctttcgcccacaattaactgaagtgacacatatcactttcacttacacttcactagctaaagcaagtcccatggccacatccaggtccaaatggccaaggaagaacactgctgtgtgcccagaaggataggagcccacaggggctgaggcagccaccatgattactttctgataccataaatctgatctgtgaatagaagagatgggaggtacaggagatccagggttttcaccagagattccaggagccaccttgacttamagcagaacaaccaaaggcaaagccaaggagagtgttttcaaagggctcagtgatcaggagagtgaarcacacagcatgcattaagaaatcagaaattcagaaagagacacttacaaatacctagttattcactgggacaataagggatgtaaaattatggtactgattggcaattaggggggtttgggcccagcaaataaaatgcaatgattgaatgacccaaagatgactcctcctcctccaatctgctgaggcatctttcagcgcatctcccatgttatgtaaaatgaggttcatagagtttattgagcagtgatccgttgaaggccatgagtactctggaagtcagaaatgatcaataagtattttgaatggaagaaaagaagttgaggggagataatatgttacaagaaatggtgcccaagaggaaaaccttttttttttttttttttgagacaaagtcttgctctgttgccaggctggagtgcagtgacgtgatctcggctcactgcaacctctacctcctgatttcaagcaattcccctgcctcagcctcccaagtagctgggactacaagtgtgcaccaccacacccagttaattttttgtattttactagagacggggtttcattatgttggccaggatggtctctatctcctgaccttgtgatccacccgtctcggcatcccaaagtgttaggattayaggtgtgagccacggtgccctgccaaaggaaaacatcttattcaaaatcatgagagagaaactgaccatgaggctgagcgaatgtcagtgtaggttgggatatattattaacaggcatagactgagctcttacagtgagaacagccttgtgctggttacatatttcattacggggtggsctggtgtgctttgggaaggacaggcatgaaagggtgactcatacrtggcctatgggtcctatgaggaaatttacctcaaccaggggaggaggactttcggcagcttttcccttctctctctgtctgcttcttaatatcacaaccatcttctcaaaaacaaacacaagtactgattgcytacgaagccctctggccgtgatttctctgacaatctcagaattcacctaagacttccctctgyaccatctcatgctatcttcatcttcatctcatgaaggttcatattgcagcttctcatgcacatctcatgtccccaggccaaggggctgggcatgagatccactgcacacctcctccagtgtcacccatgacgtgctgcaatggcagatccctgaggagctgtgccctggatctcatgcccagctccaagatcagcatgccagccattctcacatgcacccgacagttttgtccttttaggaaaatgtcgagatacattcattcactagatgacaaatgtttgagkaatcactgtgtgccagaaactgggtttggctctgtgggataccagcgaatacaatcagacgtggccactgctcctaggaccacagagtctaatcagagagatggctcttaaaccacaagagttacataacatttcaacagttgtgttgtgtgggtgagctagaaaatttcaaaattatatactggaggaatttgacttggggggacccattattttctccaatcaagagaccaaggacactgaccagagtrtttttctttacagagcctcctagtgcctacaattcacaaaagggccttgaccttctctgtgcattcaaacacagtaggttaaacaaacaaacacattaagggaggactggataaaatcacctgtactcagactaaaatacttcggaatgtgacagatctggaaagcaacatawaagcaaggacatagaggatctgaatagtttaatcagttaatactagaaaagatagataaatatggaactatgtggcctacaaagagaaaatactattttttttaattgtggtaaaatgtacatggcagtggcattaagtmcatccacattattgtgcaaccatcatccccatccatctccagaacgttttcatcttcctcaccttaaactctatacccattaaatgctaactccccattcactgcctctggaatcctctgttgcactttctgtctctattaatgttacaactccaggtgcctcttgtaagtggaatcagacaatatctgttcttctgtaactggcttatttcatttagcataatgtcctcaaagttcatttgtgttgcaataggtatcagcatctccttccttttaaagtctaaatagtatttctttatatttacacacatgtagacacatacaatctttacatatgtacacatataggtacacatacacttttttaaatccattcatctgttgatggacacctgagttgttcccacattttggctattgtgagaaatcctacagaatgcttattctttccgtgtgtctatgggtcacttagtaaagatgatattgcacctggccaataataagttttaaaataacattcaaaggtagaactgttattagccacattagtatataattatttggaaaaaaataaaacccctgcaaatacttagaaattaacaaatactctccttaaaaaaaaaaaaaaaagactgaagcctagtgaaaataaccagaaaaaagggcacactctcagaaaataatgcaaaaaacccaacaatgaacattgacttccttagagctcagtttaagttagacttaagcataatcttaagagtctgctatataagaaggaaaccagactggcaaaatgaccactaaaagatgaaggatctggatggtagattcagatcccctcattgtgtgttgctggagttttatttttcttcccaagtgctccatcttgcctgtaaccttagcgccttccctgggatgatgggagctccatttgaccttggtgatgaacacagacagccctagstggcgtgagcacygctgrttgataaggtgggtgtggagcttctgtccttctcagtggattgcgagaactttggctccatgtttcttcaccagggtatggggactcttggccatgagctttccttagttccctggctaatttatgacctagaggttgaacatggttgagcagcataagggtgagagaaaagcatggtactccagctacccagactgctgaatggctgtgtcttcaatttcaaaggcatggcaaggactaacccacagctgagaattaattaatgcttacagattaccttacagaagcaatctaatgataaaacacaaatgcctctgaacagctataggtaaaggcaacagtgtttttttttttcctatttaacgtagagtagaaaacatcttctaaattagcatatgcatgtaactccaataattcctcttacatgtttttaaaagttgtcttttcctgtgtaagtaatataggctcattttataaaactgaaaatattataaggtgaaggaaaaagtattacacctaccttcatcctctaaagaccagtgctgttcacatgtgatttgttcgctttggtagccaggaaggaaggtctaattatttcctagttttgcacccttgtgataataatgcatatgtatagttatcatcctctgaaaatgtgtcccttgattttctacatagaggaaaactaggcgcatcaatctggttggatgtgacagggaaagggtactagaatttatttatctagaagctgccttgcctcacaagcagtgttcacttggagggtctccatttaaagggacccctgcaaattataaggatagggagggtattaagtcccttttcaactcctaagcattaccactgcctgggaasttcactatggggatgttctgctgaacccctatcaactccagtgggggtggcagcaggttcaagatgccaaasaggagacctggagccagcgatgagacgaggggttttattggatgcttccatacaggggaatccagtggtggcaggctgaacaggagaaccacaaccacctgtaaarggcatgcagtttatatagcattttcagttagcaccctttccctaacatccttcacctggcaactttcattccacctatgagtcagggcctggatctgccgtccatgttccatgggacaggccaggggttcagatgttcctcatagacaaggaaggagcctccaggtcggccactcycagatttcctagcttggaacagacatccgggtgcatcctccacacagagtcattttcagggtatgcataagttattgctatcaggtgcatttaccatgcaggggaattgtaaaaagagaaataaaggtctgaaaatgtgtctccaggtaaagtggctgcattttccaagaaaaagaaaaaggaggtttgtatgacagaccttatttttaatttgtgagtttatgaagcattttataatcatataaaaacaggcaaataaagttgtacttcttcactcagagtgttaatcaagtgtcttctatgttccaagccctggraatgtgaaagagaataagaaagcaacagcctgagggacagttaccaccacccaccaagaggcaaggtgctcccctagctttaacagaccttgcaggcgaggagggctagagctcaggtggatgaggttaagtctgcatggagtgggcaggagaaagggtcaggggaaggttcagtgggtaagtaatcgccgtcaccaagtccaggaagatgagggcatccccagcagagtaggtgggggatggccatccagctaaagaaaggcacagctcagagggctgtgcctcatgctgggttgtggcttcggactggagaagcaggtggagacccatcaaagaagagctctgagattttaccctctggcagagggagccattgcaagttttcatggggtgttttttgtttgtttgtttgagacagagtctcgctctgtcatccaggctagagtgcagtggtgtgatcttggctcactgcaacctctgcctcccgggttcaagcgattctcctgcctcagcctcccgagtaactgggactataggcgcctgccaccacgcctagctagtttttgtattttcagtagagacggggtctcaccatgttggccaggctggtcttgaactcctgacctcaggtgatccaccttcctcaacctcccaaagtgctgggattatgagcatgagccactgtgccaggccgattgcaagttttcatatgggtactgccccagtcagatgtgggtttgcattttagaatgaccattctggttgcaattaggacaggagatgggataaaagagaaatcagaaacatggaggccagggaagagactacttaatattcatttacgtattcattatgcaatgtttatttaaaagcccaccacgtacggcatactgttctaggctctgaggacaaagcagacaaagtagctacttgagatctgggttaaggagcagaggatagaggttggcagagtgtgggaggaggacagtgacttgcagaacttggcaactctgtcattctgatacttcaaattcattttctatacaaggaaaaaagagtaaccgattaaagtgcaattcaagaaagtgagaacctacagggaagtaccaaaatatacaacgaaacgccacagtcacacatggcagtgggggatcctggattggattttggattaaaaaaaaaaaaaggttactagaggccgggcgtggtggctcatgcttctaatccgagcactttgggaggmcgaggcaggcagatcacaaggtcaggagattgagaccatcctggctaacacagtgaaaccctgtctctactaaaaatacaaaaattagctgggcgtggtggcacgcacctgtagtcccagctacttgggaggctgagtcaggagaattacttgaaaccaggaggcagaggttgcagtgagccaagatcacaccagtgcactccagcctgggtgacagagcaagattccatctcaaaaaaaaaaaaaaaaggtactagaaaaactgatgaaatctgaatacataaaatctggagtctagttaatagtcaagtatcagtgttaatttatcagttatgaccaatgttccatttttacgtaagatgtcaacattaggggaaattggatgaagrgtacatgggaactctgtagtatctttgtaatagttctgtaaatctaaaattaccacccgaagtttataaatgaatacacacatatacacatacaaacctcaacctcaaccacattgagtagaaataattgtataattcatatataatgaccttatttatgtaaaaccactcaaagctgctatatagtctatgagttcatatgtatgcaaatacattaaaaacacacaccacattgtatcattcattacagctgagaatagaggtaggcatgggactttgcaggggaactgaatggaacattggctttgtccatattgtgtcacatctgtaaaaggcataccgtgagaacacccttaaaatcaaatcaaggagtcactacctgctccaggcctcagtactccctgcccctgcccggatgcagaagacactggtcccagctatgcgacgcccacctcccccccccaaacagccagccaggaagtctctttacccaggtatgaggcaagactcctgtgtgctatttacatgcccttccagagtgttgacaccaggggctcatgttctttctcatccttagctattttttccattccaactcagaggacaagaaaaaaaaacatcccactgtgaaaagaagtgtggaattacaaagaataataggaagttctcgctaactgtgaagccctgctatggagtatataatgggccttaacagctgctgcaacagtcgagactcgtggcagggtttgctttggccagaggagtgcactggatttcttatatttcttgacattaaacaacaacaaagggctgcaggctcagctgctgcagctgtggagttcccaggagttgagcacagcataatcaaggtggtctggaaacacacttgatttgcatggagtggttttgaagcatggctgagtgtatccttgggttatggtcattgcatacctcccatcccccagttcgtgaagttggaatatgctggggtccctctgaaaacccagctaggcaccaagaagccagagaggtggtgggtaattcagaagggcttgagcttcctcctggatctaaactaagccaagacactgagctttcccctgaagagggactttccccactccactttcatgctttcctcgccaagcttcctccaagccatggggtgcctttaacacacgtagagatgttgcatctagtgactttaagaaaaaccaactctgctttctgaggtcttagaaacaggtttttaaaagacttcctgttagtgttatatgtttaaaataggtctagaaagaaggtggcaaacagacccagcctatttttagcagagggctccaaacagtagcggtggaaaccagcatcagtgatactcaacagggatggtgctgaaagctgcccaaagcagtggtcttcaaacttgggtatgcgtgagaatcacctggggaggggggattgttaaagctcagattgccagcaattctccccctaccctgatttctgatacaagaggcttgggggaagcctgggaatttgcgtttttaatgagttcccagtgatgctgatactgttccagtgaatcatatcttgagaccaattagtctagagaaagcaaggcccctactggaagtgacacccaccatttccctgtgctggtggtcccatagggcctctcactctgggaacaccattcttggctgtgggtgtttcttcaaagtgaacatagctctgaggagcaggaggcaggttcarcagccacatccttaagaacataaaaagttgaagagagacagaagagagacagacgtgtgcagtgckaagctggggccctcacaatggggactggcttctttcctggggaataagtaatttcaattcagcagcaggagccaactcagctaggtcctgcctctaagacctttgtgtctgtaccaccaagtggctcaagctctctgagagagggcaagaaaatgactgagacccacccttggcagcagaagggaaagtcaccctgggataatttctgggtctagaattcagctttctgtgccgagtggcaggcagagaaacgggagggtggtgatgtttgtyccaagaggcccattcccccaccccctccttgtttcttctagaaggtctgggtgctgtgttcccaactttttctgagcagagaagggtcaagaaaagataactaacagcccrgaaggcttttcctggcaggtcttcaccagcggggcctgtgtctggcagatagatgggtcagagaagcccattcttgggaagcatgattgcttcatagctcttgtagaattcccatgttcgttgctcrtcagaatgcattgtatgttaatagaatcttcaaaaaggacctgctcatctcaggtgtgcttaggagaacaagaggaaggagttttaatccatatttgggcaaaggtggtaatgagaggtgaagccagctggacttcctgggtggagtggggacttgcagaacttttcttagaagaggatggtaaaatgcaccaatcagcactctgtagctaggattgtaaaatgcaccaatcagtgctctgtagctacctagaggtttgtaaaatgcaccaatcagtgctctgtaaaaacgcaccaatctgcactctgtggctykctagaggtttgtaaaatggaccaatcagcactctgtaaagtgggccaatcagcactctgtaaaatagaccaatcagcaggacatgggtggggacaaataagggaataaaagctggccacccccaaggcagcagcgacaacctgctcggatccccttccacaccgtggaagctttgttctttcgctcttcacagtaaatactgctgctggcagagaggggtgaagcaataatgaccrcagtgacagagaagaggtgagtgtgcttggtgaccccttcccacgcagggagctgtttccagagcacttctcttctgggaggcctgtgaattttgttattaaaaaggaaacctaggccggacgtggtggctcacacctgtaatcccagcactttgggaggctgaggcgggtggatcacatcaagtcaggagttcgagattagcgtggccaacatggggaaaacccatctctactaaaaatataaaaattagccaggcatggtggcgtgtgcctgtagttccacctacttagggggctgaggtgggagaatcacttgaacctgggaggcggaggttgcagtgagccgaaattgcaccactgcattccagcctgggtgacagagtgagactctgtctcaaaaaaaaaaaaaaaaaaaaaaagaggaaaccacctattccctcagaaaaggatagagataccattcttacccattaacaacagtgtaattttattgtgatgattaatattggaattattagctttgattaactgagctccttctgtgtggcaggacatgtactttatagatgccatctcattaaaccctcggcaatgctgggaagtaagtggtgtcatctgcactttaaagatgaggcgatggaccgtgttcatactcacacagtggatcactgggaaagctaggattgcaacatatagctgtctaatccgtggagttcattctcgctacttgccagccacagggatccaatggtgagcccagtaagctgtggctcttgacctcatggggcttccaggcagcaagtagaggggtcagtggaaaagtatcagttggattaatcaagtcaagcaatgactgaaaattattttcatcagagagtatcaaacacctctttttttttttttttttttttttttttttgagatggagtcttactctgtcactcaggctagagtgcagtggagcaatcccagctcactgcaacctatgcctcccagattcaagcgattctgctgcctcagcctccagagtaacagggattacaggtgtgcgccatcacgcccagctaaattttctgtagtttttgtagagacggagtttcaccatgttggccaggctggtcttgaattcctgacctcaagtgatccgcccaccttggcctctcaaagtgctgggattacaggcatgagccaccacgcccggcccacatagtttatttttaattttcttttgtatccaattttaacttactcttaaaaatacaaacatatgtaattggtgtttagtcaacactcagtgtattttaataaacaacattttttaatcggaaaaaaaaaaacctgtaatgccttgagtgatcctgccagatgaaccctggcgtaaagttcatgctgccttaggcaccattgccacctggtgtcagacatcggaattgcaggcttggcggcagctaaagtggcgggggtggtggggtggtggagcagggggcgcgcaggacccattttgattaggagagggcaggtttcctgtcttagccacctaaaccctccaggcgctgttgagtatgtgtcaacaggtgcctgttcgtttgtaatttggtgacagctagatctgtatcagctttcttttatctgtgtgtcctgaatgattattgtgttcatgrcctttcaattgttttgttataatcaaattaacgtttgaaggttctgatgataaagtgacataaatatagatgaatacttgagggtaaactctagattccacttatgccaataatagttctctttagttgcacatctacataaaaagaccmccccccatactttgaccccaactgcttctcagcctaaccctctacatgcttaagcatatgccagtaactcacgatttgcaaaactttccagactcttccttgtctgcctgctgcctttgtctgtgctgttccctctgcctggaactactctcctccacctttcccttccaaatttattcttcaaatgtcaaatcaaggtcgacaatttgtaggaaaattccataaagtaaattcagaaacgacagtgttgtatgttgtattgcagtgtctctagagaatggaagatgtggttctgaacccatttttatctctttcatagctttggccatggccagcttgctgactcattctatctcagtggtttcatccattaagtggaaataataatgtcctctgcctccagcattgaatatatatatatatatatatatatatatatatatatatatatatatatatataaatatatatatatatatacacaaccctaatttgaggtttatatataacatatatattttatttattatatatatttaatacatagggatttaatatatgtaatatttaatatatataatggggtttaatatatataatatgtagggtttaatatatatattaatatataatacataggggtttaatatatataatacataggggtttaatatatatattatatatcatatttaggggtttcacatatataaaacccctaaattgaggtatctatatataatattgatgcatatatatttaatatataggggtttgatatatataatatttaggggttatatacatattatatatataagccccctaaatagatgtgtgtatgtgtatatatgtgtatatatgtatatgtataaaccttttctgatgagacaaagtgcttcctctgcaccatgcctagtacctagtagaagtgacagggcaggtgacactggattagtggatatatgtaaatacctggaatcttgatcaatgcatgcgcagcaaatggcttccattaccttttttgttttgtttgcagataaatatttttttgaaaaaaatatatttcgtggagttaaaaataataaaatgtccaactttgactgaactggcattattgccctccttgatccatcactgtatgtcacccgagtgctggtaagcttcctcagctgccagctgcaaagacgtggatattaggatgaaaggcgttaggcagtgatgctatttctggtgctgttactttagtcaaatmtgtgttcaccaggtacccatgtgctggcacctgtgattagtgaattgctcatgggagtatgtttgcaatgtgctttctctgtgttttccaggcagttttaaatgtctctctgtttttctgactaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaagtgagtacccctctcccatgcccaccctgtgcgcagaaatgtggctttcaaagattgttttcttcccactgagctcattatttctgtgcctcatcaaacccgggactrcatggctttagggtgtttctgtgggagctgaagtggatggaattgaacmctgacagggcaacagtggggggtctttatctcatcagtagagccctccaggcctgcatcagactttgggtaccagagaccaagaagggagaccctgggggcatctcagaggaggtcagaacccttagggcaactttggctttccagagaccagcttgatgatctagagctggaagaggtataaaccccaagacctgatataattagcaagacatggtccttagggtgaaaacagttgctaaatattcagccataaaggagtagttaaattatggcagattttgcaaggcagttttctctagccatttaaaatgcttctgaagaagttgtgttatatgggagagattcaagatattgaatgaaaacaacatacagacacatrtggtatcctcattaccaatggagtatttgcacatatcatgaggtgtatatgtttaacaaaaatgataaagaaaaatcagtgggttaatggttgtatttggaagtgattgattgattgattgatttggttttcttacctacttaaatgcattattgtgagtttgaagtgagaagatactataagggcrttggaggcataaagtgctggacagacatagagcagtagcatgatggtaggtagtaaagtccccaccctccagcagaacccttactgggcaatgcrctcaagggtctcaggccctgggaggatgcgggtgctttccagatgtccatctcggaagccttgccaaagccttttctgagcatttgctgggggagtcacctgtcaatgagaactgaaacgtgagccatgagtcccaacttatactcaagggggaatcaggtagttgtataaattgaatgttggtgacctcagaaatacccagttccagctggccttgacagtaaccagaggtgacctggcagctattggggtccagctcctgtaggaacaaccagcagcagactatggatagatgccctcttgtctttctgtgcccatcatgggagtctccaagaaagttctggcacaaaaaactaaggaaagatacaataaatttcataatttcttarcagagtgatcaagagctgtgggatctgatatggtttrgctgtctccccartctcatcttgaattgtagctctgagaattcacacgtgtcatgggagggacccagtgggaggtaattgagtcatgggggtgagtctttctcgtgctgttctcgtgatagtgaataagtctcatgagatctgatggttttatgaatgggagttcccctgcacatgctttcttgcccaccgtgtaagaagtccccttgttcttcctccatcttctgccatgattgtgaggcctccccagccatgtggaactgtgagttcattaaatctctgwcctttrtaaattacccagtcccgggtatgtcttcattagcagcatgagaacggactaatacagcatctgagatcctccattcaggtctcagtgctgctgcgtactgagctgtgggaccttgagcaacactcttaccctccctgatcttgggattcttgtccataaagtatgattacagctaacgcttctgaggattataaaaaatgaaattactagtttttgctaactagtaattgctaaacagctaataaaacagagcttcggttgcagcttggagcttcccatacttttaaaaactgaggccatataatattacggtmgttaaaagcatggattctgcacacagccagattggctgcattcaaatcatggctatcatgtactaggtgtggaaacttgacaaattgtctgcctcaacttcttatcctggaaaatgggaaaaataataatgatgtcataggatttcataaggattaaatgagttaatacatatgaagcatttagaaaatgctggaaacatagtaagcatcatataatcttcctacatgggtgacaataatcaatgatattaaaggtgaaggaaggtaagtgaaaacccaaaggattccaagttatagcccaatctctcatgtccagcacaaactttccttgagtagtcttgagtttttactatacttttatagtctatgtcatagcatatggattgattgagcaattcattcattttacatacatttaattgagtgcttatagggtaagggacacgcttcaaggtgttcggaggatacagtagcaacaagayacactgggttccttgctttcatgtatcttttattctagttctttgtttcrgaataaactggcttgaattcctctcttctgtgtgtaggtgacatggcaggaagttgtgcctggtttgtaacatggcttgttgataacaccagcacagggtcatataccctcattggaaagggtactggtrtttagtsggaatgcagtttcttacacaagtacttgggttacttacgactggcagactggggcccagcccttggcagcgcactcttcaatgggctcatgagggcctactttctgatgccgtttccctccgtgcttcatgcacttcarttcggtcattgtcctgtttwcatcatacccgcactgaagcttcttacagttgctgaagcttcttccttgaagaagcaagtttgaggaagagccccgatcattctgcggttctttatttttagatgatgagaactgggttactctcatgttggtctactttgggcacaggaatgttgcaatttccgttcattccaagtgcctgtttaagaataagttactattttagtagtacagctagatccatggtattcatggtagtcaacacggttgggagcaaatgtggttcttcaaagaggagaatcctgggtctccaaatcctcacattttagtttctagtcttgcaagtttaaaaaggagagagccgggtgcagcacaccaacatggctcatgtatacatatgtaacaaacctgtacgttgtgcacatgtaccatagaacttaaagtgtaataataataaaaaataataaataaataaaaataaaaatagaaaaacagagcaagaaaaaaaaaagaaaaagaaaaaaaaaaaaggagagagcctgcaggtgaatgtgttgccatcataatagcgccaatgtttctgttgtttaaagttaagtgctrctcacatgcaagtacatgttgatgtattaacgttttccaaatccaacaagaaatattttgatctaaacctcagggatttgtatgataagaaataatctggaatacatttgtccttgggcccctgaaagtgcatcaccattgaagctcctgtttattgaacactgcatggcagatattatgctaaacactttgtataattctcttatttaatccatttcacacaagagacttaagaagtaggtgttaacaccatttcacagataagcaaatagctgttaaacaactttttcaaggtctcacagctggcatgtattggatttgggatccatatccatttcttttcagctccaaagccccacattttcaatcactaagaaacactcttcctattttatccccagctagattttatatctaatctgcaaattccttagctcctttcctaggaactctgcttaccggggctgggaagggagtttggctggctgggtgatctattactttttaaaaaccatccatttccgtgacccactgccatcttgccactcctccctgccccagcccccagaaaaacttccccagcttctgacccaaagtagcacctggcaaaataatttatctcttgcagtattggaagctgacatactaatgcaaagcctcctgaaatattactcattattatgcattttgccagcatttgagtgatatgtgaactcttcactggaataaagtactgtaaatgattcatgaatgaccaagtttatgaaattctataaaaatattagcaggtggtaatgattccctcacactgtgaatatgatctactggctgcaaatttgccaatatgggatgacgggagtggagtgggagaccatctgttaggcgagtgggggaggaagacggtgggggggcggttgggatgggctctgcaggaggtgcagggcaaaacaggaagsatggccaagaccatggtagcaggcaggtgtccttggcaggagaccttcacactgatctgttgtccagtgggagatgctcagataactgggaatgtcagagctgggtgggagaagagaggagcatatggaagaagaggcaaaactaactttattgagcatctattaagtgcccaagaattccctagatccctgacatacacagacctatgaaaatggttatcttgtcttcactgatgaattagatgagggctaaacaggttcccaagatgtatttttactattaatgttggggtgaacatgtcttgaacatttacagtgtgccaaggctccatgccaaatactcagatgatggtctcatctcatcttcataaagataaccttgatacgtctatcacactcaattctagaacaggtaactggaaccacctgtgttcctggcctcagaacatggaaaggacctcactgccaccttctgagtatttgctcacatttcatactatataacttgttcttttttgagccaatttcttggtcaagttttgaatttgtggtcaagaatgttgtcataaaattgaaatacaactggcattcagaggtatccttgctcatatattttcttttgttaatgtggctctaccccwattctaacccatctgtagctccatgacaatttggcagaatacacattaaagtgaaagctgctgccgtcatgcggaaataggtgtatcataatgtcagtgcttataagacgattgggagatatagatgtacccatattagagagttatttaagtgattaacctggttataaaaacgttcatgttatgaacaaatgatgcacatattaccttgatgggattgtactacacctgattagacttgtacttggaaaggaccccagccctcactagtagggacatgctatgtaagtcttctttgtcctctactctggtctmccccattgctacctttcttagccagggttcttggtggcagtcaacaaaatcacctccaactagtttacaaaggaagagatttattaaagagtacaggtagccagtaggattgcccaaagtgccaagtaacctagctgacaaggccagatgaggtggtgctacaggaaatacccacatatgaaactattctagggcaaggtttttcaacagtggcactattgaaatttgaggctgggtgattctttgttatgggggsctgtcctgtgaattgtaggaggcttagcagcaccaayggcctctacccactagatgccagtaccaccaccccccacccacacacacacctaatctggacaatcagawatgtctgctgatattgccagttgtcctataaggggcaaaattgcttccatttgagaaccactgttagagagaagtgtcatagtccattttgtactgctgtaacaaaatatcggagcctgggtatttataaagaagagaatcrtattggctgtcatttctagaggatggacaatccaaggtcaagacaccagtaggtttggtrtcttgtaaggccattctcttcttgcaatatggtgcctggcaccttgcaccctccagaagacaggaaggctgaattctcatatggcagaaagtggaagggccaaaagacagcacctattcctgaaagccttttaaattaaggcatcaaacctacccatgagggtggaacacgcatgctctaatcacctctaaagggccccacctcccagcaccattacattggctattacattacaacaagagttttggaggtgacaggcatttcaaccatagcaaagagtcaakgtcgctgctggctcttcctgccactttgctctgatgctcacaactggatgtggcagccctgcttgggttacctaaaagagccaggtgactttgccaagctcagaacctctgatctgcaaagcacagctgtggcctcccgccactcacttccatccagtctcacgctggtgcatctgcaggaagaacctagacygtaagcaggactctaggtgcaagagagctgggtcaacatagtttttagtttttccagctccctggtacaggaaagtccgcttgccagaggactggagtggtggttgtcatctaccacattgtgatgacatgagtgcwatttttttaattccatgggtttttggggaacaggtggygtttggttgcatgagtaagttctttagtggtggtttgtaagattttgctgcacccatcacacgagcagtatacactgaacccagtttgtagccttttattcctcattcccttcccactcttcccccttgccaagtccccaaagtccattgtatcattcttttgcctttgcatcctcacaacttagctcctaattatgagtgagaacatatgatgtttggttttccattcctgagttacttcacttagaataakagtcttcaatcccatccagattgttgcaartgccattaattcactccttttgackgctgagtactattctaccatatatatatgtatgtatacacacaccacagtttctttattcactcattgattgatgggcatttgggctggtttcatatttttgcaattgcgaattgagctgctataaacatgtgtgtgcaagtatctttttcgtataatgacttcttttcctctgtgtagatactcagtagtgggactgctggagtgcagttttattccaagtgagagcytgtcagtgagaagcttagttgcccaaaggcaggtaacaggctcacacctaggagagtgtgttctcaaacctgtgatcttcacttctgtcatcattatggtcctatcaatcaataacacacatgtgacctaagcaagagccctgagtgggacaaaacaaaggatttgggttaaaagcccaggctttggagccagacctacrgagggaagaatctcractctcctatcacgtgaaccatatgaaattgccattcttacaggtgaaaaagaggtgaacattggcaatttcatggttcattctaatactctgacacctttagccagttacttctcagcctctgttttctcatttttagaatgagagtgagattacagtatcatctcctaacagtgttatcrttagtgggtgtttatcactcagcccagtcacttagtaagtgttccggaattgggagccagcctgccacatatcggttttatagtttaagctccctgcaagtacaatggagttgaaagcacttgtgagggagcagctagcaggtaaacagttgaatgtcagtaactctctgtaaaagggaatcatctcactgggcagtttcaaactgtggccccagactaacagcgtcacctgggaacttgttagagatgtaaattgttaggtgctttcccaggcctgctggatcagaaactctcggggtgggtctctccatctgggttttagccagcccaccaggtcatcctgasgctcactgtagttggaggaacacaggtctaaataatcacactcttgggtattaacatcatggcagctgacctgatcactaattggccttgatgaagatgacctttgaacctgtttcgttacagttctggtggggtaacatgtgcctcaactgtgcttatttctcctggtgctccggtgtgccatttgaaagccctctccatccaattccaactcttccaaactgctttctttttgtttcattagtggcacctgagagccaggcaaatttgtcccaggcttccttgctgcatcctgcctagactttggatgactgttaaatgccatgttactgcgtgtttgcttgtttctcagccagagatgaagatgtcctcagaagattggagttggaacaggctgatgtaattccygataggggaaattagccttggggtcggcagaaccagctttatctgccttagtagatctgtgaccttgaacaaagcatttgtggttyttgaactttgttgcccttagaatcatctggggagctttgaaaaccctgaatgcccaagctgcactccaaaccaattaaatcaggatgtctcagagtgtgaccaggtgtcagtatgtttataaaattctccaagtttttccattgtgaagccaagtttgagaaactgttgtgttactataacttgtctgtaccccagttcgttcataattaggaattaatataatgataccaaccagctaggtgtgtgtttgaatatcaagcgagacaatgcaggggtttctaacacaaaataaaagtcaaagatctcatttctcccaactgcttcactctgagcaaacatctgaggctgctttctaatgcctccttggacacaaacacttaaaaataggaattctgagaaacagaatttaataaacaaacgcttgtcttctgagtgcttgtgaaaaaataattcgaggtttgttcacagcccctccctacccctgcacctctgatcacctccacctgactttttccagttcgtctcttcgtatttccaagcacttcattttattacaacccggccttatctgtcaggtgcagctggcgaaactgaggcatgaagaggttaaacgaccttgtggaggcagcyacatacctggattagactgctgagttgcttctgactgattatttatttggtccactaagcaaagctgcttcctcactcagggctatggaaacatatttttctctgaacttcattagcacaaactcctcagaagaggttcaacttgaatcttggcaggtgggagaaccccacrttccttaattttctcttctccacccccacactggtctttgcacctgyggcacctggcccacactcggtacttagcacacatccatggaatgaataaatgacaggatggctacccttttttttctgttttagttgtctaactacaaccaggtctacttcatcatgctgattcttcaaattacttggcggcattttctttcccaaggtgcggaagcatcgcaatacrttgggactgcaagagccttagacccattttgtccagcccagcagcccagcgaatttacagggaacaagttaaataacggggcaactgctcagactcccaggacttgagattccctggctatgacgagcattgtgagtgacactctgggaccagatccccaaatgcaggggcacggtgggggaccatccattccagctcccgccacccattagccatctatatgccttcagctatcagcataaagatatttatttttatttggtaaaaatgagaagggagaggaagaagaagtgcattagtggtgtggactggaagacagaggagcgaaasaggggatacggacaggttgtcctcctacgctgggaccctgaagtgtgttgaagacccttgggttcgagaacagaaaatgattgaagtcatgttttacgaaagactgcaagattgaaagtgaaggccagaagctaattaaattgatcacaaaygattgggtcagaacccggatgcaagcaccacagctatgggaacaggtggccaaggattacacagttggaaagagaggccccctctgacacctgtagcactgtggcatgggargtgctggtcttcaggggtgggtcaccgtggtgacatctcccgcagtggycctgataagggaggaggcagcagcagttggcacatggtatggaagctgacattgatcagggggcccttgtgaagccagccttgggcctcccaggaaatacctggggaataatgttgtgatgggggctgagttcctgtggagcaggttggaagctggtggtgcctatgatcagggaataaaggcaaatgtgtcccatgtcgtcatgcaatgctgggaagccagccaacctccgtgttacccatctcgattctggcctgcccactgcttcctgtttaattgaagcagatgcgtgactgctctggatatgaaatacggataacctgtgagcaaaacccccaggtaaaaagcacgtgggggagcatgctttttggccagctgagtcttctcttccagtctagagaagtggaggaaaacaggggagcatctggggaccatagagccagcgtccacgccaggcagtgcaractcggcagctccatcagaaagggattcagctcaacctgggggccgattcattcaaaggacattgatctggcacccaacttgtgttagccactatttcacagtgctggggatacagcagcaaacaaccaccaaatccctgcttcatggagctctgtcaatctacaggcattagtgagtatgtgacgatcaggtggccctaagtgctgggaatagacacggagccgayaaaagatatagggtggtgggagacactgcttggtccaggaaggccctcctgggaggggccgtgagaagggaggccagatggaaagtctcctgagggcaggaatgagtgctgtccttatctctcatgtacccctgacagcttttctcaaccatggatgcttcagtcccctagcagatgcctggcagtgtctgcatatgtttttagttgtcacaactggggctgttattgccatctggtgggtcaggcatgctgctccacatcctgctgtgcacaggacagtccccacacgtccgcagggccgtgctctgcaggctccttgcatggcgttggccactcagagggtctaaaattattgcatggtttgtttgctcagtattcatcaggtttggatagtcaagaagtctgtcttcatctctggggcaccagagatgaaggaagggacactatcactgttcttgtaaagtccacacgctagctggggcratgatttgcaacaatcgactrtattatcttgtgaggagggtcatgttacaggttcagccttcggaaggacatgaggtcaaagcaaattctcaagartgaggaatgacaggagacagagacgcggacggggcaggaagggttttgtgagaacagctgatggaagaaagcatttaatggcacctccagcggagtgcgtgcagtttagagcagacgagggtggggccatggcagggcttgactaggagcaaaggtgggactcgcatgctaaggagtgagcttagacatgatactcctgcggcgaaagggacaaatgrtggaggattttaggctgaaagtgacatgatcagatttggattttacagggactgatccggttgacatgcaggggatgaatgggagacagtgagttctgtctctgggtctttgaagccagagtgacacacatcagatagatgcagttttcacccaagaagacctgggtagtgaatgggattagtcyaaactcatagtgaagatattaaatataccttgggatgaaaagagtagcaggaatgyggacttgtgggaggagggcaggccataccgggcctcacagggcaggataaggtgcttggattttactctaaggaagcctcagcctcagagggttctcaggaagggagtgacatccaatttgcatttcaagaagataagatttatttgagcaagtcaacaataacattcaaattgtcatgaaatagaaattaattcaaaaatgcattcatttattgaggccccactaccaggcactggggaaaagagatcaaagagaaaactttgctttccctggagckctgccttcaagtttccctctacacatagcaaaccagaaaacctttattttttaattcacaagtagagggttggggagcattttatgcactgactcgttctccccatttagtctggcataatttccatgccaagtaaatattctctyttaaaattttaaattttgagggttttttttttcttctacgggggtttatcagtgggctctctcaaaatttattaaacacagttggccagagctgttagctgttgatttctttgattggtatctgttttaagatctttattatccagaaggcgtatcttttctcccagtgaggcattaggtagtaaaagagatcatttccgtatttttctttcttccaaaggtgcagatgtttgcataataggctcctttaagtaaaatccaccttttctggaatcatgttggaaagcctgcaggcccacgatgagggactatcttatattctttaactcaggaatcctcgttyctgtttctgcatgtgggaccaaactgagccatgttcagtgtgccagaccaaacactctgaagctggactagagtaatagcaaactggagagtcgcatcctcgttaaatgatggcttagcatgtaaaacattcgtgtgactggatwgtcagtgtttgacaataagatgctgggaggagagccctgtgctcttttgaaattgattgtgtcctccttcaatggatcattaatagttggggaatccacatttaaaaggggtagacccacagcagaggtcttggtcagaggtcagaaaggctgagaaaaatgggcagctggcatttcacaattagtcgtgaatgcrttttctattcctttcgagtttttattgcagaacctaatcatgaactccaccaaagtcacattagttcctgttcagtgtttcttatctcctgtgatgtgaggctctggtaattagcagggctgtttctgctcccaaataaaaaggagatatatttagaaaatggatgtgttaacccgggaaagcaggcacaggaagggctgcatgaagtatctttctcttggtgaggtaggctgcaagttgatgtggaagaagttctagatcatactgtgtgttccctgcctgaccacccccgcaagcctcttgactccctattcccaaatctggaattatttttagaaagctgtcccaggccggcacggtggctcacacctgtaatcccagcactttgggaggccgaggctggaagatcacctgaggtcaggagtttgagaccaacctggcaagagtggccaaaaccccatctctactaaaaacacaaaaattagctgggcgtggtggcaagcgcctgtagtcccagctacttgggaggctgaggcaggagaatcgtttgaacccaggaggtggaggtagtggtgagccaagatcatgccattgctctccagtctggtgacagagcgagactctgtctcaaagttatcccagaggatatcaaactgagaagacaagtatttcttgggaatgccacaatgtggatgacataattttgggtcagcccaggaaatcygggccctaagatagaaagaaaggaaaactgtgaattctgtatttggaatgtgaaccaagcatatgccgggagacatcctcgaaataccatttccattcagaatggttgctccctttgtccacatgccttcatcttcctcgggctctgaccttcgcccagctctctaaacttgagcaaatgctcagagcaagacctggtgctaggatcggaacagggaagacacatggaaatgaataaggtcacattctagataacttgcayatcacggccccatttttgtaataatccctttctccatcctccacccctatcctcacttccctcttctctatgaagaattcagtttaactgtgtaggttggatcatggcatgccggtaccctggggtgatggagagttgccttcctactgaaggtcagctactgaaagagcatctgtgcgttggcaaatctgctaggttcagggctctccgagggaatagataggagaaaaattttggattcacctttgattgtacttcctgatggagtcaggattggggtgaggagaattgcacgttaacaagcatagatygcacatggagtggctgtcctttgaggtagtgagtcccctcatggttgatgtgttmcagcaggagctggtgagcaccttcaggaagagcacagagggattgttactttatgtagttacattagaagtagggggtctgcaaactgtggcctgcaggcccactccattttcacccactcattgcatattgtctgtggcctcttccaccctgcagctgcagagttgaatagttgtcagagtgtggcctgcaaagccaaaaggacttactctgcccctctacagaaaaagcctgccaaccccggactagatgaaccctggtatgggttggatgtttgtcccctccacatcttatattgaaatgcgacccccagcactggaggtggggcctggtgggaggtgattgaatcatgggggtggacccctcctgaatggttcagtgtcatccccttggcgaccgagttcttgctcagctatttcacatgagatcaggatgtttataaaagaatgtgacacagaaacagaaaaccaaataccrcatgttctaacttataagtgggagctaaacaatgagaacacatggvcacaaggcgggcttttcagagggtagagggtaggagaagggagaggatcaggaaacataactaatgggtgctakgcttaatacctgattgatgaaataatgtttacaacaaacccccatgacacaagtttgcctgtgtaacaagcctgcccttgtacccttgaaattaaaagtgttttctttttttttttttttttttttaaaaaaaaaaaaaaaggctgggcacggtggctcatgcctgtaatctgagtgccttgggaagccragccgagcagatcacttgaggtcaggagttcaagaccaacctggccaacatggcgaagccctgtctctactaaaaaaacaaaaattagccaggcatgatggcgcatgcctgtaatcccagctactagggaggctgaggcaggagaatcgcttgaacctgggaggcagaagttgcagtgagccaagattgcgccagctgcactccagcctgggcaacagcaggactctgtctcaaaaaaygacaacaacaacaacaaacaaamaaamaaaaaaaaaagtgtggcacctcccttcccccacacactttgctcttgcctttgccatgttatacgcctgcatcccctttgccttccaccatgattgtaagtttcctgagtcctccccagaagctgagcagatgccagcatcatgyttcctatacagcctgcagaaccgtgaaccaattaaacctgtctcttttataaatgacccactctcgggtatttttttatagcaatgcaagaacaacctaacacaaaccctcatatttaggaattgatagctccagcccttttatatctaattttaagagcttttgagactatcgtagtttatgccttaaaggaagcttataagtttccccttttctgggtatttccaaggaaaggcaaaaatgtgtcaccctgaaatgatgctgatgttgtctgacctagagatgaactaagtccagtctgggacaggctccccagggagcattttcatggaggtcagtgtgaacccccttttccagattggyggcagggccagctttaggtcccttgagattgtctgcatcccacttcctaagtaaacaaaataatgactagaaaagtcttttcaggaaagggaaaatgtgcaaatwtacgagacaaaattgcttttctttcccagcagttttctcccttaggaccatttcacaggcctgagctaccctaggrgtctgttttgcccacaggctatgcgtgaagccgacccttaccctctcacccagtgacgaccacgacamtgttgatgatcataagcagtgcttgcaggcttggctagtccttcacagatgctacgtcaccagtccttgtgctgactcaacgagtaggtggctgtattagttttctatttctgcccaaacaaattactgcaggcttggtggcttaaaacaacacaatttttatcttacagttgtttaggtcagaagtccgacatggttctcactgggctaaaaccaagctgtgggcagagctggcttcttctggaagggagcatcattctccgaccttttccaactttygggggccacctgcattcttcagctcatgactgcttcctccatcctcaaagccagcaatggaagcagctcctttcacactgacatctttcctattctcccatccccagccctctttcctttataaggtcccttatgagtccattgggcccatctacataatccaggatcctttctttaatttaaatttatctagttcacaacattaatcttctttaccatgtaacctaacatagtcaaagtttccagacattaggaggtgggcatctctgggggccgctattctacctaccaccacactccttgtatagatgaggtaatggagagacagagtgggttaggaacttgttcaaggtcacacagtgctaagtgatggatgatcttaacctttgaccccagctattgtcatctttggaaagcagggatggataatgtggccagcacagtgtccaaggggttcccctcttctgctggcttcaaatagggtgacggccggaaggagaagtaactctggatgaacccccaggggcaaccctagattcttgctctgaaagctcataggcagtgtgtggcaacactggtgtctctgataggttttctttccagagtgggagtgccccagtcttttgcaaatcttccttttctcataaatgttacctaggtgctttgcggggatgattttcttcagaatgagtgagtgtcacaaaacagccggccacttgatttttattcctgtttggcacagtcctgggcacagagctcctttccattcgttgcttagcaagaagcaggccccaaataaccacctgccccaaggcccttttgtccactggagaggataggtgattagatggagggtaattgataacgcagggtcagtagggagagggaaaccccttgaggttggacctaggcagctccaagtccagattcctgctccagtgcaactgatgctaaacaacaacagctaggcttgactgagcaccgctggggttcaggtgtggcgtgagtgtgtttcctgaatgatcacttagaagttaagtctcccctgccatgccgggggcattgttctaggcacaagggattttagagtgaacaaaacacatttgtagccctacccccagcccctctggagcttatagtcctaaggaccttaaaggtaaagattgtttttgtccactttgcatgtggagaaactgagcttaggaaagtgtctggaaaaaggttacatggtagctgatagtgaaagaaccaaatgacaaacccacgtcctcccctccagagcccaagctccacacactgactctgttaactgcttggtttgggccgggcaccgtggctcacgcctgtaatcccagtgccttgggaggcctaagccagaggattgcttgaggccaggagttcaataccagcctgggcaacatagagattccatctctacaaagtaaacaaatagataaataaattagcacggtgtgatgttatgcacctataatcctagttacttgggaggctaaggtgggaggataacttgagcctgggagttcaaggctgcrgtgaactatgattacataactgcattccagcctgggtaacagagtgagacccagtctcaaaaaagtacatacacacatatataaacaaacacttaggtttgcagggaagcaccctccaatgcacaggtcagcccctgccccagagaatgacgcagstccgagtgccaatagtgtcactgcggagaagccccggtgtaaaatgaaaataataaaatccaccatagagcgttgctatgagttttgaaagccctatyatgtgagccttcatctaaccgaatcatgttttcactgactggattttcagctggaatcgtggcatgtcagggctctgcctagccgggccccactcctaccccgacccaaaatctgagaaatgaccagtaacacggttctagaggaatttgccaatgctcattttttattctatgtggtggtgtttttttttttttttttctcattgcagaagacarattctatttccttactcctgagggaaaactaattccagcaaaggccatttgtctttggtaccttaagatctagataatttactgcaagtttatttttattgaaaattatgtagataytattcagaaacacaattttcaactatacggcacacttaagcacgttatattttaagtgttaatacatagactgaggatatatgctagaatgtgcatttctcaaagacacttttttcttttttgtcactcactgcattcgaggtccttaaacttgtgtgctatgaagtgctaaaggattaaaatattttcaaatggatattgtgctgtaagttttgagttgttaccatttgactgcaattgaaactcatgatgctttatatagcttagatgattaattcagaaataatttgcatttaaatgcgtttaagatatttaacttatgattccaaatgtgcctattttaagcctggtagaagtactttagtctccaaagtatgyggacgctctacttctccctagtttgtggacctgaaaaggatttagatattaatatagaataacttttccaaactagttctgaaaacataagaactgagagatagccccctgcaacacacacgcacatgmacacacacacacacacacacacacacacacataggttttgtgctstcttgggagcatttaagatacwctgcaaactacaattgcttccttaaaatgtacagtggacgtttgacatagtaaagatattttgaagatttgmaggccagaaacctgtttaagccaacatattacacacttttaagaaagaaaagctcttaataacatcctataagaaaatcttaaccattatagaagttactctttgaataatattgtgagaaaaaatttaattagtgaaaccctaaggaagttatcagcatggagatttgtgatggatgccaatgtgccttcctaaaatgctgcaaggctattctggaaaaacagttctggagacagattctggcattaactatctctgttaacatagtggtarctaggttcttcccacttctgcttgtttcagctaagtaaaatataagggagtccagtaattcatgaatggataaacaaattgtgatacatccttgcaatggaatattatacagccataaaaaggaatagagtaggttaagccatagaaacacaagttagatgagtggcaggggtgggaaggagggcctacttataggtctgggtttccctttgaagtcatggaaatgttttggaactagacagaggtggtgkttctacaacatcatgagtacactaaacatgactttaaaaaygtttcatatgtgagtttcacctcattttaaaaatcacagtrcacaaaaagaggtaagggaggccagagaaactggrcaggaaaacccaggtgtgaggaccaggaggaagagggtggggcagaggggacaaggcagattcgaggggatgttccgccacattcttcagggtggcatgggcagcttttatgtagatgraaacaattttaggaaattgcagcctaaagcggtgttcagtacacaagagaggccctcaagagaaggtcaccaagggaaggcagaagagcagcctctgcctgtctcagcaaagagctgagtgggcacccaccccatggtgatgctcacggtcacagcctagtgacccacacttgtgtctttgctgtcaagcagaagctagtgaccacgaaactaagcttaacttctggtgttctttacttgtgtaaaggatcgtaccttacatcgtagagaaggagtagaccaacactgtgtaatagacctctctgcaatgatagaagtgttccataactgcaccgtccaataaggaagccaaatagatagtagtccacgtggtgactattgagcatttgaactgcagctagtgcagctgtagaactgagttcttaattactgttttttaaatttaaatagctgcatttggctgatggccttactrttggaaagcataggttttgaatgtcacaggtgaaaactgtctttagcatcacgtgggcctatgttttaacaccaattttgcctctcccttgctatgtaatttgaggcaagttgtttaatcgtgaactttagttcctcatttgtagaaaggtagaaatgagagaatatgcttcctagagtcactgtcgagataaaatgaggtatagcatatgaagtacgtggaactgggcaamtaataaatacttgataaacattatttgtgtctttgggtattgwtaacttatatatgtcttatgcagtggtgctttgagaaaatgaggtacagagaggtgaagtaactatgctcacgtcacatagccagaaggcagagggctaggaatttaatcccagatgttctgatgccaaagcccatttgcttgctactgcactgggtttcccttggaatcctggttaccaaattcatctcagcctgtagcattagactgggactgaggagtggatctcatttttcctacaagttcgtccattaagtatgaactgttctggtctttgctgagatggtgtattagtccattttcatactgctatgaagaaatacctgagactgggtaattcatttaaaaaaaaaaagagagatttagtggacttaaagttccacatgtctggggaggcctcccaatcatggtggaaggaaggaacaaaggcacatcttacatggaggcaggcaagagagcgtgtgcaggggaactgccctttataaaaccatcagatcttctgagacttattcactatcacgagaacagcatgggaaagacccacccccatgattcaattacctcccaccaggtcactcccatgacatggggggattgtggagctacaattcaagatgagatttgggtcaggacacagccaaaccatatcagatgggatttcttgtaggacttgaaaccctggggaaacatgtggttgtgtgatggatttctatgtccatagtggtctttgtttcttacctaggttggttctgggtaggttctggactggattggcaggggagatcctggtctctttcatctcaggcacctraagtcaaatctttcagaaataacatttaaccggtacctccatatgtgtttttttgtttgtttgtttgtttgtttgttttagcgttgaacacttcttgttgaatgccttctttttcattctatatgaaaatatctccaagtcatggagaactttgtctggcatggacaagggcaagacagtcttcttctgtcctgatgttagttggaaggacacatcctattctcctcacctttgggctaagagcagagtttgggtttttaatgaaaattttgtcctgacgagagataagtcaaagtcaggcattgcaaagtgccttgcatgtgctgttactggcatctcagttacattctccatgggcgcttaagaagctaacactcactgttggtcaggggactgatgctctacttcctactctaaatatagcscctgtcttgtcacacttgctgtttaacagccttaccatgccattcttgagagaaataaagtgaggtttcattaatrtgagagatcaayagtagttcagttatragttatcactgcagagggagagcagcaggttcagctcctcaagttggaaataaaaaagatgaatgggaggaggaaatgaagttagtgatctaccgcctgggcactttgtcaagggtgcgtgaggagagaggggaaagccctttctaaacacagattatacaccaaaggcaattaataattgtttaatccttctggagagccatttgttgtggtgatattcacatgactgtctttaacaccatgacaccaggagggtcttayttcgccagccaccaagctggggrcatcatgctgggtaattgtctgcaggtgcatttaactgaaaacctttctctaagattctggagttcacagcacacaaagaaaataggcatagcatcattccagtctgtctactttctgtgactgaggtgatttttttctggagctaaayctgtcttttccacttgttctactctcattcactcactggctaattcaacagatacctacttggctcttactacctatcaatcactattcaaggcactcagtaacagcagtgaaccagagtttccaccctcagggaacttacagcagaagagcaggcaggtgatgagaaatgcccctgagtaaagttaaacaggaccaggaggatggggaatttgtggggggcaggggagctggaggaggtgcatgatattstagtctatacatgatgatcagagatggcctttctgaaagggagacatttaaacagagatctgatgaaagagaaggtcatgagctatacaaatatctgtaragagagaaagccccacaggtgtacagccagcaagatggtggaggatgcaggaggttgggtgcaggggaactgttgcaaatcgtagggccccagagtctgacaagctcaaggcaaatcctatggaaagatttttttcttttagctgctctgcctttgttggtgtacccctcatttcttttttcagcaggccgtgaccccttcttggcaaccctggaagtaggtgcaaagatccggaggtcaaagtgggcttagcatgtgtagggaacgtaggcctgggagggggtggatcactcagggccttggaaactttgcatggattctggcttctgagtgaaatgggaagcactgaaggttttggacagaggcaggatgtgttcagatatctctttcaccaggaatgctgtaaacagattggaggggaattcagtggaagtgaggagccaagctggaggttactgaaggaaaccaggtgagaaagaggagaacttggattagagagtgaggctagagtgcccatggccaaggtggaggtgataaaaagtggttggatttgcagtatgtcttgaaagaggcatcagaatttgctactggattaggtgcagtatgtgatgaaagagaggagggttkagggtagtgggaagattttttaaatatttcaacttttttaaattgtaaaaaaaaaaaaaacatgactttaaawttactgtcttaatccttttttttttttttttttttttttttgagaaacaaggtttcactgtgttgtccaagctggcttctaactcctgtgctcaagtgatcctcctgtctcagtcccccaagaagctgggcctacaggtgtggacctctgtgcctagcttcttaaccatttataagtatgcagtaaagtagcattaagtccactcacattgttgtgtgacaaatctccaggacctcttcatcttgcaatagtaaaactttatacccattaaacactaattctcttcccccaaccctctgatcttagcaaccatcttctcactttctggttctgtgatcttgactgctttagatactttgaatgtgtggattcatacagtatttktccttctatgactggcttatttcactttgcataatgcacttgaggttcatctatgtagtctcatatgacaggattttcttctttttcaagaatgcatcatagttcattgtgtggrtataccacattttctttttccattatccattcatctatcagtggacatttgggttgcttccacctcttgactattgtaaattacacttcactgggtatgcaagtatctctttcagatccttcttcaaattctttcagatatgtagccaggagtgagattgctagatcatatggtaattstctttagctttttgagaaacctccatgttgttttctgtaatgattgtgctattttatattctcaccaagtgtatacaagtgtgacaatttcttcatgtcttttcaatacttactctttctgtttacttgatagtggacattttaatggctttgtgcagtgacamctcattatggttttgatttgcatttcttttaggattagtgatgttcagcattttttcatatgctcattagccatttgtataacttctttggagaattgtctattcaggccccttgcccattttttaatcagtttatttggatttttgttggatkaagttggggaagttctttatatttttctggattttaaccccttatccgatatatrtcttgcaaagattttctcctatttagtaagttgcgttttcattctgttgattgtttcctttgatgagcrtaagtttttaagtttgatgtagtttcatttgcctagttttgcttttgttgtctgtgctttttgtgtcatatataagaaatcattgtaaaatccaatgtcctgaagctttcccattatgttttccactagcagttgtatagttktaggtctcacatttaggtctttaatccattttgagctgatttttrtatayggcatgaggtaagggtctaasttcagttttgcttgtggatattcagttttccaaacaccatttggggctgctcatttcccattgtgtagtcctggcacctttgtcaaaaataattcagccatatayrtaagggtttatttctaggttctctattctgtttcattgagctakatatttgtcttcatgtcaatacatacaattttgattaccattgctttgtagtatgtttctaaaacaggaagtacgaggactccaggactaagagattttgctctcttgaaccaaaagatggacagattgccatttactgaggtggcaatgactgagagacacaggtactctgaagaatataaggaattttcttgtgccrtatgaaagtgccgttagaaaaataggttggtcattttctgacatcaaaagattttttccccaaattgtctgagttgcagccaatataaacataggccaagtttttctaaatcacatgtgtttggagagggtggaatggctgtcagaatgggctgggcttatagggtgacatacagrtccaggcagagtgagccaaccaacatcacttgcaagattgaagaaggctcatggagttagatcagtggaagagaagatcctcatagaagaggcaaaattctctgtcttagggacaatggcaatacttgggaaaattcccagaaagtgatagttttagatgattgtcttcttggagaccgatgttggggaagactctgaggctgcttccagatgcagcaggatggagaatgactgtcagttggcaatgtccacctttggagacagacatatcagtcactttctcacttcccctgactcagctggattctcatcttctctggctcagaggggagtatcatcaagtacagstaacatctttgagcatataccatgtgtcaaaaactattcagcttttcttactctttataagaactcggtgaagtaggcactattattattttcatttgaatgttgaggaaactgcaggattgacaggttaagtagcttacctaagacatggtgagtaattggtacagccaggactggaaccctggccacttgactccagtgtccaggctattaaccaccataccgccaaagagtggcctcgtaccagggcctcgagctgcctggggcttcaggagcttctctcatctatggctgtactagtctgtttcacgctgctgataaaaacatacctgcgactgggtaatttataaagaaaatgaagtttaatgcacttacagttcctcatggctggagaggcctcacggtgatggtggaaggtgagaggcacatcttacatggcggcagggaagagagagaacttgtgcaggaaatttccctttataaaagcatcagatctcatgagacttattaactatcatgagaacagcacaggaaagacctacccccatgattcacttacctctctcacctggtctctcccacaacacatggtaattgtgggagctacatttcaagatgagatttgggtggggacacagccaaatcatatcaatggctaagactccatctctgtacagggggctgggagattcactkggcaatttttgttcctcttggcttcaaaggactcaatctaggatcatcacaaaatgtatttattgtccaaaactggagtgcttttgagagcaaaaaggactatgttaatatttaggctaggactacaaacataaaccagtcttgtccggagcaaactggaatatgaggtcattatacttatggtcagttagtaaatgagatcttagcctcagtgaaagtgaaattttactggaatgggcaacctattgaacacacactttatccagatggcttagatttggatcttttaaaagagtaacatcaccatttkaagtgttttcttcttcattaactatgaagccctttcccatatgggtttatcagcattgtaggaagggctttcatggaaccatataaattcatctctctagaaacgaagarttctaacgtccatcctcacttctgccaccaaaattagmaacatacatakrtgtcgagctttctgcttggtgaaggtgcagtgacccctctttttttcagcatccatttatttctgctygctgagctttctgtctgcattttcatctacagctctgttctttattgatagtgtttgttttagacttgtgagctccaagagggctgagactgcacactttaaatgggctttactgtgttggcacagcactttgcaaataaaggctttacaatttatttaacaaacatctagtgatggttactgtgtgtgaagcagtatacatagcacatggaagatactcaagggtatggcaaaaaggatttctatttcccataagtttatcagcagtaagaagtaacactgctaatgtctattatgtatagatgccatcttatctgtcagaaactgtgctcagtgtttaacatacattctctaagtctgtgccactgatcagtgtttctctaagtagttcccctggaacactagttcttgcaaactgttgatgaatgctatgtgtgtcattggtccccaacaccaccctcagatttggtgatttgctagaaagactcatggactctacatctagttgcatttgttgctaaggtttgttacagtgaaaagattccaagcaaaatcagcattaaaggcacataggcaatgaccaacagaaaccaggcaacagctttcaagcggagtcacacgggacacacttaattcccccagggagaaatagtgacaacgagtataaaatgctgtctaatgagggaagctcattagagacttactgcccagagtttttcctggaatctggtcacataggcaccctttgcctgataggttccaaatccctgacctccagaaggaaaaacggtgttcagcataagccatatctatttgtacggtttaggcacgttgagccactcttatcagagaatggtaggaaccttccccaaatcrtcattcccaaataccagccaagagccaaccttgcaggctggcctttctagggatagcagtcccacacttgctatgttggctcttttctggatagtatgcaaaaaaaaaaaaagtttcatattcagataattttgaaaaccttaatcaaccaattttaagctgctttctttacctctggactctaaattcccagacttatctggctctctgccaccccccactgtacatcttagaagatttttgctttgtagggaacaaccacaagaagttctcgtggggaaatgacatcagtcctattcaatgtagcatcaaatgctgagaaaatccatagcaggaaaggacagtttaaaaatttatgaattatcttttcctttacacttcagcattgacagataagtgttaaattgaaatactgtctcatactttgatcacasaagctaaggaaagcaagtgctgaagccgcactggcctcctttggaaagtaaaacccgagaactccatctaggcttcgagttaatagatgtggtggtctttacacacctgtagtcaaggggtcatctgttaagtaatcattagctttttcatttgaattgtaaattcaaattgtttctcaatgcagtagacttagattacataaggttagagcttaagctttgaaaagtaatttaaatttgttttcagcatgttaaagacttagtcaatttttttccttttattttagtttatttttatttttttcctgaggcagggtctcaccctgtcwcccaggctggagtgcaatggtgtgatcatggctcactgcagccaagacctccctggctcaaatgattctcccacctcagtcttctgagtagcccggactacaggcacgcaccaccatacccagcttgtattttttgtagagactaggtctttccatacagcccaggctggtcttamacttttgaactcaagctatccacctgccttggcctcccaaagagctgggattgcaggtgtgaaccactgcgcctggcccaaattcctatttcttgtttgaccaggatgtcttttgtcccaaccagaattagttcttatttattgttacagtcaagatttagaatagggttttattaattatatatttggactagaatttctttattctgcaagtgcattagttttggaatcactgataaaaaccaaaagttgatttccactaacwtttccaagagggagctttaaaaattcacctgtgggaaattttatgcaaaaacttgaacaagacatagtatttttctgttagcaaattataattttccccctgattcagggggggtctgtgattgttttcttccytggctgctccttccatttgcatttgcaaagatcacattcctaatcttyacctcatcagaagcctcattttgattttctgctttgctgacttctgtactccgagagattcactagctcttaatcctatcrttggcctggcattcttcctcttctctatacttttccatggttcattcatctccattttattccttctagaatgtatttttttagaagcaattaccaattcttattggtttgagctatgaaatatttcttctttggttgcatcttyagtgtggttttcttctgactgkcattgtcawtcamttgaacgggtgaaattaacctctgcctttgaggcccctatgtttactcttcgccggtgttgctgccagaagcttaaagctggatctaatcacttccttgctgaaaccattgatgcttctctgtcgacttcaagatgtgttcagttgggacattgccgtctgtttccttcttcmgttctcctttcccttctactccagtccttacaartgacatcttctgttcctgcatgctaaaatgcccgtgacttctctaatgcagctctctgccttggtgcctttgcgtatccatctctactgaggaactgggatgacttcagcatccggggtagatgcctggcatgaaccagaaaggatatcwgattagatctgtaggtgatggtgagaatggatacaggactgtttcagtcaagtacctacctctaaacaggagggcactgtggattttaggattggagatcattggtacctgtgccatcctggggaggtgggaagaaccagttcacagatctagttttgagcaaaggaacatggggttttagcaggtcatttagtgtaagcccactagaaggaggcatgtggtgtggggtccaggacaggctgtgagtacatgttctgcaccagacataatttacwtggaggcttggggagaataagcttccaggtgaggaactcagtggctgagttgcaaagagctggaaatgagagaagcaarcttaatgactwtgtacgtgcttcagtttagtgcatatcccactcttgtgtcctaatccagttatttttatttctgctgaactctgtacatcctgaggatgaagcccatgctgtcaccacttttttttttaattaacagtgtctgttaaacatgcatgtgattcagaattagatatcactccccaccctcatgaaatcmtctttaaatacttgatttattatttattttccactagaatacttctggatttttcatgaagcctgagggaaaatgagaagttattatctacatcatttttcactgttttaatgttaatcattgatacrggaattggctttcaccatcttggagtccaccccacctataattaattataaatcctttcaktggacaaaccaataacacttctatattgaaccaggaaccagagagcctaaatgcatcccctggatatcatctagtgagtcagaggcacagaacaaaatgtgcttccaaaggacagatgattcttcaaagagagctactgttctttaaatgtcacccatgtgttagagccttttgttccgctctgtttctgcacgctccatttctgaagtccaggaagccccaggctgttgagtggaaagagtagaaaggcgagagtgagaaggcaagatgaatctggaggggaagattcatgttttctgatttctgagggtccctcctgatcagcggggtgctaatgaratcagagacaggggatgtgaacaccacgggaacctgctggctttcttccactcacagcrccagaatgttcccaccagctgggacaaagcacagggagagcatcaaggaggggatgaaaaaagagatcaggaaggaagagaatagtgtgcatgagctcacgcgtgggtgagaagaaggagaaacagaggcaggggggtacataaaaatcctaccctctagctatgtccttcaggagcgggtctatctgttgttgtttgctacttttcctatgctcttgggagcttatcagaaacttcccctagatcagcagccgcaaatcagcagcaggaagccctgtcacatgcaggtgtcattgtatcatcataaaaattacttcccagggttagtaacttaaaatgaaagtcaggctcaagggtcatcaggtagttagtagatcaagaagatttctacaatgtagtacatctcttttctcttggcttctgtgatactaagtttcctggttccgtttctgtctctcagaatacttttcccctaaaggtgtaaagttctctccttcatgtacttctctttcatgarcttctctccttctaatcttaactgagccttctccaagttccttccctatctcattatcttccatttctcattatgttccctcacaatcttaaccacacccgtagcttcacccatcactttctgcaggaaattgcctgtctaccacagaactctcccctggaatttagtgtaggcaattgtccacttgaatcatcctcaaatgtgatgtgatgtgatcttccccttggtgcatatccaaactgaactcaacacttaactcgtgccctgaattttggcaaggaagttatcaccagctttcactctttgartgcataacctttcactctgtttcttrtactcagggactgtagtgtgtgttgcagtctcttatctgactctcagaaataactttgagtagagcagtactactaaaacacaaattcaccaacttttctctgctggaccttcatgtcgttctccctgagtgagtcccttttgcaagttattaatatatgtcacacagagcctgtttctcatatttattgaccagactaaggagagaacatcgtaccctctaacccagtggttggcrcgcttgagccagctcataccagctytcgtgagaccgttgttaatgtctctttctcactctgtcttcactgtagcttgatatcagccatggcaggattgtcttcaccatggcaatgggcaacaccaaggattgtcttacttcttcacagagctggtggttaagttacagcagataactgccccaccacacccattatgtcctgtgcagttatcgatgatattaactttctctgcttgaggcactctgataaaacttcactgatttatctcatttaatcccaatagctacttcatgagaaaggtgccatcattctatctgttttacaggtaaggcaaatggrcactcagagaggtaagatctgacaccgtgtgtctgagagcaggtccatgccatcgaagtagatttgtagcagaaacctggctgggggtatttttccccatattagggatatctctgtctccaattcatgtccattctaagacaatgctactggtaactgtgatggatcagactttgcacgtttttctttcttggaacaaacaggatttggaagctttgacgttggtgttacagatcatttaccaaaaaaactgctcataagacaggcccagttttctgtttggatgatagcttctcatgatggtcctcatgtgttaattgaataatatttgaactttaaattctttctacaaatgtttgactaacaatctccccaaaatagccctattggtaaccaaccaagtagttgtttcattgcaataggagtgtaatgagagacaacagatcctaagttaatgagttatccaagacctttagttgcaaatcctttagccaaatgaccatacccatgggtgtcagagcaacagtaattgtgaattattgctatgtttaaaataaaacaattttggtctagattagattttgtttataaacctgaataaatattcagattgccactatcagaaaaaaaactcattgacccaatgagcattcaaaaaagtcatttttcctcctttttactttttcattcattaatttaatattcaaagaacacctgatttatgccagccaccgttccaagtgttgagattagagggatgaagaatataggcaagatcttagctttcacggttcacattctagttagggaagataggataaaaaataaataaaaccagaatttcggggcgtgatgagccctagggaaaggaagtgatagcagaagtatgcagtcagaggctctgctgaaacagagctgacaaggtgtttgagcagagaagcgagcgttcataaggaaccagccatgcagaggtatgcactgagacgcacccagtcgagggaacagtttggagactccagcaaccttggagtaatcaagaaatagagagttggtcgtggtggtagaagtgaaataagggagataggattgtttagtgaataaatccaagaggaaagcaggacccagatgatacagagtctcagaggttatgagttgggatttattctaagtgcacataggaagcactgtagaattccaggcaggatacagaytttcccatctgtgcttaggagtctaagctgcactctttctttcttcaagtgatatgggagtgacttaaattctttgttgcaaaaccagtgacactgttatgcaaacatgaagtattgaactatatggaagtatttatctgtttaaacaytgggggaagagacttttaaaatatggtttatatkctcggtggttcggtaaaggtttttctcctgctcctcatcccccagccaaccttctccaatatattcagccatggctgactttggaggataatgaaagccacaacccaggaacttcctgatggagatggaactgtttcacatcttgattgtatcctagttgggaagtcatttcatagatttgtaagatattgccattgggggaaaatgrgtaaagggtatataggatctctgggcactatttcttayaactgtgtgtgaatcaacaatgatctcaaaatagaaagtgtaatgagagaaaaagctctatttaagtgttttattaggtaccagacatcatgttaagtattttacatgaattatcacgytatccttacaagaaaattgtgagttctagcattgccccattttaaagagaaggcacctgaggctcttagaaattaagggatttgcacagttacccagctggtaagtggtgaggccagaatcattccagatggtctgtctccaaagctgagattcccaacctcagccctatgggacacatgtctgttctgtcctcattctgatgggtccaatctggaggtgactgaatcctgaatgtcaggaggcagcagagggtggggycagttctagagaaggcacatcacctgtctctcctgcaggatggtctgtggccattggcgtaggccttcgttgacaagccaagcctctgacatctgaatagctacgctgagaaaggtagaccttgtctttccaccttgggaatcacagtctgatggcaggcaggggctttgtgccatcaggcaacccaaaatcagggtaccctgcaaagtcacctggcagaggtagcagggctgggtccacctagaggcagggaacattcttcttcacacaaagaggccttcccctcaccaagctgagctttttaaaagtttaatctatagcccctgagggagtgcctctttctaatccctacaaagacccttataggtcagcagtgtcctgtattgactgatccccgggatgcattggatttttaagctccgagattatcccagcttttacctcttttttaaataaatatatatatatagtatatatgtatatatgtatatatatattatacacacacacacacacacacatatatatgtatatatatatatatatatctttaagttactgtgctaggcatgcctggaagtctccccacccctaatgcatttttattttaagatttgactggcattttttagattctcttgatgtgtttgctacatcttttttttcttttttttttcatttttatttatttatttttattatactttaagttttagggtacatgtgcatctttaggcaagaatttattaggatgttatggttaatataatcatggccataacttcctaatgaatgcaaatggggaaaataagattttattaaccaaagatggtgaccttaaaaccattatatcttccttgtgcttatggagaacattttaggagcacgcctattcttaaagtgaattccgttatctttcctcatgctaagaatggaagggggcttaggctgagccaagtsacatgttgcaagcagttgtatgatgtcaccaagtgctggccgttggtgtctcagccacagtgggaagctcagcacatggattaagggccaacctggggcgaaggtgattaccttcttagaagacacttggtggagatgtttttgagtgtcatgactagggaggagtgcgcctgacttctaatgtgtaggaatgctgctcagtatcctaccgttcacagcacagcctgccccccaccccaataaggaatttcctagccccaaaaatccataccatcaagaataagcgtacagagttaacatcatgggactcctgagtcagagcaacttgttttcaaatcctacctgtgtccttggatggttgaccttaattaactttctgaacctctgtgtcctctcttctaaagtgtgtctcatcattatacctattttatagggtactaagagaattgaggtattgcgtgccaaacccttagcacagcacctggcacagagtaagtactcaataaatagtggagattgtaactcttactaatctggtggtggtgtcctcctcaaagtaaaataacaaggcaaaggcttcaaatcaagctgcatttkaaaagttgcattttttggtatcaaagtcctccaagatggatttatttttctattttatgattccgtaaaaggcttcctataagacttgtttgttgggggtgggactccctctctggtgctgctagggcggggtacctgacattagtcgcacctgcagtggattcgacacattaaacctcagagcattgcgtgagtgtggctctagaaagccgcctcaactgcccaggtttcttagcgatcagtcatcttgatcaaagtaagaagcagccagtgtccaaggcaaaatctgtgtggtcgtgttgagagaaccaggcayattcgccacaagatacctgtgccttctgccattaagcaggtctgacaacgtgaaagctggctgagctgagggagttgatgagctgtcaacctcaggggctgctcagcccttcgggggtgctttgcaagcctggttgccctccaggtgtcattttgctaggggttgacagagcaggctactgcccttctgcaaatactcttaagatcatgtgagttaatacacaggacrtgcttagacaggggctggcactgttctcagtgttctgttagcaattattaccattattttcacttagatttgtcattatgtacacacagctgcctgtggacatgtgcaggcacatccatrtaatatattaatataattaggaaagtgggggcattcagtactttctaggtatacacatgaacagacacacaaatatacataggacgtgcagatgtaatgggatttaatgttcccaaactcttgcagtcataaccgtctgcccagagtyaatcttagatagagagccagcaccgtgaggccaagagaatgtcttgctcctggatctggctggtgttcctgagagaaggacaagacgccgcagtgttcctttgacccaaagatggaagcaagacagataacactccgaagtgtggtagcaagccaagcaccctggagttaggggcttaaatccaggcatcaggtggttatgagtcctgtgaccctgtgcaaattagcctccccacctggggattgggaaccacagcgaagtcacggagctgctgtatggtgcataagaaagcgtatagctcactgcttagcatcatgatcgttccttaaaatgagattcagggctcatggtgccaaggtcctcttggaagcctcatgcacagagtgtcttcagacctaagattgaggaacctgtttgagaaagtttcaggtgttcttcctcaccaccatcaccatgagcaaaatggattattcactggccatatttctcctttttacctcagccaacaaggcacgcaggatcaaatgtgtggttctaccmtaatgactctatggacaggatcccctgtggctggcatgctgtcaccatctcctcctccttttcttttttctctgatccttgtttttatctgcttgtacttctgccttattgtgcttagttgtgcaagccaccgcaaatccagtatggattgatgtggggtataaataaatttttaaaaagttgaaccttgaatctgttcaataattctccaggattttgcttagctttactgtgctgcttccaatttcagactccctagctttgcctattggctgactgtaaccataaagataactgattcctgtaccaagcctaataagatcaattaaattmcttgtaaaaatggtcyctactaggggaaatgctagatgagatgctaaaactcatctgtctaaaaacaagagacaagctctttcttggattttttctttttctytttctttctttctttctttctttctttctttctttctttctttctttctttctttctttcttttttgcagctgatcagtgctcctcatgcattttgaagcttctttgcccaaggtgtctgtgacagatggctcgtgaagcagcaggaatgcacaaaacctctgctattatttttaataaaaaaatactgactctagaataaattgactattgaaaaggctgagaattcagtccttgaaactaattgtgccaagtatgggcacattataacttctccagcatggactatgtggccatgatggtaggcttggcaattaaaaagacaagkggagagatgccccaaactgccgggcctcstgctccatcctccaggtttgaactacggctggttgcaaggagtgtatttgtgcttgcattagaaaattaggaacrcctgcagaaaatggctttcccacasataaaagactattaagtctcttaaatgctggaaaatgtcttcatgagcatattcagtgatttggcacttactccacatgagaacgtccctaccatgatgtccastaaagaatgggctacgtgtcccgcaracttgattacctccctgctccagcttggctctttctacaarggctgtgctggcccaaacatcaatgtctcatttaacttttgaaaatcgtcctcttggcatctagacctgttgttttcctggcctgctaggataaatacggaattctagggtgacttttattatgctcttttcaatattggtaataaagtggcactatgctgtggataggactgggttcacatcccaactctgccttttcctgattgagctgctgagtaactcttctgcctcctgatttgcaaaataaggatactggcttttaattcctaaggtggttctgaagatgacatgagacaatgkcagtaaaatacctagcactaagcttggcacatagtwggcatagaaaaggaggagttggcagcttgattatggtcaaatctaagaagatttgatgcagacccaacttcctagggccactgaggattaaataggtatatataaattagctcaataaaagtgattatttttttcttgagacagggtctcattttgtcacccaggctgaagtacagtggcaccatctttgctcactgcagccttgacttcctgagctcaagtgagcctcccacattagccttccaagtagttgggactacaggcgtgtgccaccatgaccagctactgttgtactttttgtagagatgggattttgccatgttgcccaggctggtctgaakctcttgagctcaagtgatctgcccacctcagcctcccaaagtgctgggattacgagcatgtaccactacacttggcccataagtgattytttaaaaataagtaaatatttacaagaaattaattccctgagatcgtcaggacccaaccttgtcttcattttaagtattgtcagctcagagttctaatgaggctacaagagcattagagatagactttcaaaatattaaaagaaaaaatttcctaggcacctccaatgaaaaggatatgttccctgacctcaagaagtttccagtggccaggcacggtggctcacgcctgtaatcccagcactttgggaggctgaggcgggcgaatcacgaggtcaggagatggaggccatcctggctaacacggtgaaaccccgtctctactaaaatacaaaaaaaaaaaaaaaaaaaaattagccgggcatggtggcggctgcctgtagtcccagctacttgggaggctgaggcaggagaatggcatgaacccaggaggcggagcttgcagtgagccgagatcgcgccactgcactccagcctgggcgacggagcgagactccatctcaaaaaaaaaaaaaaaaaaaaaaatagttcccaggcccctgttagacttcatgctccctggctttccctctctcctacaaatattagaatttgttgctcgcctgctatatsttggggcctgcatgctgtgtgttgtgaggagggcaggcaaagctcattgcccttgggatttgttacctggcaagaaagcaaacactgaaccagtaatgataagtaatgactgattttgaaggaaccatacaggcacctaggaatacagaaagggatttccttcctgagttgggggatggaggaaggtttctttgaagaagtagcatttgagcctgcttcctcgagggtgagtaggagaaaagacagtagggcttcatggacaaagagacagaatatacacaggcgaagaggagagaaagcgacggtgagcttgaaaggttcaaagaagccgagacagctgcaactcaagtagaattcatcgtattttttttcttttactaaaaatagaatgacagaataagaaatttatataaggagtattcaagcagaccccaaaggccaaagttcatggatgaggtttcctctttcctctccgctcagcttttaggtttctttctttgtcccacccatcttcgttccctgatggtaggtccatgatgtagaaagtttacaaaagaaaatgtctcagggaaaggttcctccatgaatctgttaggaagaaaaactccagtgaggctgcacaccagcagcactaatcattttattttatttgtggctgtgtagtagtattgtgtggcgtatatgtaccaccttttctttatcgtgtctaccattgatgggcatttaagttgaatccatgtctttgctattgtgaatagtgctgcaatgaacatacatgtgcatgtgtctttataatagaatgatttatattcctttgtgtatatacccagtgatgggattgctgggttgaacgctatttgtatttttaggtctttgaggaatcgccatactatcttccacaatggttaaactcatttacacttccaccaacaatgtataagcagtcctttttctctaatacctcaccagcatctgttattttttgactttttaatattagtcattctaactggtgtgagatggtatctcaatgtggtattggtttgcatttctctaatgacactgatcattttgaagaatttattcttgcatactcttggttaaatgcataaagtgataaattaaactgagtctttataagcaagtataaattagtggttatttgggggctatttctgatttacacaataacgtatactaatcacattcattaagatgagtgaagaaattgatttagctggaaagcatagctctacagaggcatagccaaagtctggctatataaaaacatttttaccaccaatattttcaggcaaatgtgccaataaaaggtatattctatgtgaaattgcagcaccctattggaaatggcctgctttaacagtcctggttcctgcttattaagatgcaccttcttaatgtatgcaataaaaattagactcaaagatatctagtgatrtttagccagcttcagtgactggtctagaaataaaaagatatgccagtaaaacccgagtgttgcaaatactgttactgatgatgatcaagaagagaggaaggcactctgtgaaagattgggtacacagtgttctgtctgatatgtggcttttttggcatcaaatgtgcactgcggaccattggcacttttcagaggtggccaacacataggtgccagggacaattaacagagacgtggtggcaaactcattaacgcaagaagagaatctgccattcagagacattaatttaacatgacaccaacaggggtgtttgtatgtgcgcgttgtggtgtcagacattctgctctaattgagttaattaaaagttaatggcacagagcacatcgtgacgctataaataacaggcacgtgaccagtccttatactctcatttgaataaacctttagctcaccatcacattccacttctgaaggattcattccacatcactgcctctccttccacctttgaagagggtgagtgctattccatttgatacataaacaaaaggaattggaaaagataaaaggaggcttgtgtgctatgtcataaatatcacccatcattgccagccttgtacttaaacttcttgctgggaagggggaaaatgtgtcctcctagccagggctgtggtaggatgtggggagagcagggaacctcctgctgctcatggtggatgggaggccggctgagggggacagtcactaagaagatgagttggaagtaagattgatataaaccttatggatgggaaagctgttttcctctctgagcttcagtttctcatctgtgaagtggagctaatgagaatctggtatccacgtcattgaatgcttctcagcatgaaatgggagaaatctctaaaacacttgacacaatgttgggcacacagcgagtcttccataaaggttagatggtgctgcttggaaagtctgtctcctgagcgtggggagaacagcccctcaggtatggctgtacccacctccctttctcagcatccttgtttgggtggccagtggagttctcgacgttcgtttttaagtgttggtttggttgattacattatgttacaaatgcatccaaaaaaggaaatgtgcgacatagtacttacatagattacaggcagagaaacacttgaaaatcattcacttaagacaaagtcaatagaagacttctcagtctcaaatttttttttattttattattatacwgtaagttttagagtacatgtgcacaatgtgcaggttagttacataggtatacgtgattttgactgaggaaactcgcttcagtttgcttaaaactgaatgctgagccttctagccctgaggcaaagaggtatccatggcagcttacctacctttcatgtttccagcaccatgaaccacagcaccccttcaagtgaaagaagcaaacttctttgggggcctaaaatcatgggagaaattcagattgctcatcgtgcaaccaaatgaacatcattcttgagtgattctaacaattgaaagaggacaaaaatgcttcttacktggctctctcggaagaatttctggtaatagtcaaagatgaggactttcaaactttttggcaggttctcacagtatataatagtttttttttttgtaaccatgtacccccaatacacacacacacacacacacacacacacacacacacacacacacacacgctctctcaaaacaaagtttacaaataatacttagtctatgtggtgctttgtagtttctcttctactgtcgcttgttacttaaaatactggtcatgacctataaattgattttatgatctaaaaatgaattgtgaaacctggtttaaaaaatgctgatgcaagatgttaggtaagaacatatttctgcaaaaatacttaagtggagggacaggaatgagtggggctaggtgtccagtgttctggaaagaattaaattttttattagtatctatttctcatatttctccccagcacagtcagttckgcgtggcgcagccatcctaccaaggggagtctgwgggaaccaggacacttgattgctttttagctcagtcttcgmgggagtgctggagcaactctgtgcatcggaatcacccgggatcccagcaggtctgggagggactgagattctgctcycaggtgatgctgatactgctgctccccaaagtgcgttrggccatacactgaacagcaaaggaagagaaaaatgcaaagttggaaccttgtgtttcctggcctccaccgacagccccatccagtaatgcctcctttctccttcaagggcatcttattgtctcattactcacatttagagactgattatgtcatttagtaagccttcgaytgaatatttaaaagccacttggatgaagttaaaagtcagcaaagaatgtatttgaaaagcatgcatagctcatagctcctagaactgacagtgaaatggatgcaccaggtcttggggggcggccatgtatcgggggagctctgggctttggtagcaggaactggtggagatctttttatgtgaggccattggactgaagcagcatcccatgtcctttggcccttgcagtagaccctcacatttcagggaaaggatttaagaggccccttggctcacaggtccactcctcagccaaggagaacagggcatcttgactgacccaccaagactttgttatgacatagtgaccacggttcagtttccatgcaagggggcgtgcatgcggagtgggcagatacagccacagcacatgggttgctgaaaactaagtggctttgagaggaaggtaagtgcttttgctaaacaccaactctgtggaaagctcattaccgatacgttaacttcatcccctcgataagccagctgttctcaattggggatgactttacccttcaggggagaactggcagtgtctggatgaatttttggttgtcacagctgggttggggggttgggggtgctcctggcatctggtaggtaagaacatatttctgcaaaaatactgaagtggagggacaggaatgagtggggctaggtgtccagtgttctggaaagtatctattagtatctatttctcatatttctccccagcacagtcagggatgtggctcaacatcctgcaatgcccaggacagcccccatgacaaagaaattatccagtacaaatgtcactagtgccaaagctgagaagccctgcaaaaaacttgcatgatagtgacggttttctttattttcctcttttttttttttttgatgacagaaagttagataacagtcacaagatcagaaagcgaataagtggcagagcttgaacccagatctgtggggtaccaggacaccctgccttcttgctgtacctctcaatactggtctcttgtgcctgcctgccaaggaacagaggcagtgggaggaggcactcaaagagtcttatgagcctgataacaaatgtgtgagttccctccctttgctgatcagatttgttctgttccattccggagtcactgcaaactaccaggttttaattcaaccgtaacctgtgggaaggcttcacgtctgaggttacctggtgcagctgtcttcacgctggcacactgagaagttaccaaatgattaatagccgtggagtttcccaaaacatccaggtggaagacacacaactggcttattgtcttttaatattcagtcatataaattgaatataagagggtaacagcaggcacccctggagacctgggcatgaggtttagcttcatgcaatcccctgtaagtataatttccccagaccacatggggtaaygggcctccatgtctctgatttgcccatggggggaggacattaagtctgcacagctgtggtgtaatcagatgtgtagggagactctgagagccagaggaatctcttttccatgctgtctcacctgaaatgcttgtcaattaatgtagacttgtggtagacattttgtttgaaaagaagaaatttcattttctttcaaatattatatggtgcaggtgaagcacctggggtttttctaattataccgtgagccattgggaagtatgaacatattttacacattaaaagacctggattttgctggagaccctagagaatgttctcattggagtccccctcatttaccttggaaaggactgtctgaakttgaaaagaaatctgaagcaggaaaaacatataaagaaatatgaaaaaatggtataactttcaagggaaagggtttccttaaaaattcatgagatgggttataataaatgcactagaataacttgtaacaaaaataccaacagtgtttctttggcagatgtttctcaaatatttggggtggtttcaatggttttaaaagctttctcccaacgcttttatgttgcctatttggaccaccaattgagtaagaatttggctaattagtgtaaattcattaggctttagcataattatatttcaaaccaaccagctaaattgatatgatgttgtttgtcctgagaatgactaaatgactgataggaaatgggatatattctttgaaactcgatattcttagagcttggcaaaccgtctggtgttcaaatacattttgttatttgaatgaatacatattagctatggatataaacaaggagggagagatggatgggctgagtgtgattatgccagaaaaacaggagtcgagctcatcgcaagacctagcagtaatttttaggaatcaagtgatacaggtgttttcataagttctcagatgggaaacaattagtgaaagcaacaattccacctttttgtacaaaacatccttttgcttagttggttgtctgcttgctcctcaaacattcggaacatttccaggatcagtgaatatataacagcgatgttttgttttcagaaaatcaggctgatagtgttgtactgaactcaaatctgccttttaggaaatatccatttcctcctggttcttcctcttgagatatgcagagatctaccaaccacatcacagaatggaactcagatcattaaaggacagattccttgacttggttcataggaatggtcttgactcctccctagccaccgcccactgaatggtttgatataaaaaaaacaaaacaaaacaaaacttaaaatatgatcttcgtgatgtggtttggccaatgtagaggattaaaaccattaccactgcttcttctgcttatgaggcttttgactggcttcctcttttctgtcatccaggttctcaaaccccatgatgaacggtgcaggcagggagagtggcagagacagcaggctgctgccatggcctcaatcccagccacttaagttggcttcaccattttcctgcccatgtgtactacaggttgayggctagagacactgtgaacatcccactacttgccactgaggctgaattttwwaaaaaaaawaatgatagcagaaacacctcagacagtctttcatgcagagactcaatttaacacttcagaaaatttttgttcttatgtcaagatcctaaagttcctagatagattccaagatagaagtacccaacctattgtggctctacatccaatttccattttttattagcatgtgattttcttaacatactgccattatcataagttggacaccccattttcaaggcaactgaagtgaatcagagttatagatagcagacatagggtataaattgctgctgcccaaccctgaatacattttttttcatccagtatgatgctctcctgataaataccacctgttcaatgggaatttaagacaggttgtcattttagcagtcaaactttctgttggatcacactgagtttatggtcagcttgaactctcaaatctttgtttatgaatttttatcaatctctgacttttccaacttggtttggccaatcgctttttgaaatagaactttatatttaacttcatcaataacatatgtagaaatatatatacttatatgtggatatatacatcgtatatatgtatatatagtatttgtgtgtgtacatattatacacatgtatgtgtgtgtatatgtatatatgtatatgtgtgtgtatatatatgtakgtgtgtgtgtgtgtatacatatgtgtatatatatatatgccctttaagactaatgcaataacttttaaggttctttttgattgaagaaatatatgtaattaatatcaaatcatatctatggcttgcagcttacccctctgcctacccctaatttctaattcctagagacaacacccctctaaactcctttggctggttttttttttctggcatttgtgtatgcatttctcaatacataattatactatcatcatactattataattttcacttataaacatttatttctcctattaaaactaaagatatggctgtcaaactrtgcacacatttattatccctttatattctaggtttatgttattgtggytataagaatctgctgtaaataattatatgaaatacgactctgatagaattttctttgtcacctatcattttgtttttccaggtgttaataattatttcttcatttgtttagtgttctatgtattttttattaaatcctatgccaaacattccaacagagctgtgagatacttgtcaatgtctttaaatgtctcaagtcgtctgtttgtttgttcttattttcttggaatttgtttttcttggaattctctgtatttctgctctagtttcttcctctaagcctgcttctcagcsatcaccctgactggccatcaaactgggaactctgtttgcctttgtcctgtactgagtctcctctttcccaaatcctttctctttttccttcctggttaacctctggattatgtgtgtatttcgcatgcctgaaaatcctttttctacttttagacttgcaaatttggctggatatagaactctaagttgaatatatttttcaatagatgatgaacttggaagattcattatctaattttctttcaactcccttttacataactgtcttctcttaaaaatacttcgtacatttcttcaactttatcttatgaccactctgttgttgtattattgtttaatctttgccatcataatttcaattttaatggttttttttgttctctcaatgttcatttttatagtaatctttgttttgtgaatacagtatcccctcttagctcttcaagaatatcatttacaggtgtttgggttttaaagattcacctgttttctgttgcttctaaatttctgcttttttttttttttttttttttttttggtctgtgtcatgttagaagggttgttcacattctttgtgaatctttgctgccgttgtcctctgagtgaagcactaaaggctctttaggagttttgcatggacgtgcatgaaaactgatgagcctcaaaatgggtgatggggttgggactccaccatcagtatctgtagttattttcggttttttgtttatttctgttttttagatggattctcgctctgtcgcccaggctagagtgcagtggtgcaatcttggctcactgcaccctctgcctcccagcttcaagcgattctcctgcctcagcatccctagtacctgagattacaggcgcctgccaccacgtccggctaatttttgtgtttttagtagagacggggtttttaccacattggccaggctggtctcaaactcctgacctcaagtgatcaacccacctcagcctcccaaagttctgggattacatrcagaagtcactctcacacacatactcatatttgccttaccatttgtgcaggaaatcaataccattactacccaagaccaaaggtttcactggatttaagcactgacatgaggccaagaccatagctcsttccatggatatatggtccactttaatttttatgaattctaccctaagaagggggaaatgttaattgaaattgtagccattgttaacattgaatttatcacttaatggcagttacttattttaattataacatctgtgtccaagtcagtgtgttcattgttgtattcctcagaaagtcttatcaggaacccactcccactgtaactaacacagataaagtcttctgctggcatcatctcccctcttcacactccagggaatacctaaaaaatggaaaaggtagactgtgccctttactaactcttaaggcaaagaagtttaagtaaggacaaacattaagccaatatttccgatatggatgttaaggttcacagcacaacaaacatcacaacctgtggctgtcttttacctcattcatggaggcttatgaagtacacttttcttctggaatcctctcttttccccacctctcagggcttcttggtgaggtccacactcttcactcaccattcctggtctsaagtcgggatgtcttgtcctaactatcaatgacccacagttacctctacctctcagctgagccctcagcctattttctttttttctactcatgttctgattgcaaatgacaggagttatgactgttgttgccccagatctcatcatctacttaaacatcgtcatctgccagtattctcagccttgcttttttttctcagtgttaagaatttgttagggaggagctggtgaaatcctgaagtgcagcagagacatgcatgcctcattctttgctaaaacagaatgccttcagaagcaagtaccagaaaaccccaacccaactgttgtaaacaaagaggaaaatttatcatttcacaaaacacaaaggctgaaggtgcagggaagctccagggatggttaattccccacctccgcagcatcagggattgggttctctccctcttcctgctttatcattcagagcccggctggattatcctcaggctaattcactccatgtatgcagaatagctgtacagctaccagtgtcagaggcaggcacatcggcttataggagaaagagagagcagctctccctttctgtgtttgcgatgatttaaatgccctctccaaaactcacgttgaaatttaattgccactgtgatgatattaagaggtaagacctctaaaaggtgattaggtcatgggggctccaccctcatgaatagatgaatgctgttatctcaggagagtgtctgttaccgcgggagtgggctcccggtaaaaggatgagttcggcccccttccccttgcaagctcactcatcatatgatgcctttcacaacattacgatggagcaaggaggcctcgcctgttgtggcccctcaatcttggacttcccaccctccaggaccatgagccaaataattttttttcattagaaatgacccagtcattttatttaacaagatattatgttgtcatagcataaaatggactaagacatcttttatcaccactttcccagaagttcccatgccccacacatgtgctctcatacctcattggccagaccaagtgaagtgtctctcagtcacaggtgagggaaatgagatgaccatgaatggcaaattaatcaagctttactcatttagagaagtttagaggaggataccttctttggccacatgactgtatgggaaatggtggacactgacacacacaggtgtatatagatacacctgcccctatgtgcaccactgacacatggatattaactcagtggtaggaccagagtaaacccctgatcatagtaattgacataattataagtgcagacattaactgtactgcagtttgtctttagaacagtggtgtatatatacctatactcatgttgtatacaaccttcacaatatgtaggagaggaacttccatggaagtatgaacagaagatcaactggacagttacgctgctggtgagctgtgtgtagcctgagggatctggcacatccttagttcttttcgcacaaatgctgctgccagttggctcaagcatttcagggcagttgccacagttgttactacagttaccacattttttccaaaccagcagtcagcatacacaattggataggtacttctttccaatctgtgaattatttgatgtcatatgagttacagaagttcatcccgggtcatgtttaaggatatataaattacatgttgtagacaaagtctacgtttctacgtttttttgacagcacaagtgacatgaagtgaaatgcacatttcaatgggtgtcgcatcctggtctcaatagttttagtgcagacattcttcctacacaaaaatgttgtgaaaatttgaattgatcataatgtgattgatgttgagaaataggatttatatagtccatgaactactattgggtataaccacttgaagctgggcacaggttcctaaggagtgagtgtctgaggacaccacagagaggccagagctgctctgctcacctacccagttcttaggttctacctggcattctttagctctctgttgttaaaggtaaactctgccacaagccaaagaccagagcagagagatgggaggcttgtcaaagaagcatgaaggtgcttttatttccttctgaccagacaacttgctcagccttagcttcagcaatcaactacatctgtaaagacgcttttactgttggtgttttaaacagaaaaacaatgacttcataatctagaactctctagaacctccttttctattacaaaagcagctgcttttctctcctagtttttggaaatgtgaggcttcttagaaattcaaatgttgtgtcataacctaacatagtttgcataattgcagagaactcaccagatgactgttgtatcttatgaggcccctccccagaactcctggagagacctaaagtggggggcagatcctatcaccacagctttgtattacaaaacttcattaaatatattatgcaatgcattactgctgtatgcatcataaatagacacaccatccttcatgtctcaaatattgattatctaaactatcccacatcatctatttggacctagggatatgaagatacaaagatgcagtctgttggcagaataaaattcttaaacagatcttagaatagtgtgagttgttcctggaaggtacagagtgccrtgggaactcagagaacagattcccaccccagtaagaattctgggatcactccaccccaaaagaatgagggttatgttgtccttagtgggaggtggtagttgtggattaggtcctrtcatttcacacactgaccatctctgcccagtaccctgaatgagtgctccatgacatcatcctctttgacctctggccaccttcccttctcctagccttgctcctcaccaggtaatcctagacatatggacagctcactatcaagaggaggattggtccactggagaaccrttaatcccttctgcactttggggatgatctcatctgatttgtctgtcctgcttcctcaaagcccctaaaatgcatttctatgctaagttaaacagaattgattgcggctagatttactgagtcttttgaaatggttctattattttgaatgtaagaaaataatgtactacacctcctgagaaatagatcttctgcaacattttcattaatctctttattaaatgtaactggtttctctttggaaattaattactgaagtagtattgagaattttaatttccacaatataccagcaagagatactgctgtttctttatacactgttacacagcagggcaataatctattgaaataagcccaaaaagggggcagcttgtaattaaaacagtataacacgagtgtttgatgactctcttagtgctaaaatggccctgtcatgctgtgtttgggtggaataaaatgtatatttaggaaacagctctatatggagaagtcgacagactcaggttttacagtctgggatgtggctgtgtttcactgcaataatatgcccacgaggaaatacggtttgtttttggcatctgagaattacaaccattgctgcacaataggaagcttcttcccttagtaagccacccccattgtgaaatttaaaatatttaaatgatgaagcagagagcatcaattatcaatgtcggtatccatggaaaagacatgagtatgcaaacacctgagtgcacgcacagctcacgtgtaggtgcaagtccacgaatggatgcggatcctgtatgtgtgcatgaaggccctcattgacacagattcagcactcaataactctccctcacgcttagaggaggcttcatatttttcaagacacgttcctatctgtcatcttctatcctcccagacgtgttttcycatgataagaattatttacacatcatttacatttacagatttgctttttttgttgttagtgtcaaagacatttttgcagatgctgtgttgctcttctcttttctccttcctcactctcttctttcctgccttccctccctccctcccttcctccctcctttccttcctccctcactcctttcctttctctttcccttcctccctccctcctttcttcctccctctctccttcccttcttttctccctctctcattcccttcctccccctcactctaagtgctaagtatacagccatgaacaccaccagctccctgcttttagggagcccaaagtcctgcccactcagcatataaaatcctataattgcctcttcttggaaagcagtttattggttttgaccactgatacatgtacctttgaggtctatgccctatccccagaagctcctcaaagaaaacagtacaactgaatcacatattgtatcctttctggatgaagtctgttaactaaaacttgctcatcttcttgtatttccagtaatgtgggtgagtcttatggataagtgatcagggcagatcccaggctggacttctccttatcctggcttaaggccaccagcagcattcttgtgttggatctagacaccagctctaccgcacattgaggcagagttcataaaaaaaaaaaaaaaaaaaaaaaaaaaaaattcatggttgctgttagagccccaatcctgcataatgggcttttatttaaaaaaaacaaaacaaaacaacaacaacaaaaaaaaacgctgtacctagaagtaactgtccagaaaagaataatataatgcatacccaagatcataaatactggaaatcatacaactgctggtttctcaattacagtaagaaaataattcacaatactcaaggggaaggtagcacttgtgagccagcattatttatagaaacctttcttttatctttctttgcaaagtcttttactagaattatttatttaggataattagagaaaaattctgtaatttcaagtaaatattaactacaaatcaattccartaaaaatgctgctgtccaatcatctgtgtcactgcacttgggagaaaacawtttatgttcaagcctctttagctggattaatctcttcaaacctaagtgatccatatgaagatcttgtcaccggaaattacttttgatccaatacatctcacatatcataatggtaataaacatttgtcttgtgccttacagcttaaaaagtgtttttcatccattatctctcttaattttcatattgatttttagaaaattaatttgttcaaccagtgtttgggtgcttcttgtttgtttattccacaaaaatttatggagtacctctctcagtcctcaccactggggatgcaatggcaaataagatgaagtctccagccataaagaaactatattctagtgagggagatggatgataaaattaaaaattgtgcaagtgcatgatccagtgtcagggaatgataagacctgtgtagaattaagaggccaggggttagatctggacaagaaatgcttgttcttgctacataaagagttaaaggctgagcatccctgagtaatgtgagactgtgaaccaggaggacagcgttccaggcagagtgaatatttggatcatgcctcacatatcgtactgcagttagcacttactacttaataccacacgggtattttcccatgttgttcaaacttgaatttttaaagtctgaaaaatattccatttatggatgtccttatagatttatagatatccagcgttgcagtccggggctcatcaaattttttccactccttactgagcttcagacccaccgggctgcagagaaacatctctagcaaatcataatcatttgcgttaataggtctgtgtggcccctgaagatttcataaggtggaaaaactactcccaattcatggggattgggctggacacacttcagtagctttccttgaaaactggaggaaaggcagagctgtggcagagtcaacgtgggaaatgtggtctgttgagtggtcctaggagtttcaagaacaaccattctgtgcagatcagtcagccctgtggggattttagacgtggattgtactctgagagctaatgatgagtttgctggaaataatttttccatttccatttctaattgttaatatagtacagtgagctcggtaagyacaatctgctcagataacccaatctgcagtgtgactggtgcctgtggctggtgcctacacaacaggcttttgtttcgtaacttcagcacttgttgtggggggaagcaccacaaagctgctatccattgagcagtctttcaccctagttttggtgcatatcacttctttaatcaagcaaaatggctctaaaataatatcaatttttttttcttttttaaacttttaggtgcaggggatacatgtgcaggtttgttacgtgtataaattgcatgtcacagaggtttggtgtacagacgattttgtcatccacgtactaagcataatacccaataggtagtttttttcaatcctctcccacccccaacccttcaccctcaagtaggccctggggtcttttgttcccgtcttagtgtctatgagtgagtactcatagacatagtagtgtctattagctcccacttataagtgagaacaagggcatttgcttttttcttcctgcaagttcccataggtggcagctggataaagaaaatgtggtacatacacaccatggaatactatgaagccacaaaaaagaacgagatcatgtccttcatggcaacgtggatggagctgtggaccattatcctaaacaatatgaattcttaagaagccaacagggaggcccatttaaaagcagccacaaaggggtacataaaagtgaagacaggttttaatgacataggtttcaagttaactactgtttgttgatctcttgtggtttccgtgggaggggcatttcaatactacataggtatcgtgtttttattttcgtaactacgcagcgaggtaagtttagttatctccacaagcaacatgtaagaaaattgaggctcagaggggtgaaaaggccacccttgatcaaacagttggtactgaacctggtttctagcctcacatgcaggacctcagagctcttaatgattcacccatactagtctatcataggcggcagtgcaggttttgcctctgaccacattgcttacactttccatcttcctctccaccacttacctggggttaagctctcttccagcctgcactatgacaacagcctcttcaagccaatcttacaccctctcgccttccccsaggccaggccgtytyctccatcccaacaccaaggtccctsaaaggaaagaccagtsaagtctcaaccctgcttaaaagcctcagtgacaaccattctgctgggtgggattgctggcaggaaggtggccttagggaaaggctggtttcagccaaggctggaggtggagagaatgttctagaaagcactggttgctggaagggtttgtggatcagagacctctcagttagctcaggcccttggtacatgctcttctctctgtttataatgttcttcctgccactcattatttggctcctaccctgagtgatcccttgcctccctcacctgctagagaccctctgccacaggcttcagttagttattccagcctcctgaaagcacttaccacagtttgaacttacctttgtgaggttatctgattagtgtctttagagctctctaagtaatgtattccttcaagaaagggattctgtctttccccccagagaaacycccacatgcagcacagagcctgatgtgtgaaacttgctgaatgagttgaaaataataagctaatgattttataaattcatttaaaggatcctcagcttctactgcaatggttctcaaacacctggtggcagggggggtgtttattaaatatgcacattcttgggccccacgccagatctactactaagaacctccatgggtgtgaactataatttgtaagcaaaatgtataagcaagctcccaggrtgaattttgatttggataagagtttggggacttccttcttagcacacaaaatccagtctttattccatttaggtgtgttcaaatggtgtcatctcagtgagccctcctctgyccctcttatttaaaattccatacttccagccctgtctgacccggcactccctatagacacatgctttatttttatccagagaacttgtctgtcacttcccactattatacatgagggcagggatcgttggtcactcctactatattcccatttcctagaacagtgcctggtacacattagacatccaatacatgtttgaattaatgccaagtttgccccatagagcatttatgatgttcaaggccttaagcagctgggaaaggagagatgctgggccacataacttgagataatattgacattcttttttgctatttttcttttttccttttgattagatgacacttgagaaattaggtcagccatcatactttctgtccaaatggctgttgggtcatgtccacctaatagaaaggcaattttggctgctaatttcctgtctgatcagattaattgaattcagacagtgagcacagagccccctttcagagtaaagaagacagcactgacattagtgctcatgcaggcttcttagtttttctctgatgaggagctgtgttttatttccttgatcttggaattactgagagagatggagaagatgcaggggagctcagaaagcgtgtataggaggggcttaaggagggggcaccattttcctcctggcattagtaaaacctcaggagtgagccttatgactctggcttggaagataaggggggcctgctttgtcacttgtgactacaggattaatgacttggttatacgtcatttctgaacccatagtgtctgtcgcccactttatgggaattaaaccttccattcagagcaaataagttccccggatgccgggcacagtgggtagcggtgcagggaaggaaagaggggtgagggaagggtcacaaatgagccatgaaaactgccctgaagagcttataaactaatgaagcactttcgtttttatgctttatgttctataatagaaaaaatcgaggtggcttataatgaagactacagattaatgatggtcatttaaacaattataacagaaggaaaaaatgtacaaggaaaggagttaattagaacctgaacacctaggccaagactgatttacaggatcatagcacatcaggattgaacaggcttatgaggagcactcagttcaaactcgccccacactctcaggctgttgtccgaatcctttcaagggacagcccaatccatcccaatcactccaactctgagaagttctgcttgatatatttcatttatcaagctgatatctgtttttccctttggtcctagccctatccattaggagccccccaagagcagccctatcattctacaagatggcccctcattgaataagttgagggtttcctcttgttctctgtcttctcttcacctgtgtctttggtgtttcccatatgacttgcaagcaccttgagccagtgattgcctctcaaacacctttgagttgcagaatgtatgagttcattttcaccctgctaattaaaatatacccaggactgggcaatttacaaaagaaagaggtttaatagtcttacagtttcccatggctggggaggcctcacagtcatggcagaagacaagagcatgtcacatcttgggccaggcgtggtggctcgcgcctgtaatcccagcactttgggaggccaagtcgggaggatcacgagttcgggagatcgagaccatcctggctwacacggtgaaaccctgtctctactaaaaatacaaaaaaattaccttggcatggtgacaggcacctgtagccacagctactcgggaggctgaggcagaagaatggcatgaacatgggaggtggagcctacaggagccaagatcaggccactgcactccagcctgggtgacagagtgagactccatctcaaaaaacaacaaacaaaagcatgtcacatcttatgtagatgttggcaggcagagagagtatgtgcaggggaactcccccttataaaaccattagatctcatgagacttacaatcatgagaacaacatgggaaagacctgcccccataatacaattaccccccaccaggtctctccaacaacatgtgggagttcaagatgaaatttgggtggcaacacagccaaatcatatcacagaactaccacaatacctgttacaaaatgggcactcaataaatactggataggtggattcattggtacctgtcttcttaaaagaagaaaggcaggataatcaatgagaggttttctcactcatggttatgaccttgcatttggatggamagtcatctacaaatatgttttcaccttctcagggcaggctgaacaaagcctgtctgaaggttgtcasataactatgttctccaaagtatggggagtttattaaaaactcagatgcctaaacyatactccgaacctactgaataaggatctctttctgtggggcccagggaatctgcattttaacagattcctaggtacaattcagtttgggaatcctacaaaggctttaaaagggcaaagatttcttaaagtgtgatcagtgagaatccctgagactttttcaggggcttcatgaggtcaagactattttcataaaaatactgaggtgttttgtgcgttcatccctctcatatctcatgtatatatcatggagcttccagaggcttcctggtgtacatcattgaaccagactsaaagtagcagataagagaatccagcggattcccttaagtcaaacgtgaaagccctgcaatagccactctttctactatattttcttttgtttaggaaaatacagtttttaatttaaaaatatttttatgttaaaaagctatgagtttatttttttagtaatttggtaatctttttaggttttgtagaaatataaaggatcctgaaaccaaaaaatttgasaagtttgtttgctattgggcaacaaactaaataaatgtatttaaaaagtagatttcctatctttattcagtgaaatgctatatcaagtagttgatcccatgtcaacttaatttgttaaaattatgatttctattgataaaaggtctcatagttcctattctccaagaaggccaaggtgtttttgcagtattgcagcatgagcaggaatcaggcgctaagtattgctttcctttaaaaaaaaatgcattatatttcccagatttctggcaaatttgcagttattcaattttaagtagcgggaaccaaatccatctggatttttaaaaagtacaaccccaggaattttgtgatcatagatatgactcctttatctctcattcccaaagcttaaaccagatccagcttaaagtcatctgattttcttttagctcttccccattcaccatgggctccttaaaccaaagataccttctaagcaaaaggcaccttctaagctccaagacaaccctctgaaatggggaaaggtagcagtattgtggtaaaggtttaatgaatggcttggaggacgtgcaaagccaagccctgacttgccagtttccatggtgtgaagaatcccgttatagttggttttgagttgaagctatcaacccggcatcactaaacacggtaatgggaagggaaacatacaacaggctctggaggagacagcaagaaaaactgtctaaatccgttctctctttcaaccatccagagtttactctggatcctggcaatgccggttgaggtggcattattccagggtagtctttcatatgtcagcagagaagagaaggatacaagtgtggccaaatatgttagaggctggagcaaactccttgagagcatytgattcgcattctgtgaagaacctgtattcatagcaagaaatgaggctgaaaagagaagcagtgaatttagaacatgactaccttgcctggagaggggaaagggcaggatgttgaaccttagtctcataatcagtcttatcagaataacaatagccagcatgctaagcctggatagaaatacagaaagcacacagcactctgcctgccttatactgtagtagtgacatctttcctttttatttatttattttttattgtaatgggtgctcttttgggaagaatgaatcaactacttttgtgcaggttcgtctcattttaacttttttttttttcattttgtgaatttgaattgaatatttagtcacaggaaatagttttaagttctctgggaggccaaaggtaagaattccatgtcatagatacaaacgagtctaatatcagggctagatttattctgattaaatcattgtaagtcagctgtttttatagatctgaagtagaagagaaagtaaatatttcatccccgaggatttgttagtagagatttacatgcctccattccactcttgagtttgaatttaaaatagtcacaatgccgaggggctcctggatgcacgcacaaagtaattgttttacaattctgttagacaaaacccatagcacaatagctgcaatgcaagtgtcagaggttagggggaacattaaaatcattcaaacgctgcacatatctgccgcattctggaaaccgctgctaaaaatgggtattaaatctcaccttaaaggtcaggggcaatttacccatctttattaatgagtcgaaattatcctggaaggaaccggctattaaatatgtggagttgagacaatcggctatacatctgggaaaaacatcattagcttcctctctcacaacatgtagtgacacacatttctagatggatatgagatctaaaagtgagaagcaaaccataaaacatacctaaagataatataggcgtagctcagagatatcaaaggttgatttcagaccaccacaatcaaaggaatatcacaatgaagtgagtcacatgatttttttttttgcttttccagtacatatagaagctccrtttatactatactgcaatgtagtaagtatgcaatagtttcatgtctgaaaaatgtacataccttaattaaaaatacgttataactaagaaagtgctaacaaacatctgaatctttttgctggtaaagagtcttgccgcaatgttgatggctgcagattgatcagggtggtggttgctgaaggatagtatgcagggtactgcagcagttttttaaaataagacaacaatgaagtttgtaacatcaaacaaggatttcttttccaaaatctttctctgtagcatgtgatgctatttgatagcattttacctactgcagaacttgttccaaaattggagtcagtcttctcaaaccctgctgctgctttgtcgactaaatttctgtaatattctaaactcttttttgtcatttcaactatgttcatagtakctttaccaggagtagrttccatcttgagaaatgtctttctttgcttatccataagagcaattcttcatccattcatgttttatgatgagatggcaggaattcattcacatcttcaagccacacttctaattctagctctcgtactgtttccatcacatctgcagttccttcttccactgaagtcttgagcccctcaaagtcatccatgagggttggaatcaacttcttccaaacccctgttaatgttgatattttggcctcttatcatgaaccaagaatgttcttaatggcatctagaasagtraattctttcccgaaggttttcastttactttgcccagatccatcaaagaaatcatatgccagctatggcctacaaaatgtatttctgtatctcataagctatagttttacaaaatgtcttttgaaagtcaaaattactccttgatccatgagttgaaaaatagatgttgtgttaccatacacaaaaacattactcttggacatttccgtcagagctcttgggtcactaggtatattgtcaatgagcagtaacattttgaaatgaacctttttttcctgagcagtaagtctgagcagtgggctcaaaatattcagtaaactatggtgttaacagatgtgctgtcatccagattttgttattccatttatagagcaagattaaatttcagaatggccaataagcatttgcttcaattttaccccctaaccagagagtctgcctattctttgaagttttgaagccaggcattgacttaatctctagctatgaaagtcctacacggcatcttctttcaattgaaggctgtctcatctacactgaaaatgtattgtttagtgtagccactttcatcaacgatcttagctggatcttctggatatcttgctgcagcttctatatcagcactcgctgcttcgcctagcactatgttatagggatggcttctttccttaaacctcatgaaccaacctccgttaggttcagacttttcttctgcagattattcacctctctcagcctttatagcactgaagagagagcactttggtctggattaggctttaccttaagtgaatgttgtgagtagtttgatcttttatccagaccactcaaactttctccacatcagcaataaggcagtttcacttccttgccattcatgtgtttactggggtagcaagttttgtttccttcaagaacttttcctttgcattcataattcagctgtttggtacaagaggtctggctttcagctatctcagctttcaacatgtcttcgtcattaagcttaatcagtctaggctgagtggtggctgacacctgtaatccccgcattttggtaggctgaggtgtgcagatcacttgaggtcaggagttcgagaccagcctggccaacatagtaaaacctcatctgtgcttaaaaaaaaaaaaaaacgtagccaagcgtggtggcgygcacctgtaatcccagctactygggaggctgaggcaggagaattgcttgaacccaagaagcaaaggttgcagtgagccgagattgcaccactgcattctaacctcggcaacagagcgggactccgtttctaaataaataaataaataaaattttagggaaagcttaatcagtgtagcttttgatttaaagtgagggccgtgtgtctcttcttttcacttgaacacttagagaccattgtagtggtattcattggcttaatttaaatattgtgatatctcagggaatagggagtcccaaggagagggagagagatgggggaatggctgctcattgcagcagtcagagcatacaccacatttatcaattacatttgccatcttttgtcttctgcggacatggctcatggtaccccaaaacagatacaatagtaacatcaaagatcactgatctcagatcatcataagagacataataataatgaaaaatgttaaaatattgccagaattaccaaaatatgataccaaaacacaaagtgagaatatgttgatagacatgctcaacgcagggttgccacaaacattcgatttgtaaaaaacgcaatagctgaaaagtagaataaaagcaaagcacaataaaatgacaatgacttatctgtgaataggagaagctaaaaatgtaacgttggaccagagagggctagtaagcaaggctccaacccaaaaaatagtaaataaaaatataagtcactaaaacccctgtctatttgggagatcataaggttataaaacaagtgacaacaggacagaaaaattttgcaacatacatgccagacagttactgtccttagtgtaaaaagagctcctgtaaatcaacaagaaagagacaaataggaaatggaagaaagttggcaaagaaataagttcttccagtgccttgagagaataagttttcctttccagcaaacctggacaccttaggggcttctgaacacattgcattgcttcctcattcagggctgctgatgggtggattttcatcaaagcatattttcatcctgttattctattgagcaattgacctctgtgggtctccatggttgataggctaacatgtaacctcatcatggtatttgatatttaattaaatgagataatttgtataatgctctagtacagttttaggccatggtaaactccgaattaattctgttcttcactccttatttatagcattgytgagaaaattaggtgagattctgtatttagaagaagaaaagttcccacttaatgatggggctgctcaataaatgttggtcctcttctctagaaaccctgactcattcagcacaatcccttagatcttcacagatttttaaatctttaattagggctcctccatcctggctgaatgtttgaattacctgtggagttactggatgataccartggccaggccctaccccagacaagttgaatatgaactccgagtgtgggacccaatgtattttaaaaagttccacagaatggctgggtacggtggcttactcctgtaatcctagcaatttgggtggccgaggagggtggattgcttgaggctgggaattcaagaccagcctggccaacatggtgaaaccctgtctctactaaaattacaaaaattagctgggcgtggtggtgcacacctgtaatcccaactacttgggaggctgagacatgagaatcacttgaacccaggaggtggagtttgcagtgagccaagattgcgctactgcactccagcctgggcaacagggctagactccatctcagaaacaaaaatttccacaggagattgtaatgtgcagccaggggcaatatctacctgaaatgtcctttagtgttcttacagtggtgcctttatccctgaggtgccttttcccttccaccttgccatcatcggcctctctgtgtattaaggtcttagtttgagctggaaataaccttctttttggaacccctgcagcatttacatcctttggtcttagaatagccttttttggtaataatatctacttgtaataatatctttatatccagagttgtaagctcctggaggctggggatataattttattaatcattacatttttgtaatgtgtgtttcagcatttgacacatagcaagttctcaaaaactgttgaataaataaatgaatgtaagtgaatgaggatagacatgtatctttacacaagcctagagccaaaccattctctgtgagatctgaaaccaagcccctgtagtctgtgtgttatcaaacacagtagttagcttcacagacagccttattaactaactcatcccacagttttcaaagagcatgtatttcttgtcattcatgaagttgttagttctggggaagtgttggactttggtaaacaccctctctttcggcttctcacttggattttcaatcctgagcaaagagaccactcaggagaagaatctgagtagtcaaagcagagagttggtactagatggcgctggacttactagctgtttgactttgagcaaattgcctgttagaccataaaatccttatctgaaaaatgagatacgatactaccacctgtttcacaggtaaaagtaaaatgagaccactcattaaaatatatttactctagtgccagctacttagtgaactctcaaaaaatgatggactccaggaaataaaaattagattaagattaaagagtacaggctactgtgaaaagaattgagcattttttagtggaaggagggaggaaactaacatttcctaactaccagccgtgtctgaggctgagaacttctctggtcaactcagtgcagaaaaaaatggcaaagtgtttaaatatattacataacataacatagcgtaatataataatatagtaaatataagtatagtgaatataattactttgattacataagtatgattagtaataaatgatagatataaaatagtgttaatataatacaaaatactatagtataatacaatataatgtgtatgtttctttttaaaaccttttcagtatacgttgaaggaaacaaagacccaagtttaatasggaaatgatttttgtaataaagtgaacaaactggataggttctcttgagctggttacagctgttttctgactgaattttaattataaaagatctagccagcttctatacacactctccctgcacaaatgttaactctggttcagacaccttttctgcacccagttattctcactcataatttctttctccttgggtttttgttttattttggaacggctttttaaccttcagaartacattttgtctggaggaccagagyatcgatgtgatcctacctgtagattcttggcaagagagaaaatgttcttattaatgcagaaagtcctacccagaaggaagaaaacgtctcacctagaaaaaagtcattatgtagttttttctgggctcatggtttcctgaagagacctggtcctagtcaatttctccttggtattttattatttttgtccatttgaggtgaaatccggaggaagtaattatgaggttgttttaggggcacaggtggcattttcatggattggctgagctgactgcctgcagttgatttggggatggggtctactttagggtttcactgagtacaggtggtcacagatatccacaggttccaaccagtgatggaaaatattcagggaaaaaaaaacagtaaaaataayaccataaccataaaaaaagcaatgtaataactatttacatagcatttacattgtattagctatcatatataagtaatctagagatgatttcaagtatacagtggatgttggaagggtgttcataggttgcatgccgatactttgccgctttatataagagacttgagcattccaggattttggtgtttgtggggragggatgttgaaaccaatatctgcgggtaccaagggacaattgtaactggattctagagcacattctgagtttgttggcagttttattaatcatatttgtattaaaatgcataacgaattatagaggaaaaaaaataaactctactcattgtggccaggcatcacagagaagtgggacaagggtgtggaccaaagaaacagaccaaggagcgtgggcgaactggagggttcctgcccatgtcctgcccactttctgtyccaggtttcagaggagcaaagagccgttgcccaagaaataatggctcagccatctttaccctgtctcaaatgcaagtctctaaatttgttcctcctccttgtctggcaagtctgagcaacgttcctgcttcagctctctccccagtgtttgaggcatgaactggattccaggtgatgacttacccaaacacctcaaggagtttcgcctctaggacctgggtggaccttcactcttcccacatcagccccaggcagacctctctgcacgatgccagttgcatccatattacagctgacatttgcagttgactttactttgacaaatatttttccatttttatggtgaacccaaagagttctatcctcagggcatctgctagcccctgtggtatgtttgtgtagaatttaaaaggcatgctccctctggtcagaggcagctttacagatgtacaaatttgggtgatagaagtttccgttgtcaaatttaaaaatatatcctattcttcacacctgtaatcccagcactttgggaggccaaggcagacggattgcctgagctcaggagttcaagaccagccttggcaacacagtgaaaccctgtctctactaaawtataaaaaattagccaggcatggcagcatgcgctggtagtcccagctacttggggggctgaggcaggagaattacmtgaacctgggaggtggaggttgcagtgaaccaagatggtactactgtattccagcctgggcaacaaagtgcgactctgtctcaaaaaaaaaaaaatgtatatatatatatatttatatatatatacacacacacatataaatatatttacatctatctatctatctatctagatatatacctcatattcttgtgagtggactgaggctcatgccatgtggaaagtgaagcaagggctggatatttgattcctmcttgtccccctgccatgcccgtgctcctatgtgtattataacctgtaccccatagatggttcttgagattactcctcctttcatctggaagataatgttcatcttttttagggccaccttcatgagcgcatgctgaaggtacccatgtaaaaaggccataaatgtttgaaaagccttcaggtactttataggccatgttcattctgcaaatgtcagtggaatgttcaggaagtccaacgtagagaaaggcccaggatggctagaatraaatcagagatatccagtaggacctgatcactggcagaacccagactggggccagctgatgaagccagagaggcattcgcttcagggaccaaaactttcattcagtaagagcgggggtcctcaaccacgggccacaggccagtactagcctatgasctgttaggaacctggctgcccagcaggaggtaagtagcaggcaagcaagcaagccaagcttcatctgtatttacagccactccccatcgcttgcactactgcctgagctccacctcctgtcagatcaggggcagcattagattctcatacgagcatgaaccttattgcaaactgtgtgtgcaagggatctaggttgcatgctccttatgagaatctaatgcctgatggtctgtcactgtctcccatcacccccggatgggtccctctagttgcaggaaaccaagctcagggctctcactgattctacattatgatgacttatataattatttcatgatgtattataatgtaataataatagaaataaagtgcaccataaatttaatgtgcttgaatcatccccaagtcatcccctcacctcctcctggtccatgaaaaarttgtcttccatggaaccagtccctggcaccaaataggtttgggacctctgatcaagagtgatagcattgtaatgtaacatttttgaaactcaaaattaatgyatagaagtccatgagaagtaaaatgttaaagacaggatcaaaatcaatgcagaaaatccataatgagcaaaatatsaacatgttttaaaaagagggcatcagtattactgatttctttcgtttgactcaggctccagtacagcttatgttggcactgtgatgtatcctgtctgtatttaaaatttttaggtagtgtccatcatgacctttttgcagtaattgcgatttttaaaaatattgcgttaaaatagtacatatcttgattactgagttttttggtgcctcctttgagatggtgcagaaagcaagctcctcactcatctcctctagcccagccccaatagctaactcactcttagcgcctgyccttgagtgctgtgtgagccattgtgttgcaccagcttgttttaagtcccaacaatcttgttccatggtgtcttttaataatggaagagcaaagaggttaaatgactagcccaaggtctacatgaggtggaggaggagggaatcaaattaggcataaagcctattgcttggatcatgtttagtaacaaggagacggaaggtggaggatatgagaggctgatcaaggtcgcaggagcaagtgcagggcagagacagggtggcagctccctgtgccttctggaagccawcccccaagctgaaggagccacacagagccagctgtccaggcaggacctctctgcggtgacattcacatggcagagttaccaagaagaaagcttgtgtccccaagacttgtatttgaaagttaattgcttaaccttttcccaaagaatcgtcagcaaatattgcacacacccacaaaaattattttgcctttcataaagcacaagtggacatgtctttatttctctgcaaaacgagccgctgcagtgcaatcacttgaaatgtagggtctgaatgaaaattaatgctgttgatgaaaccagcagtctaaaayattacaggatattagactgaaaagacagtggtatttgcatccttttgaacattcgcctggatttgcataatggagatgtcacttrtattgcaggagaaaaatcaagttacctgggctcccattaactgcctgctcgctacagttcccgtaagggrttggaacaccacctttttgaaatagaaaatgtgaaactcctacattcaccaagtgagtctttagtgaaacaggagtgaaaagaatcatgggctattgcttgctcctggcctacaagaaccaaaaaagacacatttctgctggaggcgaagaccaggaagaattcactgtctgcatatgaatgtgcgtgaacttggttgtcaggaaatgaacagtacataacccaacctgggacccttttggcctctacagcttgaaattgtaacaccagcttcactacccggttatattaatctcatgtatttttggtatctggtgacagcttctttctgaaaggcttctgtttagggcggtgtgtggtaactgtgggtgtacatcacaatcatcttggatgctttataaaaatgcagatgcccaggctccactttagtgtggaacccagatattgatattttttcagcactcttaaggtgattctaatgtgcagcctgcgttgagaagcactgctctaaaagatctctgctgcattttatccttctcttatttgaggctgttttaatggagtaaacatacaggattcagcataatataaatttaatattaataatgccagggacatctaagggcacattcaccccaacagtagaaactcagaatggggacagtctagctggaccatttatcagctgcttgggcttgggtacgtggtttagcttcttggtgtctcagttttctcactttgaaatggggataataatttcctttctgatcatatgtaaggatttatgacaatgtctatcatacagttagcctgtaaatgatacgttctrttttatgtaaccattaaaacaatttctttgtgggctgtactttcatccagctggatggattttaaccaagtgatcccacctctatagccagcacccagattaagaagcagaacaagwctcttcctcttatagccccttctaatcaccagcttctccccagagggaaccactcttctgacacttaactgtacarattagattggcctgtttggggactttctactgatggacccatgctgtgtatactcttttstgtcamcttctttcagtcatcayggttagtcagatgcatgttgttgttgcatatcgtttgttcattctcctccttgctgctgtgcaatataccattacgggaactaaccacattcaattctattttaaytgttagtatttacaatggctccctaactgggatctcttttcaaacaattcactcttcagtccctgatatgatttggtgctgtatccccacccacatctcaccttgaattgtaataatcccctcgtgtcatgggaggcatccagtgggaggtaattgaatcacggggggcaggtttttcccatgctgttctcatggtagtgaagaagtctcacgagatctgatggttttataaggggagttcttctgcacacgccttcctgcctgtgaccatgtaagacgtgcctttgcccctcctttgccttccacggtgattgtgaggcctccccactcatgtgggactatgagttcattaaactcctttttctttataaattatgcagtctcaggtatgtctttattagcagtgtgagaacagagtaatatattccctcttatcgaatgacttctacacagtgtgaatgagatcagattcctcttcagtgcggaagaaaactagacctcttggtcctgtgttcagggcctttctcgggctccaaggccctcgttgtgactgtccactgtccatgcacgtgcactttttttctttctgaccatgcatcttcactcagggccgcctttcaccttgcttttcctgactgttctctctgcctactgcctagaatgtttttttcccatctctacgcagggaacatctatacatttctcaagatctggagttcagtttgtcacccgtgaggagcctccttccacttcgcctttgctaatccatcctgtcttttgtgcactcatgcagcatgtcacgcagacctttgttaaaggtcttatcaaatggtatttgacagtacaggtctatttctctatgagactacccgttgttcaaagcggcaagctaccaacctgatctcattcatctttgcatccttcatgctgattatagtgatyggctgttctcaattaatgaatggaagaattaatggataagtggataaatcacttaataaatcagaaatcttttagactttgctgctcttcctcgaagcataattctggttagaggtcacgtagtaaatatattcagggggttctacttcttcatcttccagggagaattgtcgcttttctcattcaacttttcagcttattgtacccccgctttgtaccccacctcactcccagcttctagatacctgaggtttggcgacccagctacgagactgtcccttccttccaccacctgatagtgcaaaaytgggacaaagtcatcattaggcagcgtagttagtagcaagatattagaagtcctcagaatagcatttgcgttttcatatactactttgttaaccctatgcaaaaataatccaagatagaattttagtagatttatttccacagagaccaagatagttttcttggtggccgtcataactgtttgatgtaactaaaaataaaactagccctgactgctaataactcaaaaccggtggagattagagcaagggaaatgtggttaattcaactccagcttgctttgacctgaatttatgccaactgggacttttgcctgaattattcgggaaaatgccctgagctgcccmttaattcatcttgtacgtttggtctcttacatattgaaaaagtgtgttctatgattcttttccatatagctaatgtcatcttgaccaggtcagagttcctccaagttgtttttaacatacaaatttatcacatcacgtttcatcatgcctgctcccaatggtcatgagttattgaatttgtataggagagttaatttgtaatgtccttgaggtaycatttttcactattggcctatgttggccacctttgtttacatttagttcagaaagcactaatttaagaagtgtcaggttgtaacaaaacataagatcaatgcagttagtttctgttcagactttaacaacttggtatctgtcaactgaagcatgaacatagatatgggcaaaacccaattaatacacagttgtaatcacagtgggacttagtggtactttctcctttgcacagtgggactcttagaagtggcttcattaatgttgcatttgtagtttgagttctgctcttcttctcatattgcctagttctgggcctccctgtcctctgtcctgtggccacttttccatgtggggacttttggggcctgatggctttttggtacctctgctgtyctgctagctgccaagaactctccattactccmcctttgattgcttgggacacatttttaaataaagcagctttgggccacagcgacaaaaagtgtagagccatctttttgttttgcagcctctatttctgttttgaacaggtcttttcaaatcaagcggtaggagctatacctctcccagatgaggcccatcacacactctcactaagtaggcaatttctttggggtgataaaaatgattacaaatatttgaattggaatcgttgggaatctcattaaaaacaacaaccatgatcaggtgacattgtatttgtgaatatcctcagggtatgttcagaaaatcagtgttataagagcttgaacgattatattagtttagcttgatagtgctctgtttcttttctctttacacttgcatggcataatatattaataaaaattaagaaatttttagtgaaaccaatgaatttgctttcagaaaacagcattttacaatatctattgggtaattatatcaaatactcgattccatgkttkctggtattggataaatgactaaatttgtaattaaacacatcttttggactaaagttactaaacagatagttgagtcaattacataacagcaatgggcattacattagattttatcacaacagtaattactgtgtgatgttagattctattttgaattgctctttctaaagatgggttatcagcaacagaatatgcattgggcttttatgagcggtctttgcactactcatatctgataagggccaaatcctatgataagaggtcagagactggtctggcagtaaagagccttcattaaattatttttaatagtaagcatttattgaagcttattacgttagaacctgaagagtcacagacatgtaaccttccccatgccttctggggtccttgctctaatttgggagatacaacacatagagaaaaaggtacatgaggcagccttgccacyggaagaaaatggcactcaaattcccagctgtcatctgggaaaggtcaattgttttctttacaaagccaccttcatagcaagactttatccatgtcagcagtctagaatgtcgtcatctttatagactcagaagcttgatttggtgtctatattcagaggttatttctatctcagggatagtattttactaatcaaatacataacagatatatacataaaccagaatgaaaacatattatagtgagaaatgtaattattgattgaactggatatttgtsttttcatgtcaacttattcattcagagcaggtgtgggaaaacaaattttagtcatgaaccgggttggaaagtattaaaaacgaggatttggtcatcttaacaaagtgtttctcagctacagtttcttcccaacagagtgggagctaacaataggaataacaatcagagccataatctctaagggcttcactgtttaccaggaattatactatgcccttagcatgtattatctcatttaactcccatgataacttttcatacaggtattattgttgcccctgtgagcaggaggagaagattgaaaaaaatcaataactaccccaagttgtgtagctaggacatagcatcaaggattccaagccaaggattatctgacttctgtttataaactatttttcttttagaattttttcctttcttttctaaaattgacataaaattgtagtttttactgtgtacgacatgatattttaaagtatctatacattgtggaatgattaaatctagctaatgaacatatgcattatgtcacagttactatttttgtgttaagaatattttacattcactcttttagcatttttaggaatacaatatattgttattcattgtagttgccatattggacaatagttctcttgagcttatttttcctatccaattgaaatgttctatcttttggccaacatctccctaacaactcccaattccctgcaaccaccccagcccctggcaaccaccattctactcactacttctgtgagctcaacattttagcattcacatgggaatgagactatgtggtatttgccttgctgtgcttgagttacttaacataatgtcctccaggttcatccatgttgtcactartgataagatttcctgtctcatataatatatacatatatatgtgtatgtgtgtgtgtgtgtatatatatatatatgtgatattcatgtattgatggacatttaggaacaaattgaacaagggaagtgaatgatctttacactgaaaactataaaacactgataaaagaaattgaagaaaacaaaaataaatggaaagacatcccatgttcgtggattgccggaataatattgttaaaatgcccgtactacccaaaatgatccacagattcaacataatctatattaaaatatcaatgacattattcacagaactaggaaaaatcatcctaaaaatcatatgaaaccacaaaagaccatggatagccaaagtaatcttgagcaaagagaacaaagctgtaggtatcacactacctgacttcaaagtatactacaaagctgtaacaaccaaaacagcatggtactgttataacaacagacacatagaccaattgaacagaatagaaaacccagaaataaactcatgcatctatggccaactaatttccagcatagttatcaagaacacacaatgggggaaaaaaactcttcaataaatggcatttgggaaaccgcatatccatatgcagaagaatgaaattggactcctatctgacaccatatataaaaatcaactcaaaatgaaataaagatttaaatgtaggacttgaaactatgaaacaactggaagaaaacatagggaaaagttccatgacattggtctaggcaaggattttttggacataacctcaaaagcacaggcaacaaaagcaaaaataaaatgattatatcaactaaaaaacttctgcacagcaaatgaaacaacagggtaaaaagacaacctatggaattaaaagaaaatatttgcaaactgtacatctgataaaatagaaaaaacaatgaataattgaaaaatgggaaaaggaactgaatagacatttttctaaagaagacataaaaatggccagcaggcrtatttttaaaatgctcaacatcactaataatagaaatgcaaattaaaaccacaatgagatatcacctcataccygttaatatggctgttatcaaaaagataaaatataaatgttggcaaggatgtggagaaatgaggaacccttgcccactgttgatgggaatgtaagtacagctataatggaaaatagtatagagattcctcaaaaatttaaaagtagaactatcatatgattcaacaatctcactagggttatatatccaaagaaaataacatcaatatgtcaaagagatgtctgcacttctgtatgtattgcagcagtgttcacaatagccaagatatggaatcaacctaaaaattcatcagtggatcaatggatcaatggataaactatttttaattgaaagaattaaaattgtatctttatgagcctattgatgtttcmgagaaataaactctggtcattgaatgaaatctctgtgttgcagaaacctctataagctcctatgtacagataatctcacagggtaaatttctctgactagctttccacattcttagcattcttttctcagagaacatgtgtatagtccttgtatagggccataattttcagatacacttttcccactcttctttgtgcttctctgtcctyagttgcttttctcatttaatctttataatttccctgtgatttaaattatactttcattttacagatgagaaaattgagacacttatattcacatatcccactctaggtcagtcagtagcagagtcggatgatgcattctgttgttagtgcctggmcaattaagtaccaagaaatgctattgattataggagttcatggtagggaagaataaggctgataagtaatgagtatagtttaagggcagacgtatttggaaaggggagaggcataagacaggagactaggaaatggtagacctctgtagtttattagtaatgtctgcctcggagtgacttggaggatgtggtaataaaagcatctgcatgtacccttgtggctataagtttcagttaattagtacaacacaagtacacacacacacacataagtggatctcagccatctagatgggacacagagtttttatgacaggcagggttaatgatttcataatggtgaacttttgccaatctcactactatttgaatatttcacaacttgttcaaattgttaagtacaacarcagattgcatgtacacccaataacacgggtttatgtaatgtacatgggtaaatgtacatcttccaagggagaaagggtgctctgtgtttccagcatgatggaacycagtttcaygatggattggcatattccatagatgaagaataattactggaaagaatgcagagccattggggactttctaaatagaggaatgatgagataagatatttgtttgggaaatygctctgaagaagatggaatgaaggagagagggacttctggaaggctgtggatctattttcattttaataagcatggggggagaagggtaggagagaggatggtcaacaggtacaaagctacagtcacataggaggaataagctctggtgttctattgcataatagggtgactatagttttcattattatattgtgtatctgaaaatagctagaagggaggattttgaatgctctcaacacaaagaaatggcaagtgtttgagatgatggatatgctaattacctggatttgatcattatacaatgtatacatgtaccaaaagctcacattgtaccacataaattattaatacaataattgtacgtcaattattatgtgtcaattaaaaaaacaaaacttaaaaaatagtactaatgggaggtgaagaaggtgtgaataagggcagaaagactgagtgggacgcaagtgaatgtaacaaatgctgttctcaaatagctctaacttatctctcatgcaccagagcactcttgtttctcactgaacactttttgaatgcctctttcatgttgggcttgggcacygttctcagtggtctttgtagttagatgtttttgccaaaatgttggaaagagtccttgatatatggaaactgacaaagacataacttcaaccagtcaaggagatttcagtgtcagataaggctttgatgtgaacatgcctggcacatagatggttaatatatatcctatggatgaagaaacatacaaatgaccaaaggaatggaataggtagactaatcgaaggacattcaagatagacttctaaatgcccgaaacttttcaaagtgagatccagacctttcttgaggaatgatgtttctctactctgatctgtacagttggtgaaaataagaaagaagatggaacccagcacggcagctcacacttgtaatcacagcactttaggaggccgaggcaggaggattgcttgagcccaggagttctagaccagcctaggtaacatggcaaaaccttgtttctacaaaaaaaaaaaaaaaagaaaaagaaaaagaaaaaaagaaaaaaaaattagccaggtgcaggggtacgtgcctgtggttccagctactcaggaggctgaggcgggaggaaagcttgagcccaagaggtcgaggctgtagcgagcaatgatcgccccactgcactccaggctgggtgagagagcaaggccgtgtcaacacaagacgagacaaaatgagatgagacgagakgagaaaagaaaaagaaaagggaagaagtgagggagggaacatcagtgcaggtaaaatattatttttcttagaatgaaaccaagccagcaagaataataacttttgaaagcagtatttctccctgtgtagcccttagacaataggcatcaaaatttcttgagtgtatgtgacggattcctaggccctacctcaagcctgcaaaaataatctctcacagagagaaagggaactttaagcaagctcctcatttccttttgctgcagtaaaaatttctaagaatcagtgggttagagcttcctaagcacttaaaaactccaagaagtaaggacctgttattagaggtaacaagtataggctaatttgatttccttagaaaaccttcaaaacagcagtgtcacagaatcactcttgattaaccactggacttggaaaggcctaaggttgagaggctcagatggccccagmgtaaaagccctcagtatgcctgcttcactgagcattacatgagactgttccagctctgtgatgatcaaataagaaaagcttgtgaggattttcactcttcacaatgtgatgtcttttccaataacagcattaatagagaagtgttatctttagggcatcttccttgctttatgtattttgcaataaatttatataatttttactgtttctgagtgtaaaagtaatgcatgcttgttttaaaaattataaaatactataaagcatgagtaaaaataaccaatattcctaccaccaaaagataagcaatgtcagtatatctcctttcagacatttttagtatgtacatatgcatataattttaccaaaatagaatcataccatatacactgttttgcaacctgttttatctaatctgaatggagataatatctttctgaatcatgtatattttcattttttaatggctggagaagataccacagtgtggatgtttctctttgttttattattcccttattttggatgcttgcttggattgtttatcaggccatgaaaaaaaaaaaaaagatgaattccccagaacattataaggaaatctagggaaagacagcastaccttaccttaaactttctggctcatgtcacaaatcagtaggtttggactcctcatgcttgcagcacatacactcttgctatcctcattctctctaggaaccaccattcttcccccaagtctccatcactcatctgcttttccgtggcatgtcattcatcctcactagagatcatcttacttccctcgattattctttgttcattccacataagtgtattgagtacctcctctgtgtaggaattttaaaagaccctagctttatttagtgtttgttaaagcatctcttaacctcctctcattaaggatacagattcatgataaaaaccaaacaccttgaccaaaaggctaacttggaaaatgccagttgttattactgcaatctcaagtaatgaaaattcatggagtttatataagttattgcagcataacactttatcccaacacttagtggctgaaaacagtacataatgatgagctcacagcttagtgagatcaggcgtctcctcatggcttagctctgctggaggcctcaggctgtaatcacgatgctgaccagggctacaatcatcccaaattcagatgagggcaaggtctacctgcaagctcacttgattgttaacagaattgagttcctcataagttgtcaaatgagagcctcagtttcgtcacaggagtaatatcccatcacttttgccatattctgttcattagatgcaagtcactagttttagcccatactcaaagggaagagattacccaagagggtgagtaccaggaagctgggatcattaaagaccatctttgaagtcaaggatatgctcatagagctgatagacagtgataaaacctcagcaactgaccagaaaaggtcaacttagaaaatgagattttgtagtttaaactcctggaaattcatagatcataacatttcaacttacttttaasttgagtgacatgaagagataggtcaaaatatttacatttgctaaatgtgtacttactgttctttatatagagctttgcagcttacaacatacagttctstgtcaatattttcatttgattttctcaaacctggaagggaggaatggaagatgttatctcaaatttaaagacaaatgaactgagacctgacaagttaccagctgagtaggttacatctttctgccagttcatgtgttggttcaacaaacgtatacaaacaaatcttatgtgcttggcaccatgccaggcagggtctggggacgcagtgttggacaacatgaatgtagttctgccctcccagaacctagtatcttgtcaagatgagacgttaatccaattaaatcttacataaaataagactgcaaactttaatattttctaatggttgaaaaggttatagatcatgatttatgcagtttatatatgcaggtttacatattttaaaattatccagctgcattcttaagatttgtacattttactgtgtatgtgatgtttttagaacatcctgggaaggaaagctacatagcgctaaggtagttcgttaaagaagacgtggctgagagccaggaaacagggatttagatttcctcttcaccaagtggcacatgtgtcctgaaaatgttaaactgtgggcatttttaatattgcacatgttgaactgatacatataactttctggggttttttttttttttttttttttttttttgagacagagcctcactctgtggtccagactggagtgcagtggcacgatctcagctcactgcaacctctgcctccggggttcgagccattctcctgcctcagcctcccaagtagctgggactacaggcgcccaccaccacgcccggctaattttttgtatttttagtagagatggggtttcactgtgttagccaagatggtctcgatctcctgacctcatgatccgcccgcctcagcctcccaaagtgcagggattacaggcgtgagccaccgcacctggtcagggttttatttcagaaccgtttatttccccagtacatttatccactctacctccctctctgtgattttccattttcaggctgtgccgtgctggttttacccagcaccttgtttaatgatggagctcatcatttcggagtttttctctccgtgatgctgccacatgtgtcagggctgtgtggctgttacagaggaagggtctcgtggggagggagcagtgaaactggtggagcaagcaaggtcggacygacagactatcttctcggatgtaagagaggttgttctagggaagccgtgttcctggcgctgggaggctttacgaagagtttttgaaatctccagcttgaacgttagtgtaccttattatggctatacttggtctcaggatgccttctgccctcttattttttccttctttgatgttcaaaaatttacatcatttcctgtaatttttttttctgtaaagttttggcagacacagagtcaccactattcattttacaaaaatacatttatgcttaatttaaagaaataggcagggagaggggtgctctggttcttgttttctggcagatacttaagaaaattggaagaaatcactttgaaagatcaatgagacttcaataaagtaaatttaagaaaaaaaaaaaagagttaaggaatgaagtaaaacttgctagggttaaaatcccagctagtccattccttacctttcttacctgaaaaatgaaagtggggatcgtccttasctcatgttgttgtgagtactacgtgatgtaacacacagagaatgcttaacagagttctcagtgtagagtaagctaacaaagttgacagctgttggcctcatgacatcatagaaaatgtgcctaacctaaagtcagaatccctaattttaagcccygcttttacttcccggatattcatcctttattggttacttttaacctcctgttgcttcagttttctaaatctgtaaaagggaatgtaatactgacattatagataattccatggcaatcaaatcatggaaaatatgtagaagttcttggcacagaatagcagctctgtaaatattagtcgaatctgacttgtaacattaccaggacccaacatttatgtcaagaaggcatttttcacactgcacaaatggggctccttatattctagaaaataaatatcatgaaagtcacaacataaatgtcctctcacttcttatcccttaattcagagctattcaacaaagtcaattttgggaaaatgttgcaaacatctgatatttaccaggaattaggggagaaacagtggatactaccatggttcctgcttttaaggagctcatagtctaagagtggagtcagataagtcaayaagattacaaaataaatgccagaagaggaaaaagtgggagacgccaaggaggcaaggagggacaccaagcccagccacaataagagtgggaatgtcagagcaggtgacacagtgaggttgctttagcttcatgtgacagatatctctaactcagactgatctaaacttcagtgagaaaataaatttcatcaaactgggaggtcagaggaagggcagacttccaggtgcagtcactacagttgctcaaaaatctcatcaaggtattcggttcttttcatgtctctgatctatcatggctgctgtcatttccagtccaacagtagctctgtttcagtatcatgatggctccagcaattgcccacatgatggcatcagagagacaaggggcatctcttttatctgtcatctttgggaggagaaggaaggaaaagagaatttcctatgttcttttcagcatgggccagtgttggggccaagggaaagcttccccttcaccttccgaaggttcaccttctgccctctgaaaaagaactaatgttaggaagatgaataggagaaaaggcacacaaatttatttaatgtgtattagcctagaaaatcaaaggaggatgatcacgcaataacccagtaggtccagatgcttatacaactttcttcattggggaakgagagattgagtcaatgtgtctgtcaatttgaaggggagtaaataacttttagggggaatgaataagcccagtgctgagacaatggttagtaaataatgttctctttgggaattgaacaggattggagacaaagtttgtctgggctgtaggtgtgatgtttaatttccaggctctttgtcataataggagttttaatcttctggttaatgaagttacagggagggggttgaaggccatttgttccttttgctgggtatggtttgtaggtagataaggaaacttcaacgaacagccttatcctgtgctttgggagtgaaaggtgattgaaagatgaaggaatagggggaaggtcagagaaaccttgaggctactgcttcagtttagcatatctcaaagagccatattttggagtgttgtgttctgatccccaataccagaattaaatcatctacccacccttaaactacaccttggcaagggcacaggattctcatgacaggcttagtggggcatcttgggtgacaggtgcattgaggggttgacctccacaatgaccagggaaggttttcccaggggatctcagactttgcctatctgataggatgaattgggctttttctagtctctatgtgttagaggtagacagagaaacatcccagggtgtgcaatggtattgagcataaaatattttaattattcatggaattccaagtacttttatttgactagactatgggggtagcgcagagtccaaactagtaataggagataaggctggagaggtaggtgagggctggattatgaagactcttaccagccataagaaatgtgggttttatcccacagaaactgggaacacgctgaaatatttgaagctgagaagtacatgaaattggatgtgtcagttccatcttgaaccatccactaaatggaaaggggagtgaggcaagattggaatcttgggaaaaaagactgtgttggtaattttagaaggagtctgaatgggaccatatagctggttaagtgggtgggttggggaatgagaaggagctcaaggtgattattctgtttttttttctgggattttcaagcttccctagaagtctacataaaaatagatatgggaaaatcagaatctaagagctggctactcagatttgatgtagttaatacagaatgactatcaaataatagatatttgtcctcgatacatatgggatcttggccagctggataaataaatgagtattgttttaataaatgcccattggaacaggttctttactgaaaggaggaataatgataatattgtgttgtacgagagagtgtggatgagatatttataagcaaggcattcagcaggtgtcctgtgggttaatagtctgggagtaaattcatgttcatgtcatgtaataaccttggtgaagctgctagtaagagtgaattaggcttcagtagcaaactctctccctctctcccccacctttcctctctctgtctctctcccgtatgtgtgtgtgtagtgtgtagtttattaagtctttaagtattttattcatagcagaactttcccacttttcatattttacaaaggagcattttatttaagctccaagtatgtgtaattgcaatgagccatatacgcattccccacagaccgggaagctttgccacctaaaacagaatgctctcaatgtaagcccaggtgagagttctaaggggctgtcctggggggactctcctgctctgaagggggccatcctggtctaggggagctgtcctggtttgggagttggtggggctctccttgtctgagagctgactcatttgtaggcatcctcatttcagtgtcagaaggactgtcctgctgttgatgacttcactttacttaagcatggttcaatcagaagcaggggagtgaggaaattccttaacatatttatcaacatstgtttctaggcatccagctatgtacaggaaggaactgttgaccacagaaagcatcctgcttgggcatttctgtgcaatgtctctttgctggaaggaccatttttaatctacccgtgtagccagtatgtcctgaggtttccattctaatcccaaaatatgtatatgtcatggcacttttggagggttttgtctttctttgtacagcgttgcggtattatcataagaaaagtctagaagttgsaattatatcttccaagttggcatcccagttcttccacgtagcagctataaccttgatgcagtggaatacaggcgacatggcatgtgacttggagccagatgggagtttgtatcttagtgctgccaattaatagccatgtgatcccgggggcaaatgatgttccattttctttcatctgtacaatgggattaatactacttaccttaggatgttggtgaacagatattatactgtaaagctacctagtaggaggccaaacgcataatagatactcaataarttgtagctgtcgcaattattgacctcctggactctgtgtcctaatctacaacataggaataatgacagtgcctaacttgcaggtttggtgtgaacaatacagtgatcattctaatctagaacagggtttctcaatctcattcttggcactattttcatttgaggctgccctgtgcactacagaatattcagcagcatccctttmctgcaccccctagatgggtgtagatrcctgtagcattctgcagcccaggttgtaataaccaaaaatgtctcccgacattgccaaatattccctggctggggaaggtggggagctaacgttgtcactggttgagaactactgttccaacatatagaagaaagtattctataaacaagggtaggtaccgtatctgtgctatggtttggaggtggtttgttctggttcccaccaaggcttatgtagaaattggatccccagtgtgggggtgtcgggagcggggaggctagcaggaggtgtttggcttataggggcagatgtctcacaaatgctgttctggagtttgagtgagttcttgcttttgagagcccagattcattcttgtggggatggattaactcccctgaaaggaggctgttataaagcaggatgccccttgggtttcattcccttggcatgtgcccacttcccctttgactttctctaccttgttgtgacagctcaaaagtcctccctagaagtcagcgccgaatccttgaacttctcagcctgcaaacctgagctaaattataataattctgtaattattcatggaattccaagtacttttatttgactagactataggggtagcacagagtccaaactagtgataggagattaggctggaggggtaggtgagggctggattatgaggactcttgcaagccatgataagaaatgtgggttgtatcccacagaaactgggaacccaccaaaatatttgaagctgggaagcacatgaaattggaaattagactcttctttggaaattacccagtctcaggtatacttatagcaacacgaaatgggctaagacaatcagacctatccgtaaagttgtggaaagaaatgcagacaggaaaaagaaaatcatgtttgtttcctgagcctctagatagtaatgcatacatgagaatagtggaacaaattaaacctctttcggcatgaataagctcttcaaagttcagctccacatataagctacagttgggtggggctgtcaattttcaggaaaaacttgtggtaacaacacagggtttgcagtcacttctgctataagccatggtgtcctgggaatgtaagtggtaacgcctgttccctacccccgtggctgaggaacaccagccctgccctattcctctgtgggkgattgtggcgataattctagttccctggaaagcacacatctgagattcagcatgatgtatcttatccccagcacgattattttccccctcattttttcttaagcccttctcctgggaagataaaggtcaacttaaacctgagctccaggcagtgctacctcacttcctcttcactgatcaaatcttaaagcaacaggaatgttccagaattcctctaagtgaattgcacttgtctgtagttgtgtgggcagttctgaagtagctctcacctcacattttaaggcaattttactaataggagcaccaaatccttcagggccaggaaagctctatttaaccatgaatttcctcccttggggtttcgttatgtttggttacaaagtaaaataaacccacactgcttcagagtctggagaggcacaggggcatgatttagctatgttaataatagaaattgaaaagtattttaaaagataacacaccacctgtgccttcttttgattgtgagactaaatgaagaagaaattttttccccggaaatgttactgctctgaacagcattttagcactattatcccatgataacatcagagcgggggagtaattatttgccggtaatatgcgtgctgccgttagctgaatatggcagcacttccatgctgagatctatgaagtatagattatacatttccatgctcattcaaaatatgtattttttatgattgaygaggacattgcagcatgccaccttcataatttgcatttttaaatggttctgtgtgtaaatcattggcgtgtattacctcaatcagaagccaaataactaattgtaaaagctctaaaatatgcttttcttaaatatgttgtgcgggaatcagagataaatataccttaacacatttttatatttcattactattcaatatattttttttgttgttctaacraagaaaacctccagcttttataataccattaccgtcaaattaaagactagccttcatctttccaaacatatattttgtgctttgctcaaagccaggaatgacctggctcatgaaggggttcattagcaagawgcttgaaggaaaggaaaaatttgctagttgmtcgagaaaatataaatgatgaggctaaactcatatttgagatgttctagattttcctggtgagatttcaaggtccaacacaggattctaatattctcagaagatctcctacatgaattccttcaaacttgagaaytacatttactctccacacaaagggagtaggaatttttcagtataaggcaaatggcaacaaaaacacactagagattacaaagccaacgtcactattatttttaaaaggctttatgaaaacattagtgctgagcctgggtgatttatggcacaratccatggaaagaacctttcctaagcccacatttcagctagggctttgcctgggagaaaaaaggaarcccttgcttctggaaggctcccctcaccgccgtctccatatgtgggaagttcagagctgaggtaaaatgaggaaggagaatcaagacmctggaaacatatgcccaagagggagcctgagaatctttgcagaagttgaagttgaaacagaagtttactaagatgctgaaacttaaagaatgaaaaccatcaactagmagagagtaggggattcgggaagcctccaaagaattcacaagaacattcagatgaagggaaagagggcaccaggtcacactgggttggttgccgagggaaatccctccccttgtgtcctaaatcattcccttgtcaccttgttatgcctcagtcctcagaaccactccttactgtggcttggtgcttgtccctccatatcgtaactctgttttatattcttttgactttcctgtttcttctgcatgtacatgagcctcattagcattgagcttgtgtctgttttgtttgcagcgttataccgagtgcttgcctaccagtgggctccaaagggatttttgcaatgactaaggtggaaattgaatttgggagtactgggatctttgggaaaagatctatatcgaagtcagatttatatggtgagagcactgtcttcagcagatgtcctttgagggtccaggtcagtctctggaggcactcccctctctcccttcttttttttttgagacagaatcttactctgtcacccaggctggagtgcagtggcatgatctcggctcactgcaaccttctgcctcccagcttccagcaattctcctgcctcagcctcctgaggagstgggattacaggcgagtgccgccacgcccagctcatttttgtatttttagtgaagatggggtttcaccatgttggtcaggctgatctcgaactcctgacctcgtgatccacccaccttggcctccccaagtgctgggattacaggcgtgagccgccrcgcccagccccctccttctgaaacttggaatgtcctgttgcaatccttagagcacctgtactcagggtatggaagcactcatgaggacatgagcctcagccttctggaaaagaggacttttcgcttgctataactcccatgggattttttttttttttaactttgtctttgtggacttcagaagtccttccagacaaatggctgctttatttgtgaggtagtgatttatatccctggcagaataatcctgggtgaaagtggctctccstcascataaaggaatagcaaaacatttatgaaagggagacagagcttcagatgagtgggtacaaaagttccgcacaatatcaatggttgaaagaatatgcatatattaattaataattccgacatacttcttttataaggtcccttatgaaagatagactattttccacatttactktgcattggaagtgacagatgaaattaatatgcttcataaattgccatcacagagggtcaattaacaagtgaactaaccttgtgaaagtcattttgaaagactagttatgtctgtaatattccctgtcaaattaggtaaaagtgggaaaattagatgcctgtcaaataaatagcagtctaagatacggagtaattgcatttttgataaggtaaattagtttctgtgattgttgcttgagaacagaaaatgagtagtggaaatagtaaagatctgaaaattctgtgtgtgggtacatgtgtgcacatacatacaaatatatgtaacagatgcatatttgtgtggatgtacacacatacgtacagagaggcagagaggagaacactgaagattcaaattggaagtaagacaggtccacactccttagctaaaccatcacctcctcttccaccaaggctattgccttttaggtccttcacacgtacctggccagctcccacctttctgcctttgctcacttggcttcctttttagttatgtctgcctctacttcattccatcaaaatgaaccctggtgcttgtacaatgggttggacagtgtttgggccatgcatggaccagcacaatagtgtctgctgccctagagctaaaattccctccaggagagaacaataacctaggaccctgaagctgagattcttgcaggtgacttgcttctgcctgcaaaaggactagagaaaggaaccctcctaacaaacccaactgagccagtttggaggctgaaggaattaatgtagcagtcagatcacatggctgttttcacccaatccacctgacaggaagttccagaaagaccacacaacacacacaaagtactcccacataaaggttatcctcttccaggacagatgtggtgggagcctccccacttccttcctgatgtaaaagttccatatggagttttactgctctcctgctcctctgacgtctcggttctgttcttcaaaactctgccatgtctgtgatgaaattaaatccctgactgggtctcaagttcctacttgtcatatgaatcagtagagcttaaaattcatctgaagtcttggttgtctgtccccattcctccatgacctcctttggggcttggagcaagtcaacttcttatcaggatgtgtgtcccggtgtgtgaaaggaggctgctttgcagcaaggagattgttaaaaaaaaaaaattaaaaagtaaaagtcgttatatttttgtgtataccagagcccagctacacatatgtaatgtagagaaaatactttctctccaatcctttttcttcctctgagttttctccttataccttttaattgtcagcgaattcccaaaggcatatgtactgaatctgcatgtggattttgtatatacatatatattcacaaatgcatatgctatgatttgtgattcccattttacagagtttaaaactgagtctcagtgaggggaagtaaactgcatgcagttcatgcagttactaacaacgtgccttgttgttctgtacatagcataggaggttgaacccaattagtctgactcaaggcttgtactctctatgatatccagaacgctcttttcttcaaagccaattttattccagcttggacaaattctacgcatcttcctaataaaagaagaaccttgccaggtgcagtggctcacgcctgtaatcccagcactttgggaggccaaggcgggtggatcacctgaggttaggatttcgagaccaacctgaccaaaatggagaaaccccgtctctactgaaaatacaaaattagccaggcgtggtggtgcatgcctgtaatcccagctctcgggaggctgcggcaggagaatcacttgaacccgggaggcggaagttgcagtgagctgagattgtgcattgcactccagcctgggcaataaaactccatctcmaaaaaaaaaaaaaaaaaaaagaatcttgggagacagtgtgcctccacttttttgtctattggttgtattacaagttctttttcattttctgcccttgattgcacaatctccttctctccctggtctgcccagtgcagacagatacagatgagccggctcagtctgtgtccatacagatgcggaccagctcacagtactgctcttatgtgagctgctcagagttctgtgattgaaggacagggaaaaactgccaactaaagcaatagaatcattggatggacactggccatattttgcaaatctaaaagctgacagctgggtctcagaaaggacaggagcaagttcagttctggggatcccagcgagcatactgtctcttaggcagaaccaatggaataagtcctctccaaccaccttcaattcatgtgccctttgtttcttggttcctgttgccaggagagagcttctgattggcttaggttgtawcataaggccacccttcttgggcaggtttggaggaaacaacactgtgactgacacccctgccaggtctacagggaaacacagagaggtaatggccaaagataagcagaatgctgctgatgttagaagagggacaggaaagctagcaagtcacaatctataggcatctcccacaccatgtaattacataaaataaaaccacaaaagctcaatcacttgtctcttgcctccaaacctaaattgcaaatctccatgcaaaagtcagcaaaaataaaggcagcagcttgtgagtgtggggaaggccaggagaatttgacctcagaaaatctgcacttaaatcccagtcctggcaccatagctgtgttgccttggtattagatacaccattccaaagcccgctgtaaagcataagttttcccagtgcttgcagggagtcactagaaggatcacatgagatgcagcttctacaagtgcatggggaatcagcacccactcagctgaatctgctgtagaaaggattggcaycagggttgcagatagcaagtgaagctcatgcacatgctcatgagtttgcaaactgttttaaacacttgtaaaaatctctcctgagccatttatttaagtagagctgggaacattgaataaatgacagccctttcttaagggggagtctttgaattctgagtgactggcagatttcacagccattgatattttgaaaggtgcattggtgacttgaaatccttgagagcagttatctttgaaattgtggattctgcaaatgtagatattgatatccaactcaatatatgcagctttctctatataccattcagcatatgttagccatctgtcataagcatcatgcccctaaactttcagctatccagaaatctaacaactgccttttcagtaaggttactctgtgctaataattgaataaagcaatataagattcagccaaatagagtgtgtctgccatttttagaggttctcaacccaaagttgaagggccccaggccatggtagatttttaaaagaaattttgacatgggcagtgccaataaatgactctcaagaacccttaccattgtaaaaaaaaaaaaaaaaaaaaaaagggaggtccttggtattaccaatttaaaatgtgagcattctagagggacaaaacctataatgaattacaattgccttttttcccattattttagttaatgttgttaaacaatagtgtctggaattggctaaggaagaacagttacttgaaatatgtgctgttttgaataaactgatcctgtcttaatgagcttttatagggttttatgcatgacttactacccatattacattgctaaggtaacctacttaaaactgtggtgcaatatgatgtttttcagttcatttgtctgtttcattaatgatggaatgtattttccagcacrcaaatcctatttatgatcaagacattgttgttctgtatatcaacttaaactcttacactgtgtaatttacctgctgtcaaatctcatttgaagagctgttgtctagcattgctctaatcaaaaatatgccccactgtaatgagctatgcatgttgtgtctagtattatttatttttaataaactttattcactcccaacacactttgggaaacggacaatctataatatcttctctcttcttcttcttttttaaccaactatctttccagctagggtgatgattcacaaaaatgtgatttttttttctttcaaatgtgtcttaatgggtaacagctgattagataaatgtacaggagaaatataaaaataatttggtatttaaaacaagactaatcattaataagacaagcagttttctaaactaaaatggctagaataatatgtgaaattagacttccaggacagagcaccctctgtgatttgaggagcccagctcattcattaaatatgatcaatatgcctcatcatggaaagactattccctgagatggcatgtcagtgtgttaaaaaaaaatacggtatttttttcatctacactctgtaaagacaagcccacaacttcatatggggctcagctgaaggtcagccatctcttccracacaagaaaagaaaatggcggtgttggacttaatgagacatgattctgtactatacttaataggcgattttactgatttcatgggtacatcatgctgtagttttctctttacatgttgactttacattccaaattccacattaggtgcaacttcattctaagagctttgggatgcttgtatgtgaaacaggttttatgcgcagctcttttccaacctattcttctttagtcagtggttcctgtgggttcttgggcctttgccttcctgtcttcagcctcttctctgagcagtgtgatatagccttgaaaagacttgggaggtgggcagaacggagtttgaatcctggctccaccctgtgtgactttggacaaggcacttatattcaactacaaaagggtcacccatgctgacgttacaaagtgatagtgaggaataacagagttacagaatgcagaagaacaaccagcacaatagtagcctgtctgtgtatgatgcttataattgtgatcatcatttatcctaagctcatatgtggaagcccacataagtatggcgtcttaccagtaractccgctgaatccgaggaagggccttaggccttctggcaaggtaacattcagagtgctgagaatgctgctgcaagtggaatttacttatcagaaggtcagttaattccactaaactctgatgtcatatctagcttgtacaggaggcaaacaaacaaatgctaaacagtagtgcagaaccttggagttaactgtgtgcacatttaaacctcacctccaaccccactgtgtgtacagtaattatttccagtgaaatcactgctttctttccgtgaatgactaactggtgatgatattgtctggtatgatagtaactgcataagacctataggcacatagttcatcaccaatttgtgctttgtgcaatatttgcttcgggggaaaaataaaagaatcaccaaatatgttacaaactctggatttaaaaaaaaaaaacagctctaagaaaatttttawtttttttagtgtgttctcgctatcttggagttatttctagtcatcgggatcttgcatgatttaaacaaggcccttaggtgaccatcaatttatatctaaattattagtgtgcttgttayagtgggtgaatgttctttcagttcatttgctcattcaccaccaggattctacaccaggaactatgctaggttctagtgttatagggaggttaatatatgggagtatatattgaaacacattgtattagttgattttcacactgctctgagaaatatccaaataacccaaattactgggtaatttataaaggaaagaggtttaattgactcacagttctgcagggcttaggaggcctcaggaagcttacaatcatggtggaaggggaaggaaacacgtccttcacatggtggcaggagagagaagtgcagagagaaaaggggaagagcccctgataaagccatcagatctcatgagaactcactgactatcacaagaagagcatgggggaaccacccccatgatctgatcacctcccacgaggtccctccccaaacacgtggggattacaattcggatttcaattcaaggtgagatttaggtgtgtgacacagaggcagaccatatcacacatacacacacatactgaataattgctaccgtaattgatacactggcctagtggagggggaatctagtttgaactatttcatatgtgtcacgagcctggatttccagcatcataaactgggagaaacggggagcgatgcaaaagacagtcagtgctaccgctagagctggagatcagcatggtgggggatgctggctcctaaagcagaagtggggcaaatgtagggtagttggatgcagtcacagatgtgctagggaatgtggtctagggagcacagtagtgagtgctgctgagggtggtaaggggttaatgctgcaggagagaggtgagatgcgtcacaggcagctcattatctgatgcagtctatgcagagtttaatgttagaaataccagctgcgagtgcccacactctgcatggcattctgtaatgcatttgattttactcctcacagctaagatattagttgggttacttttgctgtaaaacaaacaacttcaaaatcacactggcctaaaacaacagatatttatgcttgtcttccacatgtatgttgatcagctgagcttcatctgggctgggctgggctgggctgggctccaggctgatctgggttctggtggattccacggcttcgcctttcttcttgaacaagcggctacccatctatgagaacatagcagaggggttcctaacctgggctttgatggccccctgggattatttggcaatgtctgcagacatttctggttatcacaactcaagggaagatgttgctattggtatcccatggatgaaaatcagggttgctgtgaaacatcctacaatgcccagaaaagtcacccaccattaattatctggtcccaaatgtcagcagtgctaagactgagaaacccaaaagcccaaggcaaacttctataaacttatcactcatcctgaactcgagtctggaagcccacataaggtaggcatggcatcttaccagcaagttctgttgaaagcctttgctggtgtcacatctgcttgaatgtgatacaagcaaagactttgaatgtggaacttaccagcaagctccaaggtcaaagcctatgcttgtgttacatctgcttgaatttcatcaaccaaagcaaatcatagggccacatctaaagtctttctggttgggctttccatcctggaatccacgtttgctgggggcacttcaagctacatggcagtgagcgccagtcaagtgctgcaagtaagaatccagtactttgggaggccaaggcaggtggatcacctgaggtcaggagtttgagaccagcctgaccaacatggtgaaaccccatctctgctaaaaatacaaaattagccaagcatggtggcatgcacctgtaatcccagatacttgggaggctgaggcaggagaatcgcttgaacccgggaggcggaggttgcagtgagccaagactgcaccattgcactccagcctcagtgacaaagcgagactctgtctcaagaaaaaaaaaaaaaggaatccagtctgccacatcaatgctccccactcccaagtggggaaactgaggatcacaaatacgaagtaatctgctgaaagtcacccagcttttaagcaacagggcggggactagcacccaagttttacttcacatccttctcaggtggactgcactgcttctgcttagatttggcttgtagagtttagccaaaggaaaaaccactggaggaagctgtagtcagcctcagttttccctctgtgaagtaggggtaataatgatacctatcccatagagtaactagaaagattgaaaagatccagtatttgtaacacagtgtctaaaacatactgagcatttaataagcttaagctgctgctgcttttgccattgagaaaagacaagattatgtagggctcatttccagtaaggaaggtcttactgtgttttcctgagtgtgggttgtctagggaaattgggcccctttctcttttctttaaacttttaaatctaatcactccattttcttgtgtctttttggtgaactctagtatttggaggctttctggccttcagctattaattaaagtcatttctactgttaaaactgaattatctgtttttcttcttctaaaagcaatgaaccagggattcacacagactttaggcaatcataatcttctaaggtttgatttgaatgaaagatcccacatgaaacctgattctgtctgctacacgtaagctgttgctttcattctgttactcaaaattggcctaggacatctagaaaggaatctctgtggcacgttgatgcctacttagtggcagttcgtggctttaatgagtctgttacacagtgcaccttcctcctgtggcctacggaaatcgaaggagggatttgcttggtgggttccagtatgtatttctgagtctcagaaggtctgccaggaacaaatggcgaggcactggtattcggataaaagcagttttctctcttagtgaccagacaatggtgctgtctttcttttgaagtcactgctgggattttatgggcatagttgatcgaatcctgtgctagatgctagaaaatcagagatagggaagaccttgtccctacctctggagagctcacaggagtaaaaaacaaaaaaagcaaaaatataataataataattcaatcattattcattaagaaatctatgaaaatatatattatacaaaatatatatataacatatatatacatagacacgcagtaaaatagatgcacctgcaagtgaagcttaggcatgggttgaaggatgagtaaaagttctttgggcaaacatcttacaaagtaatattcttttcttgctgcttgttgtctcttatagaactataatttagaaagatattttgtattgtgatgctcatgtttacctactaatgtaataatttctgttgtcttttaaaaatattggcatgtttggatatcaaatatttgacctctaggattctctttggcattccttccgaaggcgtttattcctcggtgtttctctgccagcaaaggtagcattccggttttcctgtttgagatgcagacacctagatgtcatcaaagccagagacggaaagcagctgcagctatatccagtgagctggtttcttttttgccaacctaagaaggctttgttgttgttgtttctaggcatgtgaaaaacaggccgaattgaatatcggagaacagtaaatcacgactttacgatttacttcttggagagaaaaatatgaaatattgaaatcctcaatatttttcatttagaacaaggagaataagttttaaattactaaacaaaactagtgataaaggagtgtagcgagtttcataaaacatcatgtcatctatgcaaagttgtgacaggaacggagaaggaaaaaaatatgctgggtgaggaagacaggtgacaagaaaggagttgtgaatggcatgaagaatgagaacacagggaaagcttgaatgggctctaagtgaataatcaggtcatagctaaatttcaggggataagtgaacagctcactgtttcwgttcttcacctgctcgttcaaaattttcaaaagcccaacgtaaatgaaatgattaatacagcccacagacagtagacgttaggcatcatggaaaaacgaggttctaagtaattctaggattattctgcagcacgtgacacaggtggtcacacctcagttagacttggactgtcttggactgcccgtttgtttatgagacagggtctcattctgtcactcaggctggagtgcagtgtcatgatcatggctcactgcagcctcgacctctcaggctcaagtgatccttgcatctcaacctcacragtagctacgactacaggtatgccccactatgcctggataattgttccttttttttttttggtagaaacagggtctcattctgttgcccaggctagtctcaaactgctggactcaagtgatccttccaactcggcctcccaaagtgctgggattacagatgtgagtcacaatgcccagcatggattgtccttttcagacccagaccaaagaacaggacttattgtcccaagaccaatctaggaraagtataagctgtgttgtcacccaggcattgctagaaagtggtaggctggacacaggatgaaacagttgcctgattttaaagtaagagaaatagatcaaaacaaatgacagaaatcagataatcgtctaaaaatgtttattacctatgagagtgttttcttgctcacctcaattagagcaaacaaccactatttctacaagaacagatttttcccccattaaaatattctgaagataattttgttcagatcatcagtgctgcaagtcaaaaaaggaggaaatcgggctgcttgtgaaattctcttgtcattagttccggttgcttattagagtgtgtagaccaagcgcaaggaatgagaawaagcacacatcaccgtcagccaacaatcagccacaaagtggagcccattagatctctggcttaggctacgagagttggaagttaccgaacagattttagggatggaagaatttaggaactgctgtggaataaacctgagaagaagaaaagaatcccaagaccaaaatcttagtctgaatgtgaagtctttggaaaatgctaagtaatgacaaatatctaaaggaaactgagaccatgtgatgctaccaggtgatagtttaatgagaactgaaggttaatgaaacatttcatagagttcattgatgaagtatggaatacaaatagaaggagattgaaattaagggggccttcctgatgtctcactattttgaaaactagtttgtgctaagactgagctggcagacacagacatcaatctcttgtgaaacaattgtctattattaacgtgctaattcaggtcagatggcctggaattagtgtctcaagttgatttccttttacaccacttcctttgcagagctggacagaaagctcgtggcaatgtgtactttaatggaattaattagtatcacagcaagtygatcaacttggaggcacgtcactcacccttcattggcatcggaattatttaagttggcgcggcctctatgttaactacacagttatttttcatgcaawatgctatggcattaaagacaacgactaggctgtcatacctcctcatttttttttctggaaaatatggaaatctggaatttttttttttttttttttttttgagacggagtctcactctgtcgcctaggctggagtgcagtggcgcaatcttggctcactgccagctccacatcctgggttcacaacattctcctgcctcagcctcctgagtagctgggactacaggcgcctgccaccatgcccagctaattttttgtatttttagtagagacagggtttcatcgtgttagccaggatggtctcgatctcctgacctcgtaatctgcctgcctcagcctcccaaagtgctgggattacaggcgtgagctctgcgccgggccagaaatctggaattttgttaaacacttctgtcttaaggtgtcagcagacaagtttttaaacatgtgaggacaaattctgtgtgactatcttggggccagattcagtccatggagcactggtaggtgggagcctggttcagagccagagtgagatggtgagaaggagccacagaggtagctgtgcaaggccactggagacagcagggacttcagcagggctggctgcagactggaagtcacttaataaaaataactagcttaaggaaaacaaggggctgttactaggaagcccagagccctgggatcgttgaggggggtcaggagcacaaagaggagggaaactgaggcctccagctacagacacattatgtcgatgagattagagcctttggtgttgccggctggtgtctctctggagcagcacttgctaccctccaaggaagtggaaatgatktgcgaggcagagcgtgtgcaccctgcagtgagaccattgcttcagtggttatggagcagccagagaacataaatgaactgctagctttaggggatattactgtggtcttrtttctccaaaactaaaacgaaaagttctagtgcactcactcggtgatgattcatttgttcattgattcatttctttcatttgtcattcaaccaacaaattaatgagcacctcatatacactagacactggggagacagagacaaagccatttttacacccaaataattgaggttcttatgggggggtgcagcagtatatacctgcacacagtgtcccacgggccatcatagaggtctctgcagtgagcagggggtgcccagatgaaggatgaactctgggactgtcaagaaacctggcagaaaaggcaacatctagacgttcttttactaatgtattcaggtttaaagattcatccggtctatgactctacagtcattataatgtcaggaccatctcctactttctcagtacctacaggttataattaatcattggtgttcacaacaatgattccaaggccgtcaggaactagaaccaccttctgattttttagagaaggatgacactttgttatttaattgatactgagtgtttatcgttgacttttaattctgagaaacctggcatccccatggaacatactactctgaaaagtactttcatacccatttgtttgattggccccctaccctgtagggggccacaggttactcttgctatcgtgcaaatgagcgaatggaggtggtggttagcccacggtcccagaatcaatcagctacacctgtggcagatttaggattagaatgaagacctccctacttctttctttctttctctttctttctttctttctttctttctttctttctttctttctttctttctttctttctttctttctttctttccttccttccttctttccatctttcttgttttctttttttcttttttttttaagagggagtttcgctttttttgcccatgctggagtatagtggcacgatcttagttcactgcaagctctgacccgcctcctgggttcaagtgattctcatgcctcagcctcctgattagctgggattacaggtgcctgccaccacatccggctaatttttgtatttttagtataaatacggtttcaccatgtttgcaggctgctctcaaacgcctgacttcaggcgatccacctgcctcagcctcccaaagtgctgggattacaggcatgagctaccgcgcctggccaaagacctctctaccttaaacctctggaaaaaaacaaaaacaaaaataaacaaaaaataaagcaaaacaaacaacaaactagaacattttattttctacctgtctgaataagcagttttcttcaccactattccatacaaaaagtgaccaccatagtacaggccatcacactctccctgcacccctctagtagattcttcactagcccatacagtttcctcttgttcctctttagtacattctttctacatgtttcagaaggatcttcgaaaattcaaatctgagatagttatttcctcaccatcctcccttacctcttgaccccttagaggttttaaacagccttattaagatataattcacacaccacataattcacccattgaaagtgtacagttcattggtttttagtatattaccagtcatgcaaccatcatcacaggtttatttcttcttcttcttctttttttttttttttgaggtggagtctcactctgttacccaagccggagtgcaatggcacaatcttgggtcactgcaacctccacctcccaggttcaagtagttccttgcctcagcctcctgagtatctgcgatgacaggcacctgccaccatgcccaactaatttttgtgttttcaatagagacagggtttcaccatcatggtcaggctggtcttgaactcctgacctcgtgatgcacccgcctcggccttgcaaagtgctgggattacaggcatgagccactgctcctggcctctgcagtcagttttagaacattgtcttcacctcaaaagaaaccccatcactcttggaagtagcatccaacaccccctctttcctatctctaaacaaccaccagtctacttcttgtctctgtagatgtgtctgttctaaacttttttaatgaaaggaatcatgcaacacttgcccttccatgagtagcttcgttcacttagcaagatgttttccaggttcccccatgttgtagytgatgtcagagcttcatcccattttatarctgagtaatattccactgcgtgaatatatcacgttttgttcattcattcactgatggacagttgggttgtttctaccttttgactgttatgaataatactactttaaaatgcgtaagtgttttgtgtgtggggacacatgtttttatttctcttggctatttgtctaggagtggaactgctgcatcatatcatatgctmactctaggctgaactatttgaggaactgccagactattttccagttttaatgctgttacgttgcccttaggaaagagatcaaaatgcttaacattgtttacagggacccatctgatttggccccactcacctcttcaggcccagcccatgtcacctttcccacttctgtcactctacttggtccccctggattttgtgcagtttttcaaaggtatgggcatttgctaaggctstctccctcctcttccccatgaacttccatcagacagaccttctctgaacagccttcatccgcaatctaaatgggatctcgttattatattcttccatgtttcataagttcttaagtgattcttctttaatcccactaaatcrtgactccagatgagtttaagaaatcttaagactattttttaattattacaaaccaaaagtctcacactgaacttgagctacaataggggcaccttatctatctgttgaatgaataaataacaatgagagarggggagggaggaagagaaattagtttaagaggcctcaggttgccacgttgggtttgaaatctagatgaagattgacatttcaccccaaatctttaactacttcttcctttttcactgagtaatatagcatatgggttggaaaacgttttctgtaaaaggccagataacaggtactttaggccttgcgagtcatgcagaccctttctgctgttactcagttctgcttttctagcacgagagaagccgtagacagtagatacatgaatgagcatagctttattttaatactttattcacaaaatcaagcagcagcctcgatgtggcctgttaaccataactcgacgacctctattctagrgtattttgatacttgataccttcacrctctctgttttctctccccagaatcccatatttccttccacctttgttctcctagaagattcttctcagggaacaaataccttatttagaaaattttccttgacctgcaaaacagaattaaacacactctatctcatcactgaatgaggcatattcttatgttgctgcatgccttcggctgtgttaaattaattgaatatggactcacttacagaacgaagtccacaatgtcccttcttctcatccagcatcaaatatgtgatatgctcagtaaatgctaaactgaaagagaaaaaaggtgacatgaaccaaatggattatctatacaaagtacgcaggcaagcagatgatagaatcaagactttaaaatagagggaaggagaaataagtcatctgaattgatagcaataccagaacacagtattggggataagcccagtgtcagtgtgcagggtctaggtcttttattcatctttccagaacatgagatttttttcctctttttaaccagaatttttcgccggacaacaacaacaaattactttattcttcctggaaatttcttggtagcaatgcctctgccaacatgtaccatacccatacttcttctatcccatcactatcttctctcttacctggggcatattctttaaggggtagcataaatcattagtatctcaaggattggagaaacatcattgtcctaatgattcactaccatggacaccacacttggtgctttttttttttttttttaacttttgaatgagaatattgctctgaactctatgggagtacaatatttgtttatgtgtgacctacaagaatggcaggactatatagttcaaccgaacaaaattcagaagagaagggagatgactcataaattatcagtgggacttacactttgcctggtagtggcatgcttgctgtgccctttgctgcacagtctgggtggtgggtaggactatatttacactttgtctctgcatggcccgcaaacatgcagaagggatgttatgagcaaaggaacaagtcactaagacactttaattctgggctggccaggacacttaagaaagttggatgacactgtgccaggagagtctagaggtcctataacaaagccaaatgctggctggttgtcatgtgccctgtctgtactcctaagcccagaacctatgcatcagtctgcagtgggggtatctggccaaaggagagaaaatggtgcaatatgtgttaagtccagaagaaactaacagaatgcatctcatccggccacagtcatgtctggctgctgaagacctcttttgtgcacaagtgaaagaaaagatgttgagctagggttgtaagaatggcagagggatttatgtaagaaatatgagtctatttccatgacttgtgtcatttataaaggcagggacagatggaatcacttcagtgagctagaatttgtattaagttctacttgctttattttcctycatttacatatgcttattagtaatacacgtgtgagaacaaaatcatataytatcagtcactgccacacaatgaataatcccatgtaaaatatttttgcacacttttgagagtgacaataacttcactgagcttggtttcttcctttgaaacaggcagacaggcttttgctgaatctttaatgcattgtcttttggctgggttcattcaccttcagggaattctcaaaagacaagcgtcatttctttttgtctattgatctgtcctccagaaaaaagggacttctttataaactcaaagcccttagctaattcattgttcatttgttacatttattgaaaatctactgtttgaaaggcacttgttctattgtgctatggaaacaagacagacaaattcctagtcgttgagagcttaccttctagtaggcattacagaccagaaaaatggctgttcagtaggcctgtagcaataagagccgtgaaaacaaggttgggattaaggatgagtaatgagaaggagttactctttttgatcaagaagtcaaggaaggtttctgttttgaggacagacgtgaatgaaatgagggagcaagtcatgaaaactctttggaaaagaaaaaagtcttataggtgaggaaccagcaaatgcaaagaccccaaaataaaaattaacacctgttggctgggcgcagtggcttacgcctgtaatcccagcactttgggagtccgaagcgggtggatcacgaagtcaggagatcgagaccatcctggctaatacagtgaaaccccgtctctactgaaaatatgaaaaaattagcagggtgtggtggtgggtgcctgtagtcccagctactcaggaggctggggcaggagaatggcgtggacccaggaggcggagcttgcagtgagccgagatggcaccactgcactccagcccaggagacagtattgtcaaaaaaaaaaaaagaaaaagaaaaaaaattgagacctcttttgtgcacaagtgaaagaaaagatgttgagctagggttgtaagaatggcagagggatttatataagaaacagaagtccatgcttggaatctcagctgttttctagttctcagaatttatgagtgagattaaaagagaagcttcagagtgaaataaaaattagcttagctatcttgaagaacaccaagaaggaatatgtggctgaactagaatgattttggggagagtgaaatgwtcaaagttacatccaaggttcacatcaggaccttgcaggccacagtgagaacttagaagacaattgacataggatgattggaaagcagaatactgaaaggccaatttacryattcaaagatcgtgtggaaacctgtgtggtgaatagagtgggaggacaagagcagaaagagcaactcagaaacaatttactaagctgggtaagagatggtggcttggcygagaaggtaaccagcagatgatgagagatggtcaggttcaggttgtartttgaagatayagctgatggaagcagctgatggagtggatgtrtataaggagcattgggcaccctgttagcaggctttaggcttctttgactcaggcattgtaccaacattcacctagtagctgatgttgattcctctctcacaaagacagtatcttagtttgaaatrcttaagaaaaaaaaatgtacctgatccaaggggaaaatggagctccacactagcagggataaaaggaaggtggttctgattatttgtgctgctcatttccatgaaggtcttgttcacagtaagcaagtttgtcaaacctatgcctaggtagtcaaatttccctaaccagggatagtctctactgggccttagcaccttccattcagtaataaaatgaggcatcttgagcttccccgaagcacaaatctctgggccactgtatcagaattatgtgggatgagttaactcacagattccggagaacctactaaatgcttgtggttgaatttcagaaatctgcattcttgcagttttcagatgaatcccatgcaaattaaagggtttcttgttttgttttgttttgtttttgagacagagtccggctctgttgcccaggctggagtgcagtggcacagtctcagctcactgcaacctctgcttgctaggttcaagtgattctcccacctcagcctcctgagtagctgtgactgtaggcacgtgccaccacacatggctaatttttgtattttttttttttttttagtagagatggggtttcgccatgttggccaggctggtctcgaactcctgacctcaggtgatgtggccacctcgatctcccaaagtgccgggattacaggcgtcaaattaaaggtttttgattgtgatgaaaaacacacataaaatcgatcagcttcatcattttaagtgtatatttcagtagtgttaaattttttcatgctattgtgaaacacatctccggaaccttttcatcttactcatctgaaactctatagctaccctttgcccccttyctgtgtccttgagagtcaccattctactttctatttctggaaatttgattactttagagagctcatataagtggaatcacacagtatttgtctttttgtgattggctttatttcagttaatataatgtcttcaaggttcacttatattgtagcatgtatccaaatttcctctgttttaaaaactgaatagtgtttgtattgaatgaatataccacattttgattatccattcatctgctaatggacatttgggttgtttctattttttaaccattgtgaatagtgctgctatggacatgagtacgcaaatatatcttttaagaccctgctttcaaatcttttggatgtatatccagaaatgggatgcaaattaaagatttaaaagcattgccttcaaatagaagagattcttgtagaaaatgaattattatgtatctggactgtggtggtggatacaagaacctgcacatgtaataaaattatgtataactaaatagacacacacatacacatgtaaacacacacacacatgcacacacacaggtgcaagtaaaactaaggaaatctggataccagaattgtataaatgccaatatcctgcttgtgatactgtcctatagttttgtaagatgtttccactggggaaactagaaaaatagcacatagtttctctctgtattatttcttacaactgcacgtgaataaaaaatgatctcaaaacagaaaggttgcccttgaggttagagtgtgccactgcaagaggagacccatctagaagggcaaagaattcttggcattgttccgaaggagaaagtggaacagggatagaggccaacccaaagtgctaagttaactctgggtcccaagggacatggcatccccaaccccagacagtaggaccaatgtagcacagatagggaaatggcagggaatgagagccagaaaaacagaggccaactcagtgctgaatccccagagtgtgggcctggagctggtactgaccaccttcctcagattgcactggtcctgggaatggggtggcgtggggtccatgacctcagcccaaatcactcctcatacgaaggttggaacaggggacttggtcmcatgagccctatgcttcctcttaattctgaatgagtttcagattcctgcaggcagcatcagcaacatgcaaaagacgcttcttagatgcttgagactgtaaacccttatcaggaacataatgcgatgggatgtttctctctctttaggcaaaatttaaggatactggtggataawatttacttaatgattgctatgtggcaagtgttttgctaaatgctttacaaatatttattttctgtgagatggttcctgttcttccatctcaaagatgaggaaattgagattctgagaaggtgactgagtaccttaaacaatcacacagctgataagggacggacttgggccttaaagtacagtctccctgaatctaaaacccacctttggaatctcagctgttttctagttctcagaatttatgtgtgagattaaaagtgaagcttcagagaagaagcagagagtgataacagcgatggctccaaaaataaagctgaggagaccaagttctgtcaggtgcattgagactctttttataatcccaaaactgtagaactgtaaagactagaaaagccagccacactctgtatggtactataatactgatgatgtcctatgtacttaatgtgtgtttctttctcattaatcatcaatgctgagggatgttgcatgtcttagagtttaacagccacccatagctccccatttgtaataaactstagtcagtgtgtagtcactgcctgaacaagttacaatcttaaaataaaaaccttattgatttcttttttaactttgaaattaacacatgcctagaaaaatctagaaagtatagcaaagcaaagaaaaatcactcaataaaaccactgttaatattttagcataatcttgatagtggaatgcctttattttttaaaaattgcattatgtatacrctarttttagtcagaatttgtacttcttaacatgcatactataccattagtatatttttacattctctaaagtgtgtctgcaatgcagtgttstactttctgcagataccatagtttctttcatcaatcttttataacattgtgttgattgtagttttttctatctttaagcaatattgtaatgagtatacatgttgctacacacatacacacacaaccacacacgcacatatcaggctaaatttctacaagtgaaattttcaaagcttgtgatgggtgytaacaaattgcatttcggaaagattttttcatgtaattgataatatatgagagtttatttcctcataagtctgtcaaacactatgaactttttctaattattgtaacaattttataaattgttacaatatataacatgctataaatatatgtgatgcaaatttttttacagttttctgtttattttcatataatattttagttgttgtaaaacctgcatttcagtagtttaatctgtcagtaattcacgcaataaattagagctctaatggtggcttagaarggccttctcccctgtattacttaaatattcaatgactttattcctcctaatacttaaatccatctggaattcattagactatactttaaatttgtatgtatcaaccctaatttttttaagaacatcatgtttgataaaacacattttaacacttacttaacaaaatgactttaaaactgtaaacttaaaaaaaaggtattgcatttatttctattcctctgaatttcacattaggaaaggaaaaagggcacgtaaaaatacaatccccagtaatttctctctgctggctttgttttctaaagtattatatttcccatctttgcacaaaaatccccttaacccttgtacatatccttaatagatctggcataattccatcatccaagagttatataagttctacttgaaccaattaaaatttttagcctgtgtcacctcttgaggcagaggatattcactaggactttactcaagctgcttacataaaattatttygaatatctgcatagatttcttccacataattaaagttacttcaaaagttaaatgtttaagaatgccctgaaagtctagtgtgattgtgagcgtgcatacacataagaaaaaatgttttcattatgtttgatgaaacaaaaattttaaagtaaaatttcaaattcataaaggaaatactgtacctctaagcagagcaggattttcaaagaacatttgataatagtatcaagatctttaattaataacctaacaagtaggaaacttttatcgcccctttgatcgtttttataaggagatataaacaccacatccagtctgtcaagcgggggataaatgaaggtggaggaatgttacaaagggcttaaaatgtcttttccctgggaactctctaggagttggtccgtaatgacatttaacttgaataagtgaaataaaactaagaaaaatagcttgaaatgcaagttgttggcgtcagagagaaacctggattacggtaatagaaaagcaatttcaaaggaataatggctgacaaataggaattgaatctagtatactgcatccacatttgcaggtttctacataaagatctactgggaatgactgatttccttacggagcgggggtggtcctatggggatgattkgcacctctctcagattgcccarcctccccctgctcttctgggagactgtcagggtgctgctctttggactacctttgaaatcttgacctgtgacraggctgtggctggtagtgatgttgccaggaagatggcattccaaggtcaccatactcccgctaaggtctaacaaagctttgtttagtatttctacttgctgggaatttctgtgtacacrtgctcatttatctttttatttatttaacaataaaaccgagagtggtattctaaacaccatatgttgctatggtggaaactaaaacctggaaagctgaagtttcttagtaagagagcatgatcacatgacccaatttgcccaggacagctttggtttgcacctgttgtttcggcttcattgttaatggtacctacttttattctaagaagattctggtttggacaataaattatgtggccactgtattaatgtcctatggctgctgtagtaaattaccacacagtgactcaaaacaacacaaatcttatcttgcagttctgtaagctgagaatccaacatgtgtcagggtaaaatcaaggtgtccgcagggctaccttcactcctggaagctcttggggaaaaacccatttccttgccttttctagcttctaaaggccacgcacattcctggcctcatggtacctttctccatcctcaaagccagcaacagctgttcatgtccttcacatatcccatcactctgaccttcgcttcttcctccctcttaacgactcatgattatattgggcctagccagatgccatataattcatgctagtctttctgtctgtctgtctctctctctgtttctctctttcttcctcctttctctctctctccctctctctcccccctctctccctatctccctctctccctttctccctctctctctctctctctctctctcacacacacacacacacacacacacacacacacacacagaatctccctctgtcacctaggctagagtgcagttgcacaatcacagctccctgcagcttcaaccttccgggctcaagtgatcctcctacctcaccctcctgagtagctgggagtacaggcatgcaccgccactcctggctagtttaaaaaaaaaaaaaatacagagatggcagtctctctacattgctcaggctggtctcaaactcctgggttcaatcattcctcccgccttagccctccaaagtgctgagattacaggcatgagccaccatacctggcccaatctctgttttaaagccagctgatcagcaaccttaattccattggcaaccttaatttgggaggtggagagagtatgagaattgtagaccgaaacttcatgaaaagatttatcagtatgtctttgtttaaggcactaaattttagaaaggatatgtagatagagtactcttacccacacatcgtgatgatctaattggaccatgagtatattttcatctaaatctgcctaccaagcctgtacatatattgataatatattcatatgtaaggactcaggtgtaaaaagtaagggcaatgtaagtgtcacattaataaactgggttaggattaatgttatcatttcctgtcttatcacaacaaacattgtatccatggtggaaaatatcacttaaaaaatcttccaatcacactctaccttgcaagattatctgttataaataaacaatatagtatactgacacaaaaatctttgtgggcttatttccatggaatctctgcagaattttgttttaakctttgaacatctctgtggttcttgagacatactttcagactgccttccaggaagattgtatcaagttgagattccactacggtgatccttgtgtttgtgtcactgtacccttaacaattaccggctcttaacttttctttatctgggggcaaatgctggcatgttatttttcatgtgcatttcaaggttttgtgtgagtcaaacacacacacacacacagttcctttgtctgaacttacagtcatgtttagctggagagatggcagtgttaagacttgtacatccctgcttgcatgtagtgagcttctgatgatcattttatgtttcttgccctaagggaggagaccatccctcatattgtcttatgcccaatttctgcctccaaagaaggaaaaagtaaaaactaaaaggcagaaatgaaatccgcaagcagacggcccagcgccacaccctgggccttgtagttaaagattgacccctgacctaatcmgttatgttatctataggttacagaaattgtatagaaaagcactgtgaaaatccctatcctgttttgttccgatctaattaccggtgcatgcagaccccagtcacgtaccccctgcttgctcaatcgatcacgaccctctcacgtgcacccccttagagttgtgagcccttaaaagggacaggaattgctcacttggggggcttggctcttgagacaggaatcttgccgatgcccccggctgaataaaccccttccttctttaactcggtgtctgaggacttttgtctgcggcttgtcctgytacagccctacagctatattctattactagatatttggggccaggcatggtagctcacacctgtaatctcagcactttgggtgcctgaggtgggtggatcacctgaggtcaggagttcgagacccgcctgaccaatatggtgaaaccccgtctctgctaaaaatacaaaaatttgccaggggtagtggtacatatctgtaatcgcagctactcaggaggctgagacaggagaatcgcttgaacctgggaggcagagattgcagtgaaccaagatcacgccactgtactccagcatgggtgacagagcaagactccatctcaaaaaaaaaaaaaaaaaagaaatttggaatgaaagcaatgagattccttcttgtttgtgacttatagacgggttccaatagaagtttctgaagaggtattccagagataacggcagtggcagcatctacgctaaaaaacattttagtgccccagagaggtaatttggagggaaaatacttattcaggtgagagatatcttatctgtctgcaaaatagaaacggagtcacattgtgttagagatgtaactactgtgtgctttgattctgtgtgatttgaaaacttacatctgaaaatcctgtgcacacacaatccattgatcgaatgttgaactatatcatctcaaaaaagctctgtgtgtgtgtgtgttttgctttatttgcatattttgcccaaagaagaatcatcagagttaaagaggtcatcaaactgttttctaaatcatttctcttcggaatgactcacaagtccatggactgtgtgtcatgctttgtttctgattctgttgatctagattttgcatgtgttgcttgggtcatctcatattacaaaaaatattggcttttaagagccagcttctgcattttggccttcacccaagaaaccttgtaacacattttgtttttcatcagtacatccctttgggtaagatctcagtgtcaaattttgtcggactaaattgtgtctttcatggctgaagatgagaggatgactcaaatgaagggcaagctgttaatagttcgccatgaagctgaaggccacgcaggctttgtaatttggttcattatgttcttgcatttttaagggattcttttcaaagcattttacgtacagccaattcctattagtgtggtgaattaattggcttgaagaatcattgttttgcgtactgtgacttgatggttcacatttctactggatacctgctcacccaaccccccacagtatggaaagagagtagaggaacccaggtgctgggatgccaggaagggtggacaacagggccctaaactcaaggctgaaactgctctccaacttagcttcccttctggctcctgtggtttttctttagctccttctccatttcaggagttgagccccttttttcctcccattctcaggactcagaagatcagggctaacaacctagtgcccatctaccatgcccccttgaagtacagaaaatattcaggcggtatcttagtgtctccacctttggataaagtatttttgctttaaacaaattagaggtgatttgcatcctctgtctccctcaccatattattcactgttgtcatttgagaattaaattgacaagcgtatttttttttttttttttttttttttttgcttttcagaaagtgtgtagtgtcatggaaggaactatgtggtagctaggctgatactataatatttcgcagcctttagtttgtggcaggatgctacataatatacagacgctcattgtgtggtttaatgtgtagcttcatgtgtattaataaaaatatataagaaactcattaagctcctcaattcatggatgattttgccacaaatgaggcaagagtaaaaagtagyaatcaatgtaaagcaaagctactaagyaaatagcttagtaaagataatgaaacaaaaaaaatgtaagggagtccatgcaaaaacattcagcaagtgtgagcacagtgaggggaatgtgagtgttacagtcggacctaagtttgagttcaggctgatgacaaatcagctttgacaccatggaccaggtccttaaatttctttgctgcgatgagtatttgttcagattgttttaagccaaatgagacagtgcaaaaaaaggccagacctgtatgggacaccaaatcaatgttagtcctcttctttttaaaaaaaaaaaaaaaaaaaacaagtaatcagtttaatgtactctgatattgtttaccactgggattcttsttcatcawttaaggctacagagtccaccagcctagagtccatggagtcagaccaactgtcagctgtaatatgccggagatggagagaaaggacagatggccagagctcaggccaaaactttggattccagtctcttaaagaggcatagcctcttccaaagagggctctctgcagtsaatatcatatcagctacctgtttggcaccaggcattgggtccaggcttcaggatttgctaataaactcccgtcctcatgtggccagacagagaggtagacgtaaattgaattatcacaccaataggtaataacccatgggaagtgttacaaagcaaggaggctgacgccatgggaatgtaagccagggacaccctagctgttctggaggagtaagggaggctcttcttgatatttgggccaagatctgaaggatgaatagcggcagcaaggaagcgtaggtaggaaacccatggttggtaggagggttgtatgtaaaaatacctgcaagaaaggatgtgatgagttggaagaactgaaaaaagatgagtgtaactggataataaggaagaagagggattccttgtaacatgaaatgagtgtgaggaagtgggctgtggccagattacagaaagacttgtcaaagcaaaggtatttgctgtttttcctaagagtgatgagaaaccattgaaaggtatccaatagagggtgacataaatcaataaacattgacaaagacaccctggaagccctatagaaaacagatggtggcaggcagtcatggctgtgcaggaagacccacagggcgccttgcacagtwgccctggtgagaagtgacagaagctaatctcaaggagtgttgagggggatggagagaaaaggggacattcaggaagtgaaacaatggatgtgggcaggatatgttgatagagtggctgcggatagaagagaaggtttcatttgaggaagagaatgactcatgagtttctccttccttgatccctgagagaggagccatcctctagacaatatttagagcaaaatgataaacatgcaactgtatttatcatactttctggttgctcaaaaatccttgcctccaatgatgtcaataatattttaattaagttattataaatgtaaaatagttttgccctctctaggaaaggataaagctgggcccctaaaaactggggagtaatatttgacttcagactcagtaccagctttgtatcagacactttcatgtgttattttagttaatctgcaccaagatcctgcaaagtcaccatggtgggctcttattaataacacaaaaaccaggatacggagaggtgcatgctctgctcagggcccggatctggtgtgtcagcaggattcagtatcaggtctcctgaatccaggtccagtgctctttccacagctccttaaagccctccagtcagcctttcacagatgtcccccacctccagcaattctcccctccacctctcccaccagtgcaggtggcatctggatctccctcccatgatcagccaagctttccaccgtgtgagcaggaaaccactagcactagaatctctcaaagtgctggtttaaacataaattcctaaagaatctgattttacccacttccctggatgatccataggcccactgtgataaagctgaatgagttactcctccctgggatatttcatctcaatggaggaaaataattctgttggggtccaaaaatcacaccaaggctaaggcaatacagggccccccaacactcatcaccattctctgtgacctttcccatctctgggacctctccattatactttgttttctgcaatgtttcacttttcaattaataaccaatttccttctacttttgtatttgacagcttctcaaaaagtgatcagacaaaatatgatttttaagcattcagcatgcacagttgaagattagaaggacattggaaaaaattgatgtttatgggaaatgtatgtgtatatttgtatgtgtgtgctatgtctgtggtacatgtacatatgtctgcctgcatctgagtgtgtgtgtgtgtgtgtgtgtgtgtgtatgtgcgcatgtgcgtgctgctccagatagacctacaaacatctgtcttcctggcctgtgtacttgggagtggtgaatgagtccaacagccacacagtgaaattcctagcaggtggcaagactcagcctcctgtttggagcttattttattttcctatagctgaacctgggaatacagttcccaaattccacaagacccttggatttccatctccaacccctgtgtctcagtacaacatcactcaaacagtaatgtgcaccygaattctctagaaacaatgttaaaatgggtttcctctgtaggatctagacaggaccgaggagcctgcatttctaaccagctcctgggggatgccaatgctgctggcttggagactgacctttgaatagcaaggtactagaacacacagcacagacattggtcagatgtgtaattgctcggagttcaggctacctactatggaattagttattaaaatcctgcaacattggataactgtttctagctgtcatttgttgagtgcccctctcatctgcctccacagtggactttttttttaatatcacaccttgttattcccatgcaggtcaaccattgaatctaagaatagaaatcctcatgtctgaaggggtggtcttgaagtaggcaatgagggcctgggtggtttccatttcctttgagcaagtatttcattgccttctgccatgcctacctatttgtttttctcacagtaggtttctaccaagtggcatctcacttctaacataaagaacaagcatcagwatgcctccctttgaatgcatatgaggttgttttgtttttagaacccaaacacagccacttgaatctatcatgtaattcaaaggaaacaagcattattccagtcttttcaaactaaggttttgtgtgctttgggtatttcaattaggaagaaagaaggcaggcaagaacgttattgaacatttattctctgatactggaggatgcgctggaattcaagagcctgacttcagaaagtttggcatttgctaactgtgggtctgaccttcgtatgagaacagtgatgaaaactcacgggaatgtcagattttgttacggtatgtgattgggtggataaggctgtatttactaacaacttcctcatgcatatgcatgtgcttaattttcatccacatcattaataagatgattttaaaactggatgaayctctgcataaaacacaaacatttcctattatatattttattcagtctactatgttttcctctgtggggatcaagcatgatatacttctttctcatctctgccttcccagggactcataggaagaaaatgtcttcattcttcacttggtttagattgttctacgcaaaaactcttgtatggacataagccttaacttactccattyggagttgagcagagtcctaattctttgacttgatcttataccattccccactcctaaattagttccaattagttccaagttcatccttacctcagagtctgctattgctattcctgcggtctagaaatcattttccatgtgttttgtatggctatctctttccactttcttgtcattcaagcctcagctgaaacattccctcagcaataaggttttctccaccatttattttgaataggtgtcccctgccacccacacacacacacacacacacacacacacacacacacactttgtcaatcatactctacccagtgatggaaatgttctacatctgtgttgtctaatatggtaactactacctgcatgtggctactgagcactcaaaacgttcctagtttgactggagtactgagttttttcattttaataaatgtaaattgcaatagccatatgtggctagcagctacagtattgggtagtgaagctttcgtattcaaacctgtctcatatccttcatagccctcatctgtgactgaaattatcttgttcatatctttttctcttgtttatcacctgtctttccatgctgggttatcttttctgctaaccactggataccagggtgttcagcgtgatggctgacatgtagtgagtcctcaaataatttttattaaattaactttaagaaaatcccacttaacagcccttcactgtttttagagaccattccaaaggtcttgacttstgttgatattattgtcctctgaaaagtctgagtcaaactctgattagttttgtaacataaaataccattggattgtctgtttgcataattggttttctgagattcagctccacattctgtattcatcctaatcaatggtgtctccttagtttctgtctttctttccattgtgttaagatggatctgttgtctgcccttcccagtttcagcatatttgaatatttggcaaatgtgaattctgattacctatcctacttgtagcttatgatactggccaagtcttatagaatgtagaatcttaggattcagatccaagatatttgttatctttaggcacagtgtttttttgtttctgttttttttttttttttttttttttggttgagttaaagtcaagtccttggctattttgggaagatgaaaaaccagacctatgttattacataaaattgcctcagagctttattttgattgatttcctttgttagcagtattctcataatagcttaaaaaaaacataaaagtataaaatttcactctctgtgagatctcctttgtgtgcagatattacgaggctctgttcacttcattttttcttattacatgcattattttatctgcaccagaaatcaagtatgtatgtctgtgtgtgaatttgctggtaaaaggatgaagtaatgttaaagaaaaaaattwaaaaattatctacccacacatacctggtttcattttgctcactgccttcaaattctatccatatttgtaggtcatgtatgatgatgctcatgttattttgtgtatttttactcaatattctaagtagatcaataaagtttaaaaattattgtattgtaatatgttgttacacaaacattccttcaactagttcccttccactggatgttcaggcagatgccagtgtaattttattttgagaaataacaatgcagtgaatagttccaaatatgtagtgcaaacttatataggatcaggagtggtataaaaacggaacaaaagtatgagtctttcgtggtttctgttgaattttgccatgcttttgaaaaggattatactggtttacaataccatcaggtggaatgtgactctmctgatttataacaagaatgtttgtctttcatttttctaatttgggctcttttttgacaatagtattgataataactgtagcaacaatagcagcagttaatattcttgagacatattatatgatagaccatatttaaatgctttagaaatattgtttatagtggttaaaaaagtgagctctggaggcagacttcccaaggtcaaatctggactccaccatttatcttctctttgctttcattctctcctctgtaaaaagatccaaagggttgttatgacaatcaagtgagataatatagtatagagctaaagtaagcactggataagtgtttgttattattcctaataatgagtgtttttgttaaccccacttacagatgagaaaactgagatccagtgtcttgctcaaggtcacacagataggaaagagttgtactaggattccaaatgcagatgcccttttctgatcaaaatactcctatgcggggaccaacacttatatccaagaggaagtattactcttatcgctgagttaaatcaaggttgaattacgcacagaaaatgtgcgcataaggtccccgtgattcactggaaatgccatgacataattcttcgtttccaagacaaacaaaaaagttgtttttttatgctgccttcttcattgagatctgaaagtagttccctatggaagtgattcatggtgttgtgaaatcctmcgaaattgtaaacagcctggtgggcaggaatcccgasgtctcattcaggccccctgcaaattctgagttcctagcctgaggaaagcccccaacaaatactgacctgactttctcctaaaagattgccataaacacttttggttatctcttaatgtacttggttcataactgcttagtcarttatttttattagcataacattccttttaagcataatgatattgggaaaacagaaatgatacaagcgtaatttcttggctatgactgtttatgttttgagtttttttgttttgttttaactttctttgccgatttgatgaattaattgtaaatttcccaagggggatctaaagtgaactgatctttgccttttattctggaatgttcaatttctattctagtcccagtgactatcctctgagaccaaaatttcaatattgccaagggctcataaaattgtcgatataacctactttctctagagaaccttatttgaattttcataatgaattaatatcttctttctcycccaatctctttgctcaaatagctatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggtatgtcacattggcttacctttagcgtaatggcttggaaagaggcacactttgatctttgtggattctagggactgtcttatggctgttccaacttgtcagctcgtatcagcrtcgacttaatacttccctgcgtagaagccaggttggaaagctaaagtgcaaagcttgaccgaggtgttgcaagctacggaaatctctttcattgtctctgaagatcatcctccaaggatgactgccatctaagtctctaaggcatggccgatgttgggcaccatgtaaatatccagcttacctttgtgaaagtccaaggctaaactttgtgctatagcagggctttgatgagaattgggtccccattacaaactcctcagttctttcttttcacagtggccttttaataagaactattttagtaaaataggtaggacttcttcccttcccttagaagatgtgcatgaagaaatcttttgtcttcagtcagaggaccaaaaggaggatgtttgatatctctctctggaaatgcgtaaatgcatgtgcctactgttatagaagtcactcaaggttactatagagctcccgctgtcttttcccatgtttaacctttctatcagggacggttttagaatttagagcttccttttttgccccaatacatacaaattaaagtatcccacagccagcagctgaagtcactcctaagtataatgcttgagaaaatgaaagaataaaacagaaaaattcctcttcggctcactttgattttcagctttaaaatacacttgagtgaaaaaaaacaccatattaagagtatcatattaagagtatcatgatactcctagattatgcccaaataggtaaaatagtgattcgtcagaccagacaggagatgagagcggcttttactatttttcccccttttctgaattgatgggatctatcagtgacatgtagatacatgaggctctggaaatgttgccatggtaaccttcccagacaaccaggtggataattgtatgcaagatgcctaaaacctcccgtcagcttcaaggagctgggtctttatgcactgcatcagatcccccaagggcaagagcgaccctcttccttcccagctttaaatgcgctccgtaaaaatgaaagcaaatgcactgcgtgtgtgctggagggtgtttaggggagtgttggaggcagatggcagaggagcaatgacaggtctggagagaaggagagagggcaggtgaagggaggtcaggtcacttcagggcagacaatccacgtggcccctctctgtgagctgcttttgatggaaagatggcttctggtgagaaacaccctagaatttcggtttgatgtttacagaaatcttcttaaacgagctgatgtgcagaacacatttggagaaccaatgaggaaagcgattaaagaggccaaagtttgagcagaacagaaaaatgattcccaattgctatctgtggtactcgggccccatgagtgagtgactagaattcagatgggctgggaaagtgttctaaatgtaaatgacagtgcttacattcgggatggctgtgagcttgcacatgtctttgtatattatgtgtgtatatgattagacggtgtccaattttcctcccactgtgcctgtccttaaagtttagaaaagaatttcagatacatgtaatattttttgatacatgtatatacatgtaatattttttgaagaaagagttctttttgcacattgaattctttatgcacatgttattttgtgtattttttatgtatgttttttgtgtattttttagatagagttctttatgcacattgaatttcttaaatcacagagttattcagttagagacagttctccagcaaaacataaaccacctcaaatatctatttatgattggtattatcctataaaaatacataaagactcaggtgtctgtatggattcattgttttctttctcagcaccctctgggttggactataaagcacgcagtgaaatagaatcagtcagatttgggatccagaatgtggaaatgttgcaaaagactttcaaacaaaaagccacttagattacttagcaccctgtaagagagttgcaggcaagatggcccccgaagcattcatgaggccagtgggaatctgatgaagaagacggtatcctctttccaacctcttcttcaacttaaatcgtttacaagtaataacaaaccctaactggctataaaaatgatcgtctcttgtatttccattatgctctgctcatctgtggctcataggatcccatgtgttgtagaaattattcgacacccactgggagtaagggtgggggtaggggtggggtttgggtgggggtaggggttggggttgggggctgactctggaaagagttccatgattttccatgctctcacaaataaaagatgggagtcagtgcataacctgccttcaaatcatatgctctttcacctgtcccgctgaattcatggtgaacacagccatcaggtatcatagcactgcgtcgagtacttactgtgtgccagcagccatatatgtacaacatcatttcatccatgatcccacttcctgccctgagaggtggctaccactatccctatcttacagatgagaaaactgaacatcaaagaggctcaggaacttgacaaagttacctggctggggaaaaggcacaatcagtgtctacgtctccagcttcaaaatttggtgaatggttgattacttagctggtaagaggctgccacatctgccttaattctctgcaaattctggccacatctgcactggcatcatgctcaaaagactagtccgggtctgtctacaatagcccgcatttcttcctgggccttgtgtgagctacaagaaacccaagaaccagctgggtggagtggctcaagcctgtaatcccagtactttgggaggctgaggtgtgtggatcttgaggtcaggagttggagaccagcctggacaatgtggtgaaaccccattgctacgaaaaaaacaaaaattagccgggtgcggtggtgggtgcctgtaatcccagctagtcgggaggctgaggcaggagaattgcttgaacccaggaggcggaagttgcagtgagccaagatcacgccactgcactccagcctgggcgacagagaaagactccatctaggaaaaaaatgaaacctaagagccacgtgacccactgggtctgctctcttgtttccatgttttacaccacagactctttgcaggcccagctgggggaagtatttgtgcagttctatcagatgaactgatttagatcctcacagaaaatgactagttcttcggatgaaatagccaggcccattgaatcacctctagggttcaacggtgttaagtgttgaggcctttgtcaccactcatgtcacttttttctgagcctacataaccaaaggcagcttcatggggcacagcctttgtggcctcacacagccaagggaacagaagggtcccatgctcagaagggcctggggcttggtttagcgttctgctgtcaccatgttgaaattcttaataattgttgaacaaggtgtctgcattttcattttacactgagcgtcacaaattatgtggctgttcctgctcacagcattgtagcctagagctgtgtttgacgctgtgctcagctatttaacacggtgtgatattgggcaagttactgaaccttctaggaccctctgcaaatggggatagaatataacagtagctaccttagagaagtatatgtgaggattcagtgagacaacatgcttcacccagtgcttagggaacagtaaatgtacaatgaatgcctttgtattgttaacagtgcaattattatttttattctggaagagtaccctttagcaaaggtaaagcaaagagacacatgagttgtgtgaagacaaattcatcttccagcaaaccacgcgtcattttcatgtccccatgtgttcgaatgccctcggcaccaatctatcacaaaggaaggtcacccatatttatctgtatgtgcagacaggagaccattccggctgctcagcactgaactccggggtattgttttggtgaatcattcctggatgaaggaagatcagcagaacataatggtctttgactttgcagatcgtgagctgttgcttttgcagagccacagacattgatttatgaggcccaagccaaggctctggctgctccttgggggcatacagatctctgtgtgagtttggtgttttctgatggccaagacatggtgttcatgagtagggggtagagggtgagaactcttgaaattcctggagggcactaattccaaggccccatcatgtcttgttggcatcaattcatgggtgttttgccctctggtggtttcctgggcacctttgagaatggctgaccatgaggaatggcatgtcaggctcccacagaagcaggccctgagatgaagattgaggcctgcctgtggtttgcttgagaggtacagggacagataccaggtaaggtgaggtacagaaaaggaagtcagacaacttgaggtgcattattattattattattattattatcactattgagacggagttttgcttttgttgcccaggctggagtgcaatagtatgatctcagctcactgcaacctgcgcctcctgcattcaagcaattctcctgcctcagcctcccgagtagctgggattacagacacctgccaccacgcccagctaatttttgtatttttagtagagatggggtttcaccacattggccaggctggtcttgaactcctgacctcaggttatccgcccaccttggcctcccaaatgctgggattacaggtgtgagtcactgcacctggcccttgaggtgcattattaaagcagctcccagagtgggtaactgcagctttatcctttttggggagctcaaggaaatgacattaaacacatacgttagagttatctcagctaaggggcaggtagctagaatatctactcccccaagtctgataatgagacataggttcaaagctgtccccaaggatggggggctttaatttccaggcacttgccgccagctgtgygcaagggaaacctgggatccatcagctccaatatcctgtcytcttgaggcctcggccttccaacaacatcaggagctggctgtaggttgtgttcgctctcctggcttttagccaccccaaatggcagccaggrcagctgggagaatggcagccccccaccctggacgggtggggcagctttgagaaagataggtggtgagaggtcacagaaggaaagaattagctcccaaactgcatgactgacaaagatgaatgtggcatttacctaaaggtgcacgttctgtgtcctgaaagatgcacattgcttaggcatgtctgatccttcttcttgaggctgttgaagacaagcagagattagcagttacgtcctcattgtctaacttctgaaagcccagccactttccctccctctctttcctgtcttagtccctttaatttttttttccatccagtatgcttagcaagcatctactctgtgctggcgctattctaagctctgaatgtgcaacactggacctggcaggtgctgcttgttccctcctggtattcatagctgaggagggaggatagcatccaataaatcagaaagaaaattgcggcaagtgctacaacatagttgtatgggaggctcatctcgggaggggccaaacctagtcttgtagtgagataggaggccgctctgaagagatgatgtagggagtttttgtcttttatttttcctccaggatccacctgagttccttttcaagacacagttcctttaatttttaaacacatccagccattccagacataagaaaaagccagccgatcaagtcgcctttgggactaatggctatcctgagagctcagctttgcttggaagttgctattttccaaaacagcttgagctaaataaagatggctgggatagttgatagttgatatttgacacctagstcagccgatggtgttcaggttgttgctatggcctggtagtaaagtcccttttctggttactttttacttgttgcagtaactgtgatgtggcttttcaacccattgactgttaatttttttttgctgatattttcagactttcatgctgtaggttcctccattctcaactgccccaaccaatcctatgtgtttctggaatatcaggcatgtggctatttctttttttttttttttccttaggtagatatattttttaaaaaataaataaagcaattctgttcttttcaagtgaaagaaaatgcagtcactctccagtgccaccatccagagataaccacagttgacattttagtgagtgcagttctggggttctctcctggcatctctacacagagagatgcaggtgcacagttttacagaatgggagctctatgtgcttttccgtaaatcyctctcttcactcctcagggtcctatggacatttttgtaaatcaataaacatcaagcaacatcattgtttcaaacagctagagtctggatctaccatcgtctccttaaccaatttcctatcgatttaagttgttttcacttttctacacttccatcaattctgcagaagagagctcatctcttcccatgtttgtgacaatttctatagratatatttacatgagctggattaatgggatggcggatatgccctgttatgttttgatccctattcaggtgatgcttctaatcagaggattttagtctgtatcttggctaagcttgttcatgcagcaggatacaatagtctttcttttcacacacaaacatactgatggatatttttgtttgtttctccagatgacactcagtatctacaagtttttgtggtcatttcactagctgttttgtagattgtggatggccttgctatggaatccttgctggatattgtggtggaggcagaggaatgcagtggttgagactggcccctttccttaggtcatcactggaattttagtgaagaagtgctgcccagggatggcatcattaacatgctgcagagcccttgagcttggaggagacagcacttgarttatggtacaattcactgtaaatgtgttttatggtcgcctaaaatgtgtttaggtgaccataaaacacgttttatgaaagagttgcataatccaatcagagaccatttcccaaaaggaaaattcacagctaaatggaatgaaaagtattatctgaacttcactagctattgactccacctagtcgttcaagaggaaagcgaatgcttatacattgttagtggaaatgtaaacaaatacaactgtatggaaaggaggatggatagttctcaaaaaacttagaatagaactaccatttaatccagcaatcctgctactactgggcgtctacacaaaggaaaagaagccactgtatcaaaaaaacacctgcactcatggttatcactacgtatattcatcaccacaccatacatacatacacacacacaatggaatactattcagccatataaaagtataaaatcagccgggtgcggtggctcacgcctataatcccagcacttagggagggcgaggcaggtggatcacgaggtcaggagatcgagaccatcctggctaacacggtgaaaccccgtctctactaaaaatacaaaaaattagccaggtgctgtggcaggcacctgtagtcccagctactcaagatgctgaggtgggagaatggcatgaacccgggaggcggagtgtacagtgaaccgagatcgtgacactgcactccagcctgggcgatagagcgagactccrtctcaaaaaaataaataaataaataaagtataaaatcatggctttggcaacaatgtggatgccattatctttggtgaaataactcagaaagtcaaatactgcatgctctcacttataagtcagagctaaatcatgtgtacacatggacatagagtgtggaataatagactttggagactcagaagggtggaagcgtggcaagggtgtaacgtgtgagaaattgcttaatgagtacaatatatgttactcaggtgatagttacactaaaagccaagacgtcagcactctgccacatgtccgtgtaacraaactgcacttgtactgttaaatctatacaaataaaaaagaaactgaatctttgccaagttgctcctaactatgtctgaaggtcctctggtgatatctcacaccggctcagaaccaagacagtcggctcccttgtcatagccattgggatttccctcctscatatcccaggcccccaccctgatgggcaccattgcacatgtcaggcccgccctgatgggcaccattgcacatgttaggacccttggctgctggctcatgggagctggataccaaagcatctgctgggacaggagagaatgcctgaacccctttattctggtagaagagtatctaaccaaccaacagaactgtatgtttcttctttaatgtgaataactgtgaaaacaactcttttcatttttatttatagctctctctccccctaaattcacacatgcatctctggggctggagatcagctcaagagatggacaccccattgtttcctgaaacactctcctctctaaccatgaagtcttattcctggactagcctatgtatctgcctctcctctgcccatcacccatgctcatatcattcacattagacctttgtattctgggtgaactggggagatgtggcccttgggttcactttgattacttccttgtaaaaataaacgcttaatagccctgcccactaattttttggatatgatattttaggcccaagccgggagtcatccttccatcactctatatttggaagagggaaggatttgtggcatcaaatatttaaaaataaaagtaaaaatattaaaattaattgagtaacttaattaaaataatagtttaaagtggcagcagggcaaaggagcatttgtagcttcagaaatgtagtgatcattctacagtcttttgaaaagataaacctgacaggaatttctagcsaaaatgaaaattggtgacggttgagcagctgcaaagcaaaagtgaaaaagtccttgagttgtcctagcacagaacgtgctcaccagcgccgttggatcctatccctgataccaaaggatccactgtgaatagcccagcaatttttagcactgcagctgagtaaaacagagtggcagatccaaatgtcattaaacatttataatttcggggaaacccttatttcaaatcaattcttcataaccatttcctcagtaaattcattcaacaagtatttatcgggsagtttctatgagtcagataatattataggggctggggatatagcagtgaccaagaccatttagaactctattcttaagacattgccaccttcctgggaggagaaaggtgccaacagaaatggataagccagataatttaagtttyggataaaataaaacaaggtacattgttttattgacataaggtcaagaaaagtcctctctaaagaggtgatgttgaagctgagcccagtgaaataaaggagcctaccaagtaaaggcatggagaaaggatgttccagacgcaggggccaggaagtgcagagacctgaggcaggaatgacctgagggacggtagtaccaggtgagacagggagatgggcaagggcaagggcaagatcgttctgagcatgagtcaacaaactatgggccatgggccaaatgtgtctctctgcctgttgttttttaaataaagttttattagaatacacatgtgccccttcattcatgtattgactatggctgctttcgcaccatattggtagaattgggtagcggggacacagactgwatattccacagaggcaaaagtatgtaatacctgatcctctgcaaataaaaagtttgcagacccctggcttagaactccatacattttgattacattttaaacttagtaggaagcccttgggtggttttaagcaaggaaatagatatgattttactgctgaaaaatgacttgtgctattctgtggagagagaaatagggaaacaaggcatttcaatgttctaggcatgagaaaaccatggcagctacggagatggagagaagagatcacataaaatttttacagcaagtgtgtgacaaatcggaaaattctaaatattgagtcattttatgatgccagcttattataactgatgccatctatgtggaattacaataatactgtaagccttaataggtttataaattttctgcaagtataaaccagaatctaccttcagttctctttctcagcaacacagttaagaccaggagaactgaatggttttctcttcatccttcaacttccaacatttagcagagtcccaggcacaaattatccacccaataaattccactggatgaacaaatggctccaaaggccagaaagcctgaatcccgataaactgttttttaattcaatttttaaataaatggttgtatttattgaaaatgtattcattctttcaacaaatacctttagagtacctgccgtataccaggtatgctgtttaatgaggatggggttggagggggtgaatgcatgaaacagaatggatgctgactctgtagagcttgcagacgaaagaggaagtcagtaaataaagcatcactgttacacaggggaacgtcagttttcaactgctacacaggggagcatctctctaggattaagggagggagatgatgcctgtcccagggtaacacagcagtggtaatcagctgtatatttttctagcactattatgtactggatactggtccaggttccacacctaccttttaaagcagtccttacaaacgtttgacaattgaggaaacagacactcagggaggttaggtgactccgccgtggtcacacagctggtgggtgatgaagctcagatcgaaactcagacctgtatgactctaattcttgtgctttttcatttcatccccatccacaacacccactgtcctttaactatttcacccgtgatgatgttgcaagtaattccaaagttgctaccttaaatgtaagagagcattttcttacacagatgagtgagtttatttattttcatgtgtgtgtgtgtgtgtgtgtgtgtgtgtgtgtgtgtgtgtgtrtgtgtgtgtagatgagaaagagaaagagaaaaccaccaaccttccttagtcattttatagtagcccagcttgccaggtaactccacgcagcccatccttactggtggtaacctcaaataaagccagattctccccctagcggtagtttgagagatgctcaacaactcgaagattcataaagcatgctgagccatccatcagtcaagacaggccacaaatgtcagaaaagattgataatcagcagggagcttgataaagcagcttttactgcagcacccttgctctaagactcccatcccttctgagaacgcagtctagagctgctgcttccatttatctatacaaatacctttgaatcacttcaccttaatatatatatacagtaagatttttttaaagccctgaataatttatgtatagaatcacctcccttcttaaccaaatggaagagattcagtatgctaagttcaatgggaagagggtatataaaatccctttcaagtatatgtcttataaaatataggtcatgaattgagtttttcagtatcaaagaaaaaaagtttaatagacttacagctttsttgctttaattatgggtgcattttttaaaaaccaagtatagtacccaagctattttattattcagaagactggctcttttcaaagaagtgtcaaaagtttggtttggggaattcttgtgttttctttcttgmtscagttttccacttttctttagtgtgtcaccatctttatctcctatgatactagtttataawaggcttctaacatggatgccttcctcttggaagtgggttggggttcgtgtttctatagtcaagctctgtatccttaaaaaaaggcctgcttttcagaatgatggaggacctcgctggcctgtttccctggcccatcamatccagactccagagctgctttgccatctgttcctctccttccttctcatttctgcaattttaccctctatctagctgaagaggttctatgcttgttggctcacactaaagtcataagccagggctagaggggatgacttgaatagtaacatgtgtgtacatatacgtgtgtatgtgtctgtacattcacatacacacacatgaaatcagcttcggtctgtgatgcaccattcaaaaatgtctgcgtagattttcactagctttggaaaccacgtttgatgtggtttaactggaaatattgacccacgcaactaaaactcaggtaacccaagagactactactgctggcagagtcgtgtttgstgatttcagacaccatggagcagtggtccaagtttgaatgattttgttcccaggagacactttgggttccacactggggaagaagagggtacmactggcatcgagcgggccaaggtcaaggactggtaaacatacgtcaatgcatagaacggcctccacagcaaagaatcatttgcctcaaaatgtcagtagtgccaatgtttctccctaaatggagaaaatgtggagttttagttataaagcccaaatgtaaagttggcaggagagatgctacaaattgtaggcattggttggtacctttttatagtgagccacaggaacccattcctctaagcaggatcratggacatggagctcgttttaacagtgagcattttgcgagtgggagatgttgccaggccctctgctgagggcttcctgtgtgttatctcattgacttgccacagcaggctagaggcggatgctatgatcatctctatgtcccagtgaggaaactgaaacttcaagaagctagaaaacaaactgtccagcagagcagaagcattttcctcaaaatccattctgctgtcctttagtaacagacctcagtataccttagcagcaggtgtccgtatgaagactgtattgctcagcctccctggcagctaaatgtggtgatgtgaggaagtactgaccaacaagctagaagcaggggtctatgttagacttctaggatggattctgaaaggagccacctcacctaggaagagtaccctgtattctcctcctaccacctatttcttttgctgtctggagtagcgatatgatggctagaactcaagcagccaccttgctctgtgacacggcctcaagggtagaaaatatgtgctaggaaggcaggacaaaacacagaataagacctgattctgttgcctgcggaatgccatggcagccctggattgcttctctccagaattattttacataagagaattatgaacttctgtcttatgtaactcagtgttatgttgaattccctgtatttgtagccaaatctaataacwgctgaaatatgcagcatcactcaaccagtaaaaattagagcccagactatatgacgttgagtcaagccacgctttttaaccactgtgctttgctgcttgagacataagcccacttacacctctgtatgcctttcatgcaccagttttcctatggtaatcagaaaattgagtctttattggaacaaaaatggtctttgtctcctctgttatcttagagttccttccagaaagcattctaagrcctctttgacattagacatttttattaggttaaaaaaaaccccactgccttatgatgggaactttcttagtgtagttattttgatttcctagtattactgtaatttcagatcacagtctagtactaataatctgaagagattccaataatgcacaccatgatggggctgccatttatgtcagtgtgctggcttcgtgtccacattccaggggccagagaggaaaactttaaagggctctagaaggttttcagagaatattaatttttttcttgccagtgaatcaagttgaagtgcatcatgagaaagtacctgtgagttcatcagggagatcaatgtattctgacaagggtacagcacaagggttgagatggctgattcccatctccaaaagatctggttttcagctatgtttccactgtgattatgagaccttaaacatgttatcttacctctctgggctttgagtaactcttttgatcatgaggctaataacaatgccccaaaaggatggctgtgaaggttctgtgagcaagtagatatcaggctttgagcaccatgaccaacaaaatgccacgtgggtcacaaatactggcagccagcaatggcttcttttcagtggtgctagttcaggagggtcttagtgtcgtcacccagcagcttgcaggagttggaaagactctagagacccatggagctgaattctagtcctggctccttctcttatcagctgtgttaatttgagcctctatttcctctactgaattggtgataatcttctgtggcagcactttgtacgagtttgaattgggcacattcgaaatgattcattatagaaatataaataaaattttatttgtgcacagaattagaaacagtgtrctctccaaattttaaatatttgtcacaaatttgcaatttcagagtggttgtcaggattctctctctcactctttctcagttttaatgagatatcattcatataccatacaatttaccaattcatccatacaaaatttgtcattcggtggtttttaatatattcacagaattgtgcgatcattgccacagtcagttttgaacatttctattatcccagaatggaaccctgtagccattagacgtcgttccttatagtcttaggacaccacacatatactttgtgtttctataaatttgccttgctgggcatttcatagagagagagtacatagtacgtgatcctttctgcctggtttattttacttagcgtgttgttcaggtttcatccatgttctgtgtagcaggtaacagtacctccttcagttctattgccaaagatagggcttccttttaaaataaatttgctctcgccataggaaatatcgctttagcttgtgcagatgaatatgcacyattcttcgtcaagattagtcttgagttatgcaaattctgaattatctgagatattcgacaatgtaccacgtacggaaaatacatctgtgttctgtgtaccttgcagttttgttatgagaattaaatgagataatacacgtagcagcagggctcaatatatgggagggggttcctcaagaaatagagccttctacaattttagttggtttgattgtttcatggtagatctattttttatctgctttttctataatctcaacctttttttttttggatttgggcatacacatgcaggcttattgtatggatatattgtgtgatgctgacgctttgagtatgattgaatctgtcacccaggtagcaccatagtacctaacagttaatttttcaaccctttctcaccagcaccctccgctagtccccagcgtctgttattgccatttttatgtctaagagttccttatgtttagctcccacttataagtgagaatgtgctgtttttggtcttctgttcctgcattaattcaataggataaaggcttccagctgtatccatgttgctacaaaggatatgagttcattcttttctatggctgcatagtattctgtggtgtatgtgtacattttctttatccagttcaccattcatgagtacctaggttgattccatgtctttgctatttgaatagtrctgcaacaaacatatgagtgcatgtgtctttttggtagaacaatttaktttattttggatatatacccaggaatgagattgcttgttttaagtgctttgagaaattgccaaactgctttccacagtgcctgaagtaatttacattcccacgaacagtatataagctttcccttttctccacagcctcatcagcatctgttgctttttgactttttaaaatagccattccaactggtgtgacatggtgtctcattgtggtttcagtttgcgtttccctgatgattagtgatcacaatttttcatatgttttttggatacttgtttgtcttcttctgagaagtgtctgttcatgcctttgcccacattttaatagggttatttgtttttcgcttgttgaattatttaagttccttatagattccagatgctggacttccatcagatgcataatttgtgaatattttctcccattcggtttgttgtccatttactctgttgatagtttcctttgctgtgcagatctttagtttaattaaatcccacttgtcaatttttgttttccttgtgattgcttttgagaacttagccataaattatttcccaaggccaatgtccagaatggcgtttcctaggttttcttccaggattcttacagtttgaggttttaaatttgaatatttaatgcatcttgagttaatttttgtatatgatgaaatgtatgggtcatttcattcttctgaatatggctatccaggtatccagaaccatttattgaacagagagtccttttcccattgcttatttgtatcggctttgtggaagagcagatgcctataggtgtgcagctttacttctcagttctttattctgtctcattagtctatgtgtctatttatgtaccgtaccatgctgttttagttaccgtatgcttacagtagagtttaaagtcaggtaatgtgatgcctctggctttgttcattttgcttaggattgctttggctatttggggtattttttggttgtatatgaattttaatagtttttctaattctatcaaaaatgatcttggtagtttgataggaattgcattgaattcatagggagctttgggcagtatctcatctgtttttgtgtttatctcactttaaggaatctccatctatgaaaattccaactgattaaataaaaaattagtcataagtcccctctaacagacctgctcatcaagtgtctccaagatgctgtttaaaaaaatctggtttcttccaaagtgtcaggctttcaggagcccaccagtgattcaagttacataccccttcataaatttccacgcacatccacatattcatgaggcaatctgagacctttacctttgtcagcctgagtacatttctattatggcaatgtcacagccgcgtgtatgagctgtaatgaaagacagcttttgaaaactcctattctaaggtctttcctgacctatttcagcaaaatgtgtaagtgaaagacatttagacaccttttgtctttatctctttttgccctaggcaattaggtgccacaacaaatgacatttttgctccttcagcaagccatcatggctcacctcataggtgggagacaccaggatgaacactttcaaattctttatcccattccatccccccagtgagattgggtattactgtctccatgtttcatgtgaggacacagaagctcagaaaggtcaacacccataatcagagggggaaccatgtaagtctgcctttgcctgacctcaaataccatcttccttcaaggatactgcatttcctctgtctcattgtgggttaattacttcttagtatgcctgcttgtcctctatgataaggcacttttatacttattcggcggtctctaacataagcattcagtcctgctccccagccaaggctgtgcatataaataggaaatgttgattttattgcttatgggagatgcaacaggcaagcatcaaaaactgtggtggggtttcagctggaagtgtgcacgttaagaagctgctctaagtcatccctgtccatggggtttttccttacagcatgagacagtccggctatgccttgtcctaattgcaactcaaaggataaggtcaaactacattttaaaaagggcaaacatcaccaggaggaaattttctagagttagaaaaactgtaaccaggaatctagagatgacatttatcttttaaagtatcaatcagagatgcattctgtttcaggcaacaaaatagcaatcagcacagcttaaacatcacaggttgattttcctcgtatttctagaagctgggagatgggtggctgcttcttgtgcttcattgacttgatagttggcatctctgtgagtctttggactttcctttgtggctccaagaaaaagaaaacatataaagcagtatttawatatgtgtaagcacatatgtgagtatgcatgtgtgcaagtatgtgtgtatacatgcattgtgggctagggaggaaggaatttggaatggatttggggttagcctgtgagtggtcctcacactgtacccaaaagttaagagaccactaaatgaagaagaaaccagcatttcccaagcttttattatgaatttgagaattagttggtggtgagaggcatcactgaaatggtcaattggttaaataagagaaggaatcaaagtgaaactggcttctttactggcagaattttgagagacttcaagatgtgaataggcatgtcagtttccaagatgatgtcacaccagagaatctgttatgagcaggatgttccgtcagcctggcacatgggaggtggcagatcctttggaacggcagctctcagatcctgagctgctaggtatcatgggatgctgagtgggcgtgctcctcctccatagaggagttattaaagccacagagttaaagtaaaatggcccgagagcaagacaatgaatatcagagagggtcacaggayatcaagtggacttgtgaccttgggagtgtaagcacctacagtggacagaggggagtttgtgagcaattttgggataggagccatgacattaatacttcttgaatctcattccctccacactcacccctccaatttagctagctttctctgaaaagccgatactcaaagaataaaatgtttaccgaatgaattaacatgttatataaatgtcaacgcaagaattttggagggtcatttatttcactgcttctcatggggaccaagcatccatctaggttcttggtaggaaattgactatctgggatccttaagatagacataataagtccacatacaaaatggcagacagattttctgcctgtggatctacccagaactgttggtagctgtgttttgggtttccaggtagtctctccctcactttcctgttgactagtaagtgcctggctttgatgtaactgtactgtgcaagatacagagccatgattttcatacatatcacctcatttcagccttgcattatcccgagaaatagataaaggagttctcatttacagataaggacctgaacctagtacacaggaaacttacctaagtctcacaacttcccttcacatcttctctaagaccatgtgaacctgtctatataaaatagagctcaagatggaagaggtgactttaaactcataggtttttaccattggcccagaggaaaaatggagctggaactccattacttggttagtctagggaccagtgaaagtagagtgataatttgggacttttatgaatgtttcttttatagatgtttgtatcagccactgttctctagggaaacagaaacaatgggaagagagtgtgggttggaggaggcagacagaaggaagaagagagagagagattcattgtaagaaattggttcttccaaacaccacatgttctccctcataagtgggagttgaacaatgagaacacatggacacagggaggggaacatcacacactggggctttcaaggggtaggtaagcggcaaaaggagggagagaattaggacaaatacctaaggcatgcggggcttaaaacccaggtgttgggttgataggtgcagcaaaccaccatggcacaggtgtacctatgtaataaacctacacgttctgcacatgtatcccagaacttaaagtaaaatttaaaaaaggatattggttattatgattatggaggctgacatctgcagtcagtagctggagagccaggaaagctgatgtgtggctccagtctgagtctgaagtcctgagaaccagagagctgatggtatcatttccagtctaaacgccagcaggaagggccaatgtattgtttaagtccgaaggctggagtggactgatgttgtagttcaagacaggyctctgactcagctttttggttctgttcagacccgtaagtgagtagatgaggcccaccacattaggaagggtcatttccttttctcagtctaataattcaaatggtaatctcttccagacatgcccttacatccagaataagagttgcccaagtacctggttaccccatgstcagctgagttgactcataaaattaatcatccaactgttgtaggccaaatgttggccccatgatctccacctcctggcattactcctgcagttatgtggcctcacatggcaaaggagactttcttagtgtaattaaggttattaatcagctgaccttaaaacaaggaggttacccgggattatccaggtggacccaggtaatcacatgggccctttaaagcagaagaggaaggcaagagagtgaagaagagagatgcagcagcagagaagagttagagaaatgaggccaaagttagttcagagggttgccaattctgagatcctgaggattcaacctgctgctggcttgcagatggaattgggctgcatgggaagtgtgagaaataaatccattctgccagcaccccaaatgatgctggaaaaggatttttccccccagggactccaataaggaacactgccctgctgaaactgagattttggccttatgagcccctaagcaggaaacctactgtgaaccccacggaggtcatacttctcacccacagatactgttgttgttttaagccacttaatttatgataattttttacaatagcaatagaaaamtaatacagaatgtggttacattatcttacataccatttaagagtaaagctgcttttcacaacaaaataacagggatttttttaaaaaagcacacacattcataaactgttgaacagctatcaaaagttcgttttcaaatgaattaccaacttacaattttcaagtattcccaataccaacatcattcttaaattaaaacagcaacggaagcaatctcagggacatgtttagcaacacttcctagtgaagctcccagaattatgaatacttttggtatgcgtgcgatgccactcattaccacgaaccgtcttttgaggaggttgcgctgactgcattaaggagctttacgtgcgagtccccagcccactcagctttcagaagtcacatcgctgcttgccacaattcacctcgctttcccagagtagacatctttcataagatgctgggatttgaagtggaaatcacactgacagaacgacatcatccctgcgattgggataagctaccatcattaaggaagtcacagttgctggtttaaggcttgtacaagcttttcgatattctccagatagtctcctgacacctacacctagaacacatgtgttggaagtaatcctttatgataggtcccttaatgtacttgttttggaatatgaccttctcctgacctgtcttcattgcagaattgctggaaagtctgaaatggggagcacagaaggtcatggtgtggtggttgacacttaggaactctcaaaaaagtgtataaattgccttgatttatcacatactgtgcgtaagttatgctgttctcattcagccaacagtrtgtttaatacccaaagccctctttttttttctccttctttgtttttggcatataacagcttattgcagtataattcatmgactgtatgattcacccatttaaagtatataattcaatgttttttggtctatttataaagttacacaatcrtcgccacaatcaattttagamcatttaatgactcccaaaatgaaattctgggctcattaacgatcatttctcatttcctcgaaaactctttggtactagacaaccaatgatccactttctacctccatggatttgcccattctggacatttcatataaatgcagtcatgcaatatgtggccttttgtgtgtcttctttcactcagcatcatgttttcaggttttattcatgttgtaacatttatcagcacttcatttcattttattgattattaatattgtatgggattatattttattttaagtttttacgttatattttatgacatttatccatttaaaagtccatggacatcgggttgttactactttttggctactatgaataatgctgctctgaacatttttgtgtaagtttcctgtggatatatgttttcatctttttcttaagtatatatctgggaatggaattgctgagttataaagtgactctgtgttaacctttggagaaactggcagactgtgtttcaaagcagctgttccattttacatttccatcagcagtgtatgagggttctaatttctccactttttaccaacacattattattggtcttttattatagcctccttgctaggtgtaaaggagtatctcattgtggttttgatttgatttcctttttcaagattgctttgcctagtctgggttctttgtatttccatataaattttgaaatcaacgtttcaatttctgtgaaaaaagagaaaggcagctggaattttgaaaggcactgttttgaatcaatctgtagatcaactggaagagtattgtcagcttaacaatattgagtcttcccatccatgaatatagaatgcctttccatttatttttgttaatttccttcaacaatgttttatagttttcaatagacaagtcttgcatttattctgttaaatttattcctaagtatatttgatgatattgtaaattgaattattttcttaatttcttatgtggattattcattgttattatatttaatcaattgattcttgtatactgatcttgtgtcctttaaacttgctgggagctctcttttaacatagacrttattatgcttattttatgtcttcatttatttgctcaaatctcgtagtagagctactggagcccaacattcatattctgtttgttatacactcataattatacaagtacatgtgcacaagtcaaatattaaacagatacatactgaggtagcattgttccaaatcctcatctatttgagcttacctttctaacgtgtgaactaattatggaaagaatttggttgcttgctgtagctcatgacttaggacgcattttcccctcttcaactgtcttttatttgagccatgattgaattattcaccatgcctagttgttttccttttcctaaacatttaaaaattaactcattttcttttttttctttttttatttcaataggttttttgggaacaggtggtgtttggttacatgagtaagttctttagccgtgatttctgagattttggtgtacccatcacccgagcagtgtccactgtacccaatgtgtagtctcgtatccgttgccatgcccaaccctttccccaagtccccacagtccaatacattattcttatgcctttgcatccttatagcttagctcctacaggtgagtgagaatatatgacattcgattttccattcctgagttacttcacttagaataacagtctgcaattccatccaagtttctgtgaataccattatttcattcttttttatggctgagtagtagtattccatgttwtatatatatatatatatatatatatatatatatatatatatatatatatatactaggtttttttaatctgttcattgattgatgggcacttggcctggttccatgttcttgcaattgcaaattgtgctgctataaacatgcatgtgcaagtatctttttcgtataatgacttcttttcctcttagtagatacctagtagcaggattgctggatcaaacagtaggtctacttttagttctttaaggaatctccacactgtttttcacagtggttgtacttgtttacattcccaccaagaatggtcatgatcaaaaaatgaaaaaataatagatgcggggaaaagggaacactttttacactgttggtgggaaaattagctcattttctagtagcagtatatctctccaacaaacaagtcacctgtttttttttcctgaacacaccatctctcrtcattcttgatgctaaaatataagcatgtaggtccaaacctgtctctcctcctttcagagtgaccagagagacccttctagtgttttgttttgtttttttgagytggggtctcctgtgttgccagtctagagtacagtagtgcagtcatggctcactgcagcatctagctccaaggctcgggtcatcctcccacctcagcctccccagcagctaggactacaggtgtgcaccaccaggccctgccaatttttttaaatttatttttcgtacagatggaatctcactgtgttgccgaggttggtctcacatycctggcctcaagtgatcctaccacctcagcctcacatagtgttgggattacaggcatgagccaccatgactgtcttcttctagtcttgatgcctctcctctccatctgtagaccccactcctcctaggtcacttcctgtgaccccacaccaacatcctttctctagaaacggccattcccaaactgtgagcctcgtgtttgtattcatsacacatatgtagcatccactgtgaagtcaaaattaaggtgaatggtaaactcaaccacctggcttcatgttgaccttgtccctagactcccattccctgcagctggtcttgctctctactttgaaaacacagttgatgccatctgaaacgatctcctccacttggatctctctgcccgtatttacctgtatctccaatatctcctgctactcaagtatcttctttttattaaaactttcatatcgttggctaggcgcggtggctcacgcctgtaatcccagcactttggaagtctgaggcggacggatcgtgaagtcaggagattgagaccatcctggctaacatggtgaaaccccatctctactaaaaaatagaaaaaattagccgggtgcggtggcgggcggctatagtcgcagctactcgggaggctgaggcaggagaatggtgtgaacccgggaggtggagcttgcagtgagccaaggctgcgccrctgcactccagcctgggtaacacagcgagactccatttcaaaaaaaaaaaaaaaaacttccatattttcagttctatcttctttttattcttcctttacctgtacctttattgatttattttaacttttgttttaggttcaggggtacatgtgcaggtttgttatacagggaaattgtgtgtcacaggggtttggtgtacagattatttcatcacccaggtaataagcatggtaccctataggtagtttttttgttctcaccctcttcccaccctccacccttaagtaggtaggccctggtgactgttgatcccttcttcgtgttcttgtgtactcagtgtttagctcccacttataaatgagaacatgtggcaattggttttccatttctttgttactttgcttaggataatggtctccatttccatccatgtcactgcaaaggacatgatcttgttcttttgtatagctgtgtagtattccacattatatatgtaccatatttctttaatccagtctactgttgatgggcatttaggttgaatccctgtctttactactgtgaatagtgctgcagtgaaaaaatgctcaacatcactaatcattagagaaatgcaaataaaatccacaataagataccatctcacaccagtcagaatggctattrctaaaaagtcaaaacgaaacasgtgctggcaaggttgcagaaaaaaagggaacatttttacactgctagtgggaawgtaagttagttcagacgctgtggaaagcagtttggtgatttctcagtgaacttaaaactaccattcaacctagcagtctcattgttagatatatacccaaataaatataaatcattctgccataaagatgcctgtacttttaattctattttctgttgactgccccatggcctttctttttaaatcattaccctctccttcctgcatcttcagtcacattctccatcatttcttttgcattagtggagaaacatatccaggtctcccaatcctaatatgagagaatccactatacccctgcctttttgttcttgcttactgcccattataagcccttttcctctttcttggcatacttatactttctgaaaatgcaatgtttattatgtcagccatgtatacatctgctgttgtgaaagataattttaggtggcatagaggtgatcttttataattttaatagctatttattttgatgtacaackaagcaatacctggtacgtttccataatttaaatcatatcattgcttagaagtaagttaaatttcaaaaatcaatttaaagtatattgaaagtagattaatagtggtactgtcaatacttacatatgaatsactgaaatactggaaggctttgcatgtaagaaaagcagaactttaaagacaaacggaactcagagtggatagtacccctgaatggacagtgcttcacgagtcttttctggatgaccctaagaaagttagttgtctacattgcagaaaggctatgaagattagagcaatgtatttaaaggaacaagaacattgtccagaaaaaaaataggtgtttaataaatggtaactaatcatcccccggaccgtatatacagatatatagggatacctttggggaaagtagaatggcccaatatgtaggttattcagttccacgtaagtgggtgttcacgagatgcttcctgatttgaaacatcaccatcatcaacaataacagcattgatgagaggtcatcatgggccaccactgtactacgcctttcagatgtacacctcactcattcccagtttgcaacagctttgtatgggaggttctgtaacatccccactttataggtgagaacactgagtctcagggaggtgaaatattttacacaagattgctcaactagtgacaggtgaagcagagattcaaattccagaagtctgatttcaaagttgtctctcttaaccactgtgttgtatctcaaatcatgacagttctaacttcatgtgtcatggtacttggcataaggacgtttttctccccattcttccccaaattcagtgcaaaaaatatatatgctgagtttttcatgggccaggtctactctattcttagagaaagggtcgggtgcggtggctcatgcctgttatcctagcactttgggaagctgaggcaggtggaccacgaggtcaagagattgagaccatcctggccaacatggtgaaaccccatctctactaaaaatataaaaatttactgggtgtggtggcatgcaactgtagtcccagctactcgggaggctgaagcaggagaatggcttgaatccgggaggcagaggttgcagtgagccgaggtggtgccactgcactccagcctggtgacagagcgagactcggtctaaaaaaaaaaaaaaaaaaaaaaaagacaatgacagagagcgacaactcatctctgcatctctgctttctgtggggaaacttgcaagtaaaggagactgacaagtgatggcgttaaactgtgctaagttgacaaaacacagaatcctcactgcctatgaatatggatctagggaagccagcaatggacctttggcagagtcaagtgaaatctttataggagatgaactgaaatagtttagaaagaatgcattaagatagttttacctaaatagtttatcgtcatatcaataaaattgatcatctctatcaccagttttaaagttggctttgacaacttttccaaagccagagtttgggcatatttgggtatttccataatattgagcaaatgtttaaactatattgaaaacgtttgccgtgcataacagcatcccaataggaagcagacggcatgctcaaactaggacagttgtaggaggacctatttttaaaagggcctagttacaaaggggaattgcaaaggataggagcataaccttgggcagtaagaactgagtaggaacagtgctccacagagagtgcaaagtaagctgatgggttgaagctaaggagcagggaaaagatctagaaggctcccaggcagaaagtgattggtaagctgagtcttgaaggaatcccttctggatagcatgagaagcttgttccggaagaaggaacctatgtacgaagacctgaaagagtaaggcatgatctgagaatacaggtagagggggtgtgacttgggcataggctatggggatggcagggagtagaaagggctggaaaggccaccatgatacaggtgttggagagaggcaggcatcatgcaaagtgtatgtgttaagactattaggaacaaaatatttgtggattaaagatataacacagtggttaagagaggcagctttgaaaccagacttcttggatttgaatctccgctttacctttcactagttgagggatcttcgataaaatacttcacctccttgagactcagtgttctaacctatccctagacctgaggaatgaaggaagagtcactgatctggaaggcgtgagtcccatagagagcctcgtgggaggaacagagaccaccagcatgggatacatccaaccgcaggcaacccgaaagggaaggatccaggggaatgagcatgctgaccttactcaaccaccaccttctgatctccaaacgcaacaggaagtcgaaggtctttctctattcaggccagcctctaaggacagaggggaggcagtggagggtactaaggcgtgctaaagggtcacactaatgatgctccgcaaagagtgcaaactttcttatatgttcttgctgctgttccataaagcaaagactggatccacataacctgatggagcaaagtcttagtccaaccccttagcctgcaaactctggaattttagaaaagtcaatagtgtgccccagacatatttcaatatacctccattttactcmaggtaaaaggtttcttgcatccatttaactattgtaaatgaataaccatgtgaccctcaagaagattccaagccaaattccattggtttctaaggtcttaggkttgcttgcttttggcaaagagtgtacttatcttttcatgcatgcctttaaagagaccatattttttctctgataaagtcaattatcagtgtatgtgctgctctgttcacagttttgactaaatagtgcaacatctacgtagaaaacataccccaaacttgagttttcctgggttgtgcattgtacattgtcaaagcgtaaagaacatctgagttggaactcgtacccacttcaggatatgagaagatgcaggtcagtgatttgtttcgaggcggaagaagcttaaagaaagtaccttgcgctgtgtgttcctccattagcatttgttattatgaaagcattagactatctctggatgttttccacacacctgagagtgtsaaagaatgacaggtacctcattaaagatgcataatatctagyctcctgttctcacacagactccaaccactggtatgaatatactgcttccatatgagcctgctgcaagccagccagatcctattcagaatatctcctttctaccacatccaaatgtgggcagcmtatatatacagatttgaagtgcaaagggtttgagtcaactttttgataaccgtggggattttccatctcaagaaattccgaaaatgatgtaatgatataatgtagcagaattttaatttagtaggtaggattaagagctgacaaatttcctctctttaagtttctttaattctgtctgtgcaagtcagagcattcggtrtattcccaccctcccagctgatatgctaaaattggtttcactgtactactctcaggcatgcaatgagctaggcaaagctgtttagttacttgcgatctgtttacattacatagaaggttggttaattagaaataatcatgtttcttaattaaggaacaaattgatttttaaagaagtgctgaggcccccttgggccacagcagataagggactgagctcatggtttgtggttgtctgtgtgattctctttaaggagggtctgaagtgtacagtgacacagctatcagtggctatgraatcaaatatttgtagattaaaaattgtactcattctgctgacatcttatgagtatctgttgtgtgcagagaaatatgttggagractctgggaacttgaagataagtaagacaaaatcagatctttaatggagctgagggtggcatggtaaaaacagkcttgtatgttgtatatttagcaaactgtgttaagtcctagaagasagatgggtaaatatcccaggaaaacactgagagcaaagtaagctgatggggtgaggctagggagaaggcaaaagatctagaaggctcccaggcagaaagtgattggtaatctgagtcttgagggaaccccttctggatagcatgagaagcttgttgcaggaagaatgaacctgtatacaaagacctgaaagagtaaggcttgatctgggaatacaggtagaggagatgtgacttgagggtaggctatggggatggcagggagtagaaagggctggaaaggccatgatacaggtgttggagagaggcagacgtcatgcagagtgtatgcattaggactattagggtgagtttaagcagggaaaaaaaattgcatcagctcatttatttaaaggaccaagaggagctttagggatagcagtatctaggtgttccaactgtattgtgaagaatctttcttacttattccttggctctgcttttctctgggatagctttccccaggtgatagcaaacaaaaatggccacctggcattttccctactattttagcaaatgaagctgcccctcgcccttcataaaagtattgttcccatgtaactccctttaaagttttaggtatgcctctgttggcccagtttaagtcatgtgcccatccctgaattagtctctgtatgcacagatgtggaagactcaaaggggcttgtgcctacacctagagccaggtatgggggaaaggtgataccagcccttcctcaacttcaaggactaagagtgaaagaatggtggtcgcttaagggaaaaggagaatgctgatatcaagagcaaggagaacagacgcaggacagaaataaatagatagctagtatgcaaagatgtcaaagtgacagctcttgatgagttttgagtaaaaacgacatggacacattttcattagaaaaaaattattctggctttggagaatgggtaggagagaggaacatctaactcggtgagatgctagcatgatgacaagggcttggtctcaggtggttgtggtagagatggtgagcatgagacatgcatartctagagagagttaggaggtacaaaagatggacttgggggtttctgatacattacaaagggccagaaatctttgagcatcttgtcccctccccttgattctaggtgaggaggggacattgatttgaccaatacaatatgtagaagtgacactctgccacttctttgatccaggccttaagaaatgggttgatttaatttactgtctcttgcaacgttcactctgatagaagccagcaccacataagaagtttggctacctggagactgccctgtgtggagatgctcaagctatatgaaagggccttgaaggatgacatactgtatgaacagagaggtcaaggaggagtgaagcactattcatgggaataaaggagctatatcagaattagactctccaaccctggctgacctcatgagaatctgagatgtaccacccagctgagtccttcctgaatccctaacccacaaaatcataaacacgataaaagtgacaaaatgtttagatgttttcattctacagcactaaataaccagaataagaactgaattaaacataaaaaggagggaggggtttatgttatcagccaatggcaagcaccactgaagtttttaacaaatataagacaaaaggttaaaccacacatctggcccacacccagcccccagttcctaaaaagcctggtccatctcttcctcttcttgccacatctcaaaggctatctctctatgtggatataaattatagatttaggttatagtttcccttcctcctggggtttcctctttgatgggactgtcaaactcttgggtgagctttattgtcagtcacagggtctgtcagttttcccatagtagtattatttcactcatcctttaatgtgcccattggtggtgacaaattttctaacatgcaaccacaggccataaatgtaaaaataaagcaaaagtcattgaattgaaaagcaggagacactttgcaaggctccaaccagtgagcttccatttcttctgcctgataatgactcccacacttatgccatttcttgagaactgtaaccagaaacccatgttttgggagtcaatagaatagatcagagcaaagacaaaggcaagagaagtgagattggtctttgttctggtgttatctggtagaaagaccataacacacagctaaccaataaggtactttgcaaaaattagaaaaaggtgtccccttcaagcagataagttctgagaaagtacccctctggaaagaagcagaccattgaggtcttggcttaatgagtagaagatgaatttgcatgtaaaacaaatatatcccttcttccagagagctgagcaagaggagggcaggctgctctcagtaccctttggacccgctaccatgcatggtggctttgaaaaagccaggcatttgcttcctaagagcacaccttgcagaagcagcatcaccatcatcactaygatttatccagcctttgctctatggtagatgctgtgcaagtgctttcggtctcatcctgaaacaactattgatatagatgccacatagatgacaaaacaacaactgagaatcttgatgccttgccctgaaacacacagactaggagtgggagagctgtaacttacacctgacctttctagctcacatgtggcctcctgttcagcggagagggacttcttggagaggtgccctgagaaaaacacatcccttgaccatgagtttttaacagtatcagctctcatcgggacattattatgttctagttgtctgcaacgataatatatgtgactgttattttgtctcatatctccaataaaggggtccccktcagttggattggccataccttcaggtgggatgcaactgtgagtctgtgtacatggcccagaagcaaatgcagcacagtggagtgattaagactctgatatgatccagttattgctggactggatctctgtttcttattatcatatttgcatgaccttaggcaagatacttgactgctctgagccttagtttcttcctctttaaattgggatgactgtagtttgttataaaaatgctgtagataattcccagacttgtaggtaacacatattattaaacagtagaactgtcgtgaccattaccagaaagattttacaaacaccctaaaatcatcataggattcagctagtgttcttagccttctaagctcacaccattgtctcatgctaaacttgtggtccaccagaaacttaagtgcatatttcttataattatttccaagataggtttctccagtttagaaattgtatatacacatgcatctatatatatatatatacacacacacacacacacacgtgtgtgtataacatatgcttatccttgatgtcatatttacccatgatttttattttaattagctttaccccatgggaagaatacaatgtcttttgtcttcaacctggtttgttggcaattattcttagcctttttaaaatattcaaaatctcataagcatgcattctgcatcttcaccaaagtaataacaactgtatatggtttagaagggcactgactacctctccctcaagtgtcaactaaaaaatattagatacgaagcttgagtcaagaactgtcctgggtgctgttgactcttctacgtccggtgtcttccatggcctatggtacaaagtcactccagaacattggatggatggatgggtggagagacggatgagtggatggatggatggtaaggttattgaatagaatagaattatatatttatgtttacctttgcctaaaaggcaaccatacagtgttttggtgaggttgatcaaccagttatatatttacctaagagtttgatcactcagcccacgttttcccatggtatgcacaacttgatcatgagaaggttttcacaggccttcctgaaatcatgatactatatatttgccaggctcctggtttatcagttacacaacaacagacttgaagaagaaaaccagctcacatctgtgcacaaggagacacacagttgttcattactgcattgtttgaaaaccactacgttgtaaattgcataaatgtgtatcaatgggtgaatggctaataaaaactttaaaaataaatataaaactgcmattcaaaggaatgaacgaaatattatataaatatataacccaataatttctataaagattatatgtgtgtgtatatagatatatgtattatatatgtgtgtgtgtatatatatatatatatatagagagagagagagagagagagagagagactgtcccagaacaaggaagccaattttagggcatattccatataatacaatttttaaacaattaataaacatatacataaaatataccatattattctcagaaacaaatatatgcctaagatgattcaaaatggacattggtattcttgcgtgaggatgagagtggttgtcattggtaaaaaggttgaaagtcatagaacaggatatgayggatcaaagatcttaagctttatctgtaatattttatttcttttaataaaataaagacaaagcaaatgtgacaaagtgttaccagttggcaattccagatggtgggtgtgctgattttcatactattgttctttgtgcttttctgtgttttcttaaaattcccaaaatatgaaactgaagaaggaaggtaaccatcattggttgctgactgtcagcccattcattctatttttgctcccagctattttttatttgaagataaaagacgtgacagatacacgtgaaacctttctatctacctacctaatttaggattagacttagctgcatgtaaaagaaaaaaaaatctcaagagtgagacatttctttttatcacataaaagacattcagaggtctgtatagggcagtctggagacgtcatttgggacaaaattctaccattctcagcacgtagattctgccctccaggccacttcatggctcaaggtggctgattggagctccagccttcacctccatattctagaccaacagtaccctcccttcccaaaattacctctgcttacagctcatgggccagaattcatcacatggccatgtaactgcaagggggacagagaatatcatgtttcattagggcacattacccaaggtttttttttttttttcctttaattaaggaaaaagagaagagtgtatattaggaagtaactagcagccctgccacaaaaatgccctcatcctcactgccctccctcccttctcagaggaaggcactctcttaragttagtatataaccttcttgtctatgtttctataattaaataactatgttcctatccatttaaaatacatggttttattgatcttaaagttttaataaattctgcaattattgctttcttgttccaggaaacatgctaagtacttcatgcttattatttcattgtgtcctcaatagatggtaacaactacctatttaatagttgcttgcttttttcacattttagcaaatgtacctttttctaatttctaaagttgatgttccctccttgccatctggagtgagcacatctctttagcctccaccagttcctaactgcctgaaattttcccagaaatcgtggactccccctttccctgccccttcatgtcttcctggatttctgacatctggcttctcctgcctgtgcattaagagttccaaacctctctgacttaagccaacagtgactttcagtgttgtgcgttccctatccatgttcatgattttttagcaccgagatcgcatcagcaagaaccctcaaagccctgggatgcagttcttctggatctcaagtcttgaacacattaaatgataagctctttacagactttctcttcccaattattaagcagsaattacccttcacatcaccttctcccatatcacctctataattccaaccactctcacctaaaaaagctcacctaaacccaccacttgtctatctgagtcaaatcattccaaaccaaagctgcacatgcctgaaattagggattaaaaaaaaaaaagtaccaagaggataaacaccttccttcctttactagatccagggtatttttcaactgaatgcagccattgccaccctatatttggcttttagagacagactgaagtctaacaagwtgctccttatacttgaattcacaagtayaaaatcatatggatgacttgtgcaccttgctgtcattctgtgcagagctcygcctgtgcactccttccctcacttaccgagkgcctagttcatcctccacctctgtggacacaggaacgackaaaaagtctcccttatgacctaacggcttagagcatgggtcccataatccaatgtgaatgggcttccaccccaactctaccagctacttmttgtgtggttgtgagtaagtcacctaccttctcagaacttctgtttcttcatctatagtagaaggatactaattcctccaccatagggatgatttgaggacagcactgactaatagccataaagtacttagcttgctgcctggcacataatgaagacaaaaatgaacattgaccaatactagcatcatctgcatctccaccatttccaccatcatccttaattggttgtgcaaataaatccacaagtacaatttaatcaggtaaattaatggaaatattttattctggggttattttaaatgtacagaaaagttgcacgaacagaacaaagaacttccataccccctcatgctgatccccagctattcacatttcactgcgtacactctatctccctatgtatgtatctatgtgatgtcccttcaaccctcagtgctccatcatatctgcctccccaagtacaccctcctgcataaccaccatgcaaacccacaagtcaagaaatgagcactgaaacaaaacccagtgcatcaatacattgatgcaatgtccaatctccacaccccgttcagggtttttctagccctcctacctttcccttcttaaaaataccttctgcaacagtgagaaatcttcattaacctcagatctgtccagctgtcctagtgatgtctctttttcatatctggcccaggattccatccagttacaccaatggttctcatctggagctgactttgcactcccctctgaccccacccatggtacatttggtaatgtctggagacatttgatcacacaagtgggaattggtattgacatctagggcttagacaccagagatgatgccagacaccgtgcagtgtgcaagacagaccccaagaattatccagtcaaaaatcttgaaagagctaaagtgcagaaaccccgagttacacattgcatttaattgtcacatctttgcagtctgccccagtttggagcatttcctcagtctttccctgactttcatcgtcccaacagtttggaagaatgcagccctacattctgcagtgtgatgctcaacgtggtccatctgatgtttcctcgggaccagtttcaggtcatacgttctggggagaaaaaccacagaaatgatgccatgttatcagtgttccacctgctggggcacacacaaccaaccctgcccaaggctcaggaatgttagcctctttcacctggtcatgtcaacatcctcaggtttccccccaaaaaagtcaccattttcccctttataatcaaatttgcagcaagatattccagatcatcgatcttgtgatatgctgctctcatgagacctcaactcacaagccttgactcacctgccagttcttagctgagcatctgccctgatggtgtggagtgatttcctttttccatggctccttgtacatttatggttggcattctactgcaaggaagactgtttcctcttctcccattartatattcattcatttattttttatatcagaatggactcatgtggttttaattctttggrttgttttctgttgctgtctttcttttttaatgctgtgcttaaattgtgtcatatttggccagggggagcctggggcttttgataattcctcatttatttttaccgcttactttcttatacaatgagatattctgaactcatgttgtaccttcctgcccaaccctggattgagtgacttcctcaaggaaccttggtttcttttcatggagggtggtctttaraaatcagtgtctgggtatttggtgaggttgtggctgctggagtgtcactgctgctaggtsctttcagcagacagagcaatgatacagacacacacatatacatacacatatacatccacacaaatatacgtacatatatatgggtgtayacatatatacacatgggtacatctatatgtactcatttatacatgcttgcacatatgtctacaactmctgtatctctctgcattgttcatacattaaatttaaaacacaagttcaaactgatatctccaattccaatctaatatctaagggtttttctagccctcctacctttcgtgtttatcaataccttctgcaacagtgagaaacctattattattctcaatatatctactaattgatttgatgaaatcacatgatgtaaccagcctctcaaccatgccagccatctctgctgactgccacctctgcctgacttcccagagccccatatcccaggctaccagcaggcactggtccttcctttcttccctccaagtcccccaggccagtgaaagaaggaaatagactaccgaggcgaatttatggacagaacaatagggtcaagggttaagccaagaggcttattacaagaggtaatgcaaagaggctttctgcaggaatcaacaccttgagctgccccaagggcatagaagcatcagcaaggttaacaccctgtgggaacacgagcagaaggaatggttctgccaaaggcatggaggaagagagcctggtcactctggcacttgcatgtgggtcagcagcatgggatccgagggtatggagaggggagagtggtgaagaggaggctagacaggtgtgcagggccacatggcaaaaggcctcatgtggatcaatgtggactaatgatgaatctttcctgtctcactcttcaggcatgcgcttggcttttggattctttaagtactctcagataaatccacctgtcctttccaaagtcatttccatctattatatacaagtctcatgagttgtcgtgtgtaacatggtatgtccaacttctaggaaagtattttgtacatagtatatgctcagtaagtattttaaggcaccaatgtatatttttatctcaaataagctctcctggccctctttcaaacaaagatggttggcaaacagcagccagctcccagcacaggtggcccctactgtctctacatttgtatggaaaatgtaatgggtcatgaaattgcatgcattagcatgcggatgcttagacatatatattttttgcaaacatttcatcctataaaagtaagggaccaaagtataaaattctttagaggcatcagctggaggtagtagtcaatgagagagaatcattgtttccattaaatagtaccagtttttgtaaggcaagtaagatcttcatgttaattctaagaaactgtatgcctcattaggcagctaaggcatattatgatttggatgcagaataaccccagtgataaatgaatctcccagcagartagcttccagattataatttctttctttgcaagattgctataggcaaggtggcctgatcacttttcagaggcccatcttaatagtcagagtaagctcagctatgctgtagtaacaagaaaatcccataatctcagtgtcttaataaattaaaataacttatttataacaaaatgtctaatgcaaatagggctccttcatcttgtagttactctagaacatggggtctctatggtcacctatggcatgggaaaagggattgaggtgacattcagctctttgctcagcccaagaatgaaactcatcacatctgttttcagtccagtgaccaatactagtcatgtggccccagcataactacaggagmggctggagaatatatgggaacctcctcacattcaccaaatggaatctttggtgaattytaaagattcccggcatgtcccactatctccttttggggctgagaaaatgaaagaaaaaactgacaggccaatgtactgactgctctctcacctgggtctgatcccatctgaagctactttgggtggttatcacaatgtagtttatyatagtgctrtggaatatgaactatgaccatagccagccctatattytagaaccagcatctccatttgtagctatgggtgcttggacaaacacttcaatgttctccatctcagtttcctcatctgaaaatagagtaaacaacagtaccmacctcatagggttgtgtggattaagtagttagaaacatgtcgctgttgaggaaacatgagctgctgttgtatttgaaatggtgctgaattcagaatcccatggaaatcttcactatgacaagaattaaccagcccagagccacatggagaaaagatgtgtggccaygatctcttgaccgaatccagcatcagaatccaccagacaaaaccagcatcaggacattggccacaaagggataggcgtcccaggatgctggaatgttgggggcagcgctattattagagacacctggtcactgacccagctttcttyccatggctcaagctgagacttgatagtaaaaactgccttaaatggaagcaactatatttttgatgtatgctcttctaggatgatactaaaagccatatataaaagaggtgttggttcaaaataagtgggatttttcagttccacctatacccggatagtattacccaccctacttgaggactctaggaggcaggtaagctacagtgaaatgtgctacccttgctagttgtggtcacttcatttaaggtaagaggttgtatcttcatttaacttgatgaggaattttccatcatacaattagttttgactgcaagtataagaaaatctaaccatggtggcttaaacagtttgggggatgtttgttggctgctggtattgattcaacatcatgatgatgtcaggggtgtccccactgtgattctcttagccttttctgcaagacagctgcctctgctctagtcatcacttctgtatttaaggaagagataaggggaagaagtaaggtccaccccaccttttccattgcatctagaaagccaaagtttccctgaaacatcatctttagctccctgctgcaagagactttcgcctacattttcttagccagaattgtgttatatgcccatccttagtgacaagggaagtttggaaaattaaatacttgtgttcatagactctattatagaggcaggggaggaaaacaggggccagaaatgagtgttaggtcaaccaagttacaatgtctgccccaggaacttatccaagaatagtatatgtgagaaggaggaggaggaggcaaggtacccattcttatgctcacttgagatgccatatttgatcctccctagcattcctcaacttaagggctgttctttcttctgcaggaagaaggcttaagatgtgaactggaaagttcttattctccactgagaactaattgcctgcagcaggtttcggctcacttctagttgtttactattttccaagtcactgtgattccagaaggtattgggcctcagtggagctcaaaatggatattagctcttgggtgtgtttcatcgatttgggcacaggagggaaattatacacagaggattgtcatcctggacagttaaaaatttaaagtaaatgaactgaacaaacctcctcccttaaatagtgctcagaaatcaaagarctgaaaaaatgtaaatgggattcattaagagctacaaaattatcttcttgtgttgctttgataagtttttcttgcaaatctctagaagtttagctcagggcaagtcttggacatggttgagaatgtctgccttatgaatggcgaagtggacaatggggaccagtgagaagaggctcttaatatgtgaccatcttaggatgccactggctcctacagcagtccccctggcactttccccttgctgtctctttctttgccttggtttgcagtgtttacacagcatgtccaagtgctagtttgagttaattttcattatgctcattttaacacaaaggacttgagtattcaagaatttctgtagtgctgggtttttactttctctgttggcaagaattacctttggttaacctttgtcttatagactcattgggtttcagttatcaggactggggtaaaagacctcctagacatgacacctactctgacagagaccaagaatccggcattgacaccctgaggctgtacttggctggcaggttttttattgttgtttggactgtgcagtgttttataatatttaagaatcacatttctgggctaggcatggtggcttatggctgtgatctcagcactttgggaggcaaaagcaggcttaagtccaggagttggagaccagcctgggcaacatggaataaccctctctctggaaaaaaaaaaaaaaaaaaatgttagccaggcatggtggtaatgcctgtagtcccaactacttgggaggctgaggtgggaggatcgcttgggcccagaaagtcgaggctactttgagtcgtgattgtaccactgcactccagcttggccaacagtaagatcctgtctcaaaaaaatcacatttctggctttttttgatcaacgagatttgatgatattggacaagtgtttggaggtggcaccatgggcaggagctgaggagcagctgcctgtttggatcatggcagctacagtcctcaccacaccctattgccttgcactcttcccatgatgctgatttaccaatctctgcatggccactttaggccctgcgttggtgtaccccatccagattgtctccattgtaaagccatatakttccaagsgcacagcaggtgtgtgtggtatgctgagagtccccttctatctctccaccaccctctccatacttgctccccaggatggccatggatacagctacattagcctcacctgggtgcttcttagaaattcagaatctaaagctcagcccagacctactgaatcagaatctgccgtttaataagatccacaggtgatctgtgtgctcataaggtgggagaagcgttggtctaaagcacaattttcaaacttggctgatgataggaatgaccagggcgcttgtgaaaaacccattcccaggcaccaccctaaaaccagtcagagccgacagggaagggctctgagaatccacaggcttaacatgtgccccagtgattctaagacaatggtcaattaaaaagacttggcttgaagacttagttctcaaacgggtatgcatcagaatcactcagattgcttttcattttttaattaaagaaacataatttacaaaaatcacattattgtaagaattttaaaaagtcagatatgcaaaatataaaacyataaaattgccatagttgttattttagcgtatcttaacgttttagtgtataagcatttttttaggtgtttgtgtgtgtatattttttaccaaaatgagatcgtaccataacgttattttcaaatctgattttctcagttaacaatctctatctttctataagaataattttcccatttgaccccgaattccaatttacagtgaattgttctgtctaaactaggagccaatccagatggatctggttattccatcctttatgttttttataaacaagcacattcttctcctcctcaatccctttattttattctccacataatgctgccttattgatggactggaccatttattctgcagatagtcccaccttttagacttatctggtcacttccttatggtgtcacatagcttgttgctstgtcctggggtgcctttgtttattctctttaatgcattttccaagactcccctcaaactccaatgaattaaagttttcagagtttggggcctgggaatctgaastggttccactttgccaggtgagtctgagtttgagaggaaaggtgtcctagatcattcagcagcagcagaagagttggcccttaaatctacgaagaacattgccctgtgcatctgcatgcagacagggtctgataacatcaaagctgggagtctctscaaygctttaactaatgggatctgagctcggctgtttatttatagtcattcagtgataagaaagtcaacttggttggaaggagcttctgtcctaggcttgcagctggggccttagctayccttgtaattttcccagaaaaaaaaatgcacatctctttgagtcctgggccatgtgtaaatcagtggtaatacaagaaacatggagcaccccagaaaatcttcagaccctgagtttggagctgaggaactcagaaacactcaatttcatcgaagccccttcatacagctttgaatgcatacattatggggtctgtggctcagaggtaccagtgctcagagcagtatctgctttcctagtatggcctgtgggcagtggtctcagcatgcagcatcactgaacagaaccctgcatatgccataatttacgtagatactatggaggtggaaccatgtatggttaagtcccggggccctggagcagtagatcttaaccttattggacacagtawcccatttctatttacaaatacttttttttttttccatgagaacaaccacagggacttttaacttgcctaaagataatgtgtgattttgagatgtgattagggattatcattcccacagtgatcctactatcaacaggaactgctgtttctattatcaacaagaatatgcctccaagccaggagtcctgctgatcccactgtctcccyaccccaacagccatggyccgagatcagattgtctccatggattctagtgctcagggaagttaagaaaactcaattcacggtgctcagttcaaccttagacatgcatcagaatcactcacattgctktttaatwttttaattaaataaaaatatttattcagccgaggtagctgaagcaggagaaggaagagcctcaactcaggggaagatttgctgtcaccccctgacactgagcagaggccagtcaaatccactggagctgacctctttgatgtcaggctcagcagaggcctggctcttagcaggccagcttcctgtgcttgggattgcttgtcttagctttcagaggatttaattgctgattcaaaccatacaaagtacaacgaacagtatctactggtgggttgaacaaatgggttccaatgactcaggcccgagtgacctctgctgcctctaacctccttcaccatctgctgcccagggggtcctgagaggccaataagtatctgccaagatgctctttagtatccttctgtgacattcataagatgttaacctgcctacacacttttttttttttttgagacagcgtcttacccgtcgcccaggatggactgcaatarcatgatcttggcttactgcaacctctgcctcccgggttcaaatgattctcctgcctcagcctcccgagtagctgggattacaggtgcctaccaccacacccagctaatttttgtatttttcgtagagacggggtttcaccatgttggcccggctggtctcgaactcccgacctcgtgatccgcccgcctcagcctcccaaagtgctgggattacaggcatgagccaccgtgccagccacacatttaaaataatgataatagtaagccccaattatactataaaggaacaactaatttagaataggaggtctaggtmaatatgcaaatgcaaatactctggcgcaacccccctggaaaacataatgaagtggtcccgccagagtatcctcacacagggtcaccaccaacacattgcatcagctgccatgcagaygaacacaggtctgttttgcattgtcacccaagtgacattcagtattgccattggttaggcaattttccagaattggtgagattctgaaccaaacaaaaaacaagatcacctcttttgacacagggtctgcattgtggtgatgtgtggaatatgttcatctgtacraaaatatttggggtttgagtgtaaaatcgagttgggttctagactcagataaacaagattttttttctcccccacccaaagactgtttatcagggtcattcgaaatgtatgtggggcaactctatgtagtcaggagctccatgcatcgcggggtgtctaacacctaattgtcacctcccactaaatgccagtaacacccccgattattgtgacactcaaaaatcgccccctcgcacttcgaaagcacacccctatasacactgatcttctgttaaccctgccttgaatgacwtcggtagcctgaattcccatcctggccccactgcctcatagcttcgtggccctgggcaagcccacaacccccaaacctcagtttcctcatctgtgatatgggtgcatggaggaggttaaataacagctccaatcttaaagcctccttagcgccgtgmctcacgagctgtaagtactaaatgaatgcyggctattatatataacttatattgtatattatttatgattgttcctaaaattatcactaataagtgcttcacagcaatgagctaagattctgagtgctatttcatggattttagagaaataattagattctagaacctcaattatcatcgtaatgactcccctgatagagttccaaaactgtttctttgtgaccactcacagtaagaacatcacacgaatgaatattccacctgtcttaggtgtgcacacagaaggtactgacggttctctctgagcagttccaagccctcatctgggaccacgtcttcccaagaccaagccctaagtcgtgatataaaacaagaaaagacgctgggagtacagtcagcttcaaagacagaaccagcgcacgaggcagaatcacagtgtcagagcttctgtaattacacgctaaattatgcggtgccatctttaaattatgtaggaaatagaaaaaggaaaatctcggtggaggatggaggtagcttctagaaggaggtgggcctgagccgcccctgaagaatgttgggaatctgggtcaggcaagaggctggaggagagaggtgaagarctggaaggaagttgggaggggagaggcccaggggagggcatagatggagggtgatggggtgtgggtgcccaggcctgggaattcagacctgccaatagccctttcaagggccagagacagttccctgccagaataaatacatagataaatactatttaaagcaaaaacaaagtgtcaccaatatctagataaagtgtccccaaggatacatctggtgctattccgtgagaccatgtcacccagagctggtgctaaactgatgccaaggggtgcccatggaaatgccacctttgggtgggcagaggcatttggctctgcactggtttttatggtgtgggaaaggaagcattctcgtgggaatattgttcttgcctccaggaagggctgtgggaacrtgcagttactgcagagggacatttctgagcatacatgcttgtttatgatgatggatgactggctcaggagagagctaaaatgatcctttccctagagatgtgargagaagccagcccagaatttctgtcacaatctgctgcccgagtccagtgactcagaaacaaagttcatctttactgacgtgccatggctgccaggaaccagggcagctgctaagccaccaatccccagcccacagttttgtgyggaggagacatagacatatatgttattgcaattatggctctactgaaagaatgaatgaatttaatcgaatcaatcattcattcaattcagttgaatcattcaytcattgaattgaatcattcattcaatgaatgaatcccctggtcaaggaaccaggctcagcccacaatgtatgcatttattcattcattcatttaacaagcaatgccaggcttctggcctcagggagtacatgttcaccccctagtggagggagacacacagtaaacatagaatacattaggcaatgagaactgtagagagaagcaagcatgaagaggaacatagaatactatgcagccataaaaaagaacaagatcatgtcctgtgcaggaacatggatggacctggaggtcattatccttagcaaactaaggcaggaacagaaatccaaataccgcctgttctcgtaagtgggagctaaatgatgagaacacatggacacagaaggcaacaatgaacactgggtcctacttgagggtggaggttgggaggagggagaggagcagaaaaaaataactattggttactaggcttagcactttggtgaggaaataatctgtacatgaaacccccatgacacaagtttacctatatagcaaaactgcacatgtacccctgaacctaaaagttttaaaaaaaaaaaacaaaaaagagtgaacagtactgaagtgagagtggcaggggtgcggttttcaattgcgtgctcaaggaaagctgcttgtctgggaaagcaatatttgaacacagcctgaaagaggcgagagagtgagccacgtggataactggaggtacagcaggccagacagaggcaacagcacatgcaaagtccctgaggcaggcacacgtgtggtgtactggaggaattgtaaggatgtgggatggatgaaataaagtgagaaggggagcagaagcagggggagcagatcacatccaactgtgcaggcgtagtaaagaacccagcgtttactcacaaggaatggtgagccgccaaggttttgagcagaagcgtgacatgacctgacttgcattttataggacctcccttgctagtgtctggaagagatcaaagtggatgagaacaaaagcaaggcagccattgaggagggtgggacagttacataggtggattgagccagactggtagcaatggagggatgagaaatggttagtatccgcaggggtttgaaagggctgactgatttgctgatggatggtgtgtgtggttcaagagaaagaaaagtcaaggaagggccaggcacagtggctcatgcctgtaatcccaacactctgggaggccaagacaggcggatcacctgtggtcaggtgtttgaaaccagcctggccaacatggtgaaatcccgtctctactaaaaatgcaaaaatttgctgggcatggtggtgggcacctgtaatcccaggtacttgggagcctgagacaagagaattgcctgaacccaggaggcagaggttgcagtgagccgagatcgtgccattgcactccagcctggacgacagagcgagactccatctcaaaaaaaaaaaaaaaaaatagctgggtgtggtggcatgtgcctgtaatcccagctacttgggaggctgaggcaggagaatcactggaacctaggaggcggaggttgcagtgagccaagactgtgccactgcaytctagcctgggagacagagtgagactctgtctcaaaaaaaaaaaaagtcaaggaagatcaaatactcaaggctcctagtgatcatcarttagacatccgagttcttctgggaggtcctgtttgccrgtggtcatcctgtcatttccatcagtgatgtctggaaggtttgataccaagaagttacctcctttcaaagtggcttcttcttccagctactaggtttgacctcctggaggccaggagtgcaaggtacaactattactcttccagaagaggctctccccaaccctcccacattgaagggttgacattgaagtgttgaagttttccttcagcctggtcattgctcaaaggtggtagaatatagatgtaggtcagtagtgatagcaggctacagccagccggtggtcaccacagggtagatatcacatagtggttgaaactgaaggcggcygaaacctgaattctaattaatttctttgtgaccatgggaagttatttcacctttccgttcttttttttaacttttaagttgaggagtacatgcacaggatgtgtaggtttgttacataggtaaacgtgtgtcaaggggagttgttgtagagattatctcatcacccacacattaagcctaatattcagtagttatttttcctgatcctctccctcctcccatcctccaccctcctggtgtgtgttgttcccctctatrtgtccacgtgttctcatcatttagctcccactatgagtgggaacatgtggtatttggttttctgttcctgtgttagtttgctaaggataatggcctccagttctgtccatgtctctgcaaaggacatgatcttattcctttttatggctgcatagtattccgtggtgtatacataccagaatttgtttatccagtctatcgttgatgggcacttaggttgattccgtgcctttgctattgtgtttcaccttgttgaacatcagttttgtgagctataaaatgggggtaatccattctctacctsstaggattgttcagagtatgataaaacactgtgtctggcacaggaatgtcaatgatcagctattgagtaagcaaagtgaattaatgatctttatatgccatgtgtcatgtaattctatcctctcacttccaggagatttggaaggcakccaggagtccctctttcctctctgttgcctggctgacctccttcctttaaaacccttctcctcttttttgtatcataatgaccttattttgaattatggtggtactttaaattttatgtccctgaagggttaagctctatgttggctttacstgaactctctcatcctcacccaccascaagatgaaggtagggtggccactgayaggtgacgttcgtgaggtgcatggcttttctgaagataagcagtaattgaaggaggagaatcagatttaaagcctggggctgcaaggatatgagattcatcacaaatgatgatgatgatgatgatgataggaacattaggggaggagcaggagtagggggagactgggagacacaaaacatgtgttaccagactttgtcagtagcatttttcatggtttcacatttttaattctcacaatgaccctttcaggtagcttctatcattgtcccaggttccagttgaggaagctgaggctctatgaaatcagataacttgcccatggttacacagctactagtggtggtgcagaattgggaagccaagcagccttggctaaaaagcctgcagctgtgatctatgtcctcgctctggccctttctcctggctttcctgatctcaccgccgcccccttacccccactccccagcatgtccctcctcggccgtgggcaacccctccttctttggggacacacctctctcaccaagttgtgtttccccaaggcctttgagggtcacagtagtacatttctcactttgattatgaggggatacaccctcttaatctaagacaaaccaccaccaccattatactgaatttaaaccagtcaagaagttcaacccttccagctatggaagccaaggtatgttctcactttgtcttggtgcatttgatttctctgaagataccctcagatgctctaatttgagaaaatactagaaagtgtgcatttacaggtgaccatccctctgctctgttgtgacttttataaggtctagttgttcttgatatgcagactaatctgtaaggaagatgagcatgggggagagaagaaagacgcattattcactggaaaacagcatcgtgtattttagcaaggagagcgtgctggtgttgatctgatatcaccccaatacttaggaggaattgagttagagatacatttgtagcttgaagagttgcttatttgataagttatcggagtgtgtttcaaagacattatgcctatgtraaagtaaagatggagttgtttatctctgtatctccttgtcctgtttctcccaggacttggcagaactcttgatggcaagaatcwaatctttgtcctacttgtaactgcagtgcctggcagtttgccctgtccatattcatagagctaaagaaacatttgttataaatgaagaaatcccccagagagaaagctatagagaactgacctggaacaatttacttacctgctgggagacgctagtcttgccccagatgttcaatgcctgcactggtctatttgcaggtgcaggggaggcttctgctgtcctggggaaaaaatacccatgtcttcagccagccacaattcaattactctagaccagtgtatccgaagcttgagtgtacagcagaatccccaggaggatttgtttaagtactcattgctaggcgtactaccctggtttctaactcagttaggtatattaatttcctagggctgccrtaacaaatcactgtaatgttdatgtttaaagcaacagaaacttattctctagcttctggaagccagaagccaaaatcaaggtgttgccaaggcatgctccctttaaaggctccaggggaggatccttccttgcctcttccagctcctggtggctccagggattccatggcctcagctgcatcattttcatctctgcctttgtttttacgtggcctcctcctcttctctttctcaaatgtccctctgcctttctgttacaaagacatttgctattggatttaggaccttcctagataatccaggatggtctcatctcatcttgagattcttcattacatctgcaaagacacacccccacttattttccaaataagattcatgcacaggttccagggataaggacatagaggtaycttttagggagccaccattcaattcatggcagtagacctggaatatggggcctgagattatgcttttttgtacttctaacatgttcacagttgatgctaaaagttgctcagaggttggaatatgagagcttggactgctgctccaaagagagagaaaataatacaatgccttctttgaaatagcaccttttcagaagagttcttaaaatagattttatctcatgggattgatttattgtgcccattaagccagatgcatagctcttctactagaattaattttaaagttgctaacccttaattatttgcagagataggacaaaaaatgttggaagcaatttggaaatagtctttatgttcagtccataatggatgctatttacaacaatggctgtttcatattctcatataaatgatgaagctaacactcaaagccatagaccattcaaatgctttatatcctaaaaaggatacaaagaccatcagaccataaattgtgatttttcattgccatggcatgtttcaatagatggtttgtttctgtagaaagaacagttaattctggactcagatcctgaacatgctccttttttggctatgagaatttgggtcttagttttcttgtctaaacagtgtgggtgataatattttgtcctaataattagcaggcttattatgatgatcaattaagagtactttgtaaactgtcaagtgttttgaaatatgttacttctgtaatgacaaggttgaaaataaatataactggagctaattcatagaaatctgtgtactaaagatagatcttaagaaaaattttcgtccaaagtgtatttgcttactgcagccctttcagcttctcccatctgtcagatggcctttctcaaatgtgaccactatgtctctctcccatcccacatggtcttcttcagtgtgaccttgacgatctttcattgagatatggggactttgtctcatcctcttggatctcagtggatcaaggactcactcgtaaccagtagaatgatgtgtgacttctgagatgaggtcataaaaggccatgcagctttctccttgttcgctgggaatcttgcttttggagtccgtctgcttgaaagccaccatgttgtgaggaagcccaaactaaaccacgctagactctgggctccaggagagcacagactcctttgctttgtcctcaccattttaccccccgccgcatttagcacagtgcctcacacaagcaggcattcaaacagctgtgagagtgaagaaacaaaaggaggttgtacccaactcattctaatatgctctcaagtttaaatatgtgatgtaaataggacattataagaacaaacaccaaaaaaccacctatgtgttgcaaaagttaacattattaatcctctagaattgtatggtgcctaatggttacatctgttttcttaatcgttcccttataatgcctgtcttatagtactgccaagaattagaagggaaggagcatgctgaggcctagataattctgatgggtttttttttttcttttttggaaaggatttaacagatattagagaaaacttagagggagtcttgggactccttgatggccacraaagggrtgacttttaaagaaatcgatccagaaatgtctrtgtggctgccctttctcttctcgttgtaaattttctcacagtgaacacaggtgttagagatcaagtgtttggctttctggtgctctgatgcaggaagtttgttttctcaggcaggcttctcagctcttgcacagtagcctatgggttgggacggctaccggatggcccaactccaggatggggtcatagtgcggagctctgtgagtggtgcccyctagagraaacttcctgaaggaatgaagcttcctgaactcatgcaatttggcaaccctgggttctccccaatgctttcaagacatagtaggttggagcaaaagtaattgcagtttttgccattgaaagtaatgtcagttacttttgcaccaacctaatacaaaccatcccatatctgtgttctccatcctttcatcctttatcacagtggggttgtgatagatccctgaaaacacaggatcaagtataggtaaatgcaagatggtacatagaatcaagtgtgaaagtgagtcccatcaacccacactctttccatttggcccagttgctgcccttgttgtttagaatggcacgtacctggccttgaaatgcactgaagcctatggggattactttaaaattcggtcctgtaagccagtctgttagtatcattgctcctactaatgayagaaattgctggtgttggccgggtgtggtggctcacaccagtaatccaagcactttggcagacggaggtgaaggsatcacttgaggccaggagttcgagccagcctggccaacgtggtgaaaccccgtctgtgcttaaaaaatacaaaaaattggccaaaygcagtggctcacacctataatcccagcactttgggaagcygaggtgggtggatcacctgaggtcaggagttcaagaccagcctggccaatatggccaaagcccgtctctaccaaaaatacaaaaattggtgtggtggtgtgtgcgcctgtaatcccagctactttggggggctgaggcaggagaatcgcttgaacccaggaggcagaggttgcagtaagccgagatcacgccattgcactccagcctgagtgacagagtgagactccatctcaaaaaaaaaaaaagaaaaaagattatataaaaaattaaaaaattagccaggcgtggtaggcgtggtgggaagctgaggtgggagaatcgtttgaacctgggaggcagaggttgcagtgagctgagatcgcatcactgcactccagcctgggtaacagagcaagactccgtctcaaaataaaataaagtaaaataaaataaaaataatctgtggtttttcctcagcatgccctttatgaactgaattatacaaattatatactttaaacctcacaacaacctcatgaagtgtatataccagtaatattcccattttatggacaaaaaaaagagaaaaaaaatagaggcaccaagaggatcttacccaaggatgcgtgactggtaagtagcagagctagaatttgaacccaatctgttaaacagttccctcaacaaagaattatctcattttgtgcttgactctcaagcattcatgtaggtgaaaaacttctttagaattctctgagccaagaacctagctctwtgtataaacattttttgtatgattttaatctgcactgaatatattcgtttcagtctcatattcatctggagacccctccagagcttgaggtcttgagaagtcctggggctccagtggccactaaagcaatgacttttcaaaagaaaagaaatgtttcctgagtgtagatgttgctatcttttttctttctcattgtatacttccttgtagagtacataggtgttagaggtcagatctggagggattttgtatccaggaggttaccttgaactttgatgctgtacactagcctagtattattattattgttgttattatcattactcctactattactcctcctcttgctgctgctgctaaagtagcaaaactgtctggctcccggagcgccacctattgaccwtatagtttgccacctgtctcagttttgtgccatgcatgagctcatcctcaccaattattggcaagattatagaacaggacacagagtgattcaccttcagtatagctcccactagtgtgttgctcttatcccacaagaacgtgactatccaggattccttaaatccaccaggctytgagccagactgcatttaccaatccacagaaatagtgcagaccaattccttttgtgaaaattaacatatattttgtctatggccttctcttcatcacttrccccagcaagtctctcctcaaaggatagtcagtttggcatgatttatgtatgacgaacccaggtagactaccataactcactgttctcattgataaatcgttgataatatatgccttgtaagttggtgctgtttggatggcatgactaaagtcaagcattagcatagtgcccaacactcaggaatctggcagaaagtcaaaagttacaccgatcagtgtcattattagtatgcawtttcattcttagtcttcttgggatttaattgtattacctaatttatgtaatgagactatattttcttttctgtcccatttctattaaacttagatacgtccccttctccttgcttatggaatcaaatttttaaattaatttgatttgggttctattttctaatcccatcaataaccagctacaatctgcccttcaggaggacgctgcttcttaaagcatgtctgagctcccctagccaccctgatttataatgtgatatttaacaccctcagctgcttctgaagcccaaggggcaaactggttacctagcaaccacatacacacactagctcatggcgcaggttagccccattttgttataatgaaataatacgtcttgtgagaatgaaaagctaaggtacactatatgaggttagtgttttggagaaaaatgggctctttaggacagattagcaaagcaggagttgtgtgggtcaccccctgcttcacagtgactcaccacttcctagaatggaagtcacgaccttgaaatcctgagacttggaggaaatagaggatatgtttgatgtactgaactgtctttaaaaataatgtaaatttagcactttgggaggccgaggcgggtggatcacgaggtcaggagatcgagagcatcctggctaacacggtgaaaccccatctctactaaaaacacaaaaaattagccaggtgtggtcgcgcgcgcctgtagtcccagccactcaggaggctgagacaggagagtggcgtgaacctgggaggcagagcttgcagtgacccgagatggcacaattgcagtccactctgggcgacagagcgagactccgtctcaaaaawaataataataataataataatgtaaatgtagaaacctttgggggagtgagcagtccccagtggaagtataatttccaggctatctcacacaagcctgcttggccccaggacatcctgttgtgatggagaacatcataaagctcctccaccaacatggaatccatagagaatattcttacctagatacaaaaagttcagtattctatcatgactttaatataagggaaaaataaaaggaaggtgatttacaataaaagaatgcacacttgaaatgttcgggcatgactacacaagaagatataatgacacagccaaatgtttgcacctatgtgtaataaatcaacttgaatttaggagaagtaagatgattcagaaatgcatttctttttttccagtgtctcttctrcagaatattttctgaatcataatcattgcagattaaaaatcccacaaaaaatgttcatacaaggagtcaggctcttggctcagaaaattctgaagaagtttctcgcctccatgaatgcttaaagagtcaaatacaaaatgagataatcctttgttgggggaactgttcacgtttcagaacttttggcatcctttgctccacctgcagagagccaacaaaatccttcactaattttaggaaccaaaaaacaaatttccccacttctcagtacagccttcaatactggtctgtcatttctgcctgaccttgtttcttctcccaacacatctatccatttgttgattcattcactggttatgcttataacgttgtcattatatccttgtctcagttttcttatcagtaagggtaagcagcttcgcagaattttaggaaggattaagtgatgcgtgcaaaatacttagagcccacaagaagaacttgattaatgttgttcttattattgctgtattgaatgtatcctttagtactttctttttgtatagtaccatatggcatagatgtgtgtgcacacaccccctcacacacaaatacacacaccaaatatttcaaaggaatatatagtgaaaattcctcctatgtgcctaaatcttcctcggtacccttccccagaacagccactgtgtcttcccagaaaktgtgttaagaaacaaayrtgtatatccttttgtgctgtgttttgtagaagtggaagytttctgtgcagccagttttgcattgtgttcctcaccaacaggatctgtcggacgccgtgtatatagttcttcctcattctctttaatggctatgtgatgttgcattttatggatgaaccataatcctcaaaaacattcgttaggttgtgttgataacatagaaatgtctaaagcagtgaacaaagtagcccattatctcaggacccagataaccaagttaacatttttttagcaaaataaaagtagaagatgcagatgataaaagtaaaagcaggtcagtaacagtacagtaagaaaagtagaaatctcctgtcattttctgaagtcccaatccctctagctctcaaaaaaaaaaaaaatcttaacaattctatgtgcattctttcaggaaaaaagcaagatagaatatggatatactagctgtgtaagtagctgtgtaagtagctttgtaggctgaaaaaagcttatcccccatccccctggaagatgtgcaagtactaattcctggggcctgtgaatgttagcttagattgcaaaagggactgtgaaggtgtgattgagttaaggatcttgatttaaagaagttagtctgatasgcccaatgtaaccacaagsgtccttataagaggctcaccagtggtcagagaggaaaggtgatgttgtcctgctggctttgaagttggaggaagaggccatgtgccaagagatgccagcagcacctagaagcaggaaaaggyaagggaacctcatgtcactagaaggaatgtagccctttggaytcattttagactcccgacctccagaactgtcagagaatacatttgtgttgttttaagccaccaaatctgtgataatctgttacagccgtaggaaggtaatattttagcgaatatttttatttgcataagtaccacactctgtatgtgcactgagttgttctttactaataktgccatgttatctaatttttcacaggcatattcctttctcccaaattaggtttacaagcaccttggaggcagaggctgtggttggtatcackttgcattcctcccggctcttctctcagcaggaggaaatatagctgcttagttaaaaataaaaaaggattctgaaggcacacagttcaaagttagaacaggcagccaatgcgtttgatgyccttgagccacatgccctcagcccacctggatctcggctgcagctgcattgggcactcccaccttcttccagcagcttctccccgcttttccaggaccaagaaaattctttgccagcacatagtagccccaaatcaaggaagctaatgtcctcagaggtgacctccagccagtggggacaggggtcagtggatcaatgcccaggcccctgtctatgaaagggcaattctgagatgtgctctctgcaggtccccagtaggactgagctgcggtagcgcccggtggtaaccagcttagccacacagctgtaagaaatagttttctccttccttatctccctcttctgccttctcctacctgcttcctgaatctcccaccatcctcaaaagcacgcctacactcaagtctttgtctcaggctcagcctggaggagcccaagttagaatggaaccccagctctctttctttcccccccckcctctctctctgtctctctcccctttctytttttytctctctctctttctttctttcagtggagtcttgcttcatcgcccaggctggagtgcaatggcacaatcttgtctcactgcaacctctgcctcctgggttccagcgattctcctgccttagcctcccaagtagttgggactacaggcgcacatgccaccacggccagctaatttttgtatttttagtagagatggggtttcaccatattggtcaagctggtcttgaactcctgacctcaggtgatccacccgcctcaacctcccaaagtgctgggattacaggtgtgagctaccacacccagccagctctgcctctttctagctgaggattctgtaacaagccagtcttctaaaactgaattttttttgtctatcaatgaagatagcagaatctacctcaatagagtattgtacagtttgaaagagataatgtatacaaagtatcttatacattgtccatagctactattgttaaaattagtttatgactattacatcatagtaattgctttctaaaaagtaacttaatgaaacrcatacatcaaatgcctgatgaaagctgaattttctaaaattggtcttggccttcaaaagatttctcattccttctaccatgtatattcaacagataattttgagcgcctactgtgtgccaggcagccctctgggagcaggaagactgcagtgagcaaagyaaacaaaactcccattttcctatgtcasatgcaagtggactcattcagcacatgctatttgcatcctggaggtatcaaggcaaagaaaacacagtttttgcctccagaggcataatcttacctcctgcccgtttatttgaaatacacacagttgaaatattgttgtaggtttatcgattttctatatgtttattaggctcctgctatatgccaagtactgtggttagcaccatcctcatataaacattatcatcttagcccctgarcttaaggaaatgtccaggctgctaaagcagatctgtgaaaaagctcagcctgctttttttcagctagactactatgactctagctcagaaaaaaaattatttctaatcactggttctaatacaaataaaatgtagtgattcattaatctccttagcctataattgcaaattgagttttctttcaaatatacctaaagaaggtaggtgcccactaaacatttcaggggagttttatttaagctgcaaataaaattagtttactcatttttaatttaattcccaggaggcattttggaaaccttccctcctcatttgacccaaaatcatttttaaaaattattgttstcctaaattgaagccctttccagcattgcrcattagaagtcttaaaactcatctgttttcttttygtaattgacttacaaatgcgtaatcgactcacaaatgtataactgagtatgcatggcattttaaaagggcagagtttccatttgcttcttgatttctttgggggttctcattttcctaagccctcttcccacaacattcccagtcattccttgggtcatctctcaggtgtcaccaccctgctagcatcttaatggagcggctgtgtctcctcccagcagcagtggcaccagaagatttagctgtgttggggacaacgttcagaatcctcatttgctgctaaagatgtacccggtctcattctcctgacacatggatgatgatcttgtgacccgtgtgactatgactgtatcactctgatcatcactagaacaataagtaatctaaataataagaaattctgcatgttccattgacaaaactgggaacactgcacacacatacacatattcacacaaaccatatacagtcacgtgtcactcaacaatgggkataccttctgagaaggtatcattagatgatttgtcattgtgcaaacatcatatagtgcacttacgcaaatctagatggtatattctgctacatgcctatcctgtatgacattgcctcttgcgcctaggctacaaacctgtacggctgttactctattgaatactgtaarcaattataacacaacagtaaatatgtgtgtatctaaacatagaaaagataccataaaaatacagtataaaatatttaaaatggtatccctgtataggaaagctcgattataatctaatgagacaactttcctrtatgtggcccrtcattgactgatatattgttatccagcaatgactgtacttaagtaactttaatagaagcatkaagaatgtagtagttgtcatttgaaaagggccttgctaaatgtaaccttcagttaaagcaagtcagcctagtggaggatggtggctgctcatgttgtcttatgtggatataaacctatatatccccactaagtgtgaaaagatgtcatgcaccaggaagcatgcaggagacttggtaaggagacagagggatgcagagactaagcccaaggctgggagcacaaggcttccttccttggtccaggtgtttctgcatgggaacagaagattggtgtctgcttttcagtgacgtggctgaatcagagtgagtgagtgggtggtttattgttggtttccacagatgctgatgctgaggcaagaaatcaagtcaaaattggtttattttgggaggtacaggaaacaccagtagaaaagtgaggaaataagacaggggasggaaggcagccaataacgtaaccagccagctgctttcatgagagactggagcatcgtcccaccrggaaayaataaaaaatagtgtaaaaacgcataagcttcagagaaagatatgggagctggggagtggatatgccaatcccattcttgactgattgaaggctgctgctagggacattaatcccccagcactcctgggctaccatgtgccaagcagagctgcctgctgtgcctttggggaaagccctcatgcagcgacacggggcaatggtagttgtctgccttgtgaaggagtaagacccggggctatgactagggtatcagcagagcctgytccaagaatggttaagggtttggtttgggacatgtagagttcaagcaacctgggaggcacctaggtgatgtgactcagacctctgtcaatactggctggagtttcaccatcaatattgatctgttgagtaatctacccattgtatgtgctttatagtgactgaattaccaacatgcatctgcctagcctatttccctcttcaaaatggcatctcccacacatgaaacttcctccttgattatatcaaacaggaccaataaatcattcagcttttccccagaagtgggatgttgagtggtacaatccatgatgtgccatttctcaacaaggcagatgatatttgattcttgggatatcagtaagtctgggttatttaactggctttttttctaaatcctgacttgtgtccagttgcttaaccagatttagaagaagccatgtttacatggaatttctgaattacaagctgagaaatgttyccagaagatattttaaagcctccttaagaaggctagtgggccttatttcctgtgtgaaacaacttttatcaaaatgtatttgacactgggagtgtgggtgaactggtgaaaaggtccctgagagttcgggtccctgagagttscaagcacaaatcctgttaacaggtaataagattatgagcayagcccatgtagagcrcatggttttatcagctgaagtgaagcaccaagatgccaagttgttaatggaattcagcatctgtgtctttcatgggtctctaaatagacaaggttcaatgctacccaaatttcctgcagaatcaaaaccacgttcgcctttggaatgggtatttatttattgcttttactctggggaaaaaggcttttttactttataacctttttatctcttatacagcaatttccttccatcttctaaaaatgttagaaaataaagcaaatatgaaaattcatgttgcatttctaagcatctgaccacaatctatagatcaagataatgccagactctaatttcagtgtttagcaaggttactggcaaatagcatttgagaaaagagaaaaaatagtatattgaaggcaatacccaccccctatattttgtattaccatcttttgtaagctctggtcatgcaatgctatcataggatatttttccttccttcttttatgtctttttgggtcattttaaatataccccatttatatatgctactcatagaaattagttctttattctccattgaacttttctgaaaagtattataaagaaggttcaatttaattatgttcaagtaactgagtcgttggcaatcagctgccaacattttgattgttttcttgtgggattcagtcctagtattgagtgcccactaacaactgccaaatttagtcatccaaatcaccacgacaataagctccaggtattgaaacatcaagactgaagccaccacttacgatccartcaacctttttaactgtcagtgcttccagtctttgccsaaatacacagcattaaaattcataagtcaacccatgtccgtgcgtsctttttctctcccatatccagttggtcacttgcttcatgctgatccatcyatagcggtcgtggtccacactccagccctcctttacatcctccagacagatagggttctttmtatggcttaaaggtgccaacctcattcctgtctcagggacctcacacaattgctcctttagcctgaaacaatcacccactaatctctgcatagctgagaccaccttgttattcaggtcttacctgaaatgtagcttcctcagagaggtcttgtctggttaccccactgaaattagcatccccctttactgtgttccattaaacctcccacttttctttcttttgaagcatttaccatcatccacaagcatccaatgtrtatcaccgttgtgtggtttattgttggcttcttcattgctagaccaagagctccatgaaagcatgggccttgtctctcttgttctcagtgaaatcatatgtgctcaatatgggggttagcacatagtcaatgaatattcaaattcattcatttaaatatttaaatatttaaaaaataaatattgagayacactaccattcatttggcacacagcacatgctacttttaattgtgatggctcaaataacctatgatactgcaaagaccatttttatgcccttataggtcatgtagtaccttttrttctctgatatgtccctagtacacattacagtgtttcacacagagtaggcacttaaacataccagctagtggatagtgtgatgatgccaggaagtaatatacaagggtaggaaactaacaagtatggagcatctcatatgtgtactggcatctgacttctcatttagtcctcataacaagtttataaggtagatagtracatcccacattacagaggaaaaacacgagcttgtaattgcatgataagcgcataaggagcaaatctggaatccaagcctgtgttctctgcagggtgccattgtgctactgacagtgtgctaagtttaggttctctgtggatgtttgtgaaggaggcacagggaggcaaggagagccacaagctcatggctctatggctggaacttcataccattaatgaccacttaagaacgtgctgaatgcacctatgcatgtggaatcatgtacttccttttcacattgtaaatgtgtctacaaaggccaggcatggtagctcactcctgtaatcccagcactttgggaggccaaggctgatggatcacttgaggtcaggagttcgagaccagcttggccaacacrgtgaaaccccatctctactaaaaatacaaaaattagtcaggcatggtggcagacgtctgcaggctcagctacttgggatgctgaggcaggagaatcgcttgaacctaggaggcagaggttgcaatgagccaagttcacagcaatgcactccagcctgggtgacwgagttagactmggtctcaaaaaataaaaataaaaatgaataaataaataaatgtgtctacaaacagaggtttttgagagtcaggcataagcccccaccttagtgatactgatgcagccacctcgaaatgggaggtgggtcacccatctttatttgtggtcccsgaagaaagaagatctcagcggggagaaggtggggtggggcacatcaactccttgcaggtagacactctgacaagaatgtatgcactactcaaaatgtttcttacccatggttcctaatacggtgaagtcatgagcccccttaagacccagtgaaagtggaacaattccacgtgcacataagccatgcatttacgatttcaggacatctttgaacccagggcaagaactgcagctttgggaaattcccagaacagtaaacagtgtaaattctcaaaagggggtttatttcatgttacttccttttttaaagaaatgtaactgtgttgyattaccattagacgtaattgggtgagaaattacttataaacctgtcatcataacatagctattgttttctttgtccaatatattgacattttattccactgtgcacrtagagttctgcatttggctgtttttacttaatacatcatagcatcaaacagtggtaatgccatttcacagtctgtatttaattggaagtgttttagtataatgttattgtaatactcaaatgcaaaggcacggtgatgcagtgaagattggtttctgttttgtctaaaattattgtagaacccattaaattttgtaatgcacattctcttccatctacaggtctcccataaaatagcttcaaatctcacaatcaatgatattttaaagcagcacataagagtatttagctttaatgtgatcattgcctcaggctgtaataaaaacagaatttttccccaattattatcmgtcactcctcctccatagtccatcatgataaraccgagcgactttcattcctcaccaggcaactaatcatccctttgctgagcattcttcataaatggaatggaataaatttcattatgcaatgcggtaatgttccccaactagagatcggggtgtagcaatcttggggaaagttacagtcaagattattaaaatatatgaaacttaaagagaaatagtgtcctaatcatgcagcccataataggctgtgccaaccccacttatcctcaaaacagccctcccttaccttgccggcctcatctaaatgctgctgtctgcagkgcacggtggctcatgcctgtaatctcagcactttgggaggctgaggcgagaggatcacctgaggttgggagttcgagtccagcctggccaacatggtaaaaccccgtctctactaaaactacaaaaaaaatttgctaggtgtggtgggcacacacctgtaatctcagctactagggaggccaaggcagaaaaattgcttgaacctgggaggtgcaggttgcagtaagctgagatcactcaccactgtactccagcctgggcaatagagcgagactccatctcaaaaaaaacaaaaatrctcttctctcttgttgtcctttgtaaacttctgaaaattagacaatacttgattcttttacttccctaacaagtacctgcttaccaacctgctatagttttatagaagtactctctgaaaaggtaccaaaaatattctcattcctacatccaatagctgtttttcttatttggttggaattttccatatgaatcaacatgctcaaccattttcttgaggatctttttgtsgtagcagttgttgtttaaaaaacaactttattaatacataattcatatactgtataattcacccatttaaaatgtgcaatttaatyttttaaagtatattcacagggtgatgcaaccaccaccacagtctgattttatatttttagaggaaacaaatatatatgtttatatttaaattttattttattgtgataaggacacttacctgagaccttaatagattttaagtgtacagtagtattgactctaggtacagcattgtatggcagatcgctagaaccccttcatcttgtttaattgaaactttatgsctgttgattagtatctctcaagttttccctccccctagaccctgacagacaccaattcagtctttggtttgggttayatgactattttgagtacttcatgtaagtggaaccatgcagtattagtctttctgagactggtttatttcacgtcacataatgtcttcaagattcatccatgttgttgcatattgcagaatatccttcacttgtgaggttgaatcatattttattctatgtatgtgtcatatttatccactcatccatcactgaacatttaggttgtttgtacctcttgtgtattgtgaatagtgctgcagtgaacgtggtagctctccagtaatatcttcaaactatctcttgaagatcctgatttcaatattkttggacaaatacccagaagtgggttgctgggtcatatggtagaaaagttggttttttgaaaagataagcaaaattgacaaacccttagctagactaaggggaaaaaagagagaagattcaaataaataaaattagaaatgaaagagggaacattaccacttataccacagaaataaaaaggttcataagagacccctatgaacagttccctgccaaaaaraatgaaaaaaaaacctaggtaacctagagaaaaatgagtaaattcctaaaaacatacaacctaccaagattaaatcgtgaagaaatagaaagtccgaacggacccataactcatagggagattgaatcggtaaccacaaattctcaacaaagtaaagcttaagaccagatgtttggcccaccaaacatttaaagaawtgatgagaatccttcycaaactcttccgaacagctggagagggagtgacacttccaaactcattttataaagctagtattaccctgacaccaaagccagacaaacaccacaagaaaagaaaacaaaagaccaatatccctgataaatgtagaagcaaaagtcyttaacaaaatactagcaaactgaatccagcagcacattaagaggatcacaggtcatgatcaagtgtgcatgggagtcaggaattgttcaacacacagaaatcaatcawtgtgatacaccacattagcagactagaaaataaaaaccacatgattgtctcagatgcagaaaaagtacttgacaaaattcagtgccctttcatgataaaaactctcaaaactaggaatagaaggaaagtacctcaacataataaaggccacatatgaaaagtccatagctaacgtcatactcaacagtgataaaactaaaagcttaccttctaagatcagaaacaagatagggatactcactgtcaccagttctattcaacatagtcctggaagtcctcacaggagcaagtaggcaagaaatagaaacaaaagggatccaaaacaggaagaagtaaaatgtcccggtttgtagacaaaatgatctcacatatagaaaataactgaagaacccattaaaaactattagaattaataaatgaatttagtaaatttgtgggatacaaaatcaacaaacaaaaattagttatgtttctatacactaacactaactgatctaaaaaggaaatcaagaaaacaatccctttacaatagtaccaaaaagamtaaaatacacagtcataaacttaactaagacagtgaaagacatgtattctgaaaactacaaaacattgacgaagggaattttaaaagacacaaacagatagagatcttgtatagatggattggaagacttactattgttaaaacatccacattacccaaaattatctacagatttaatgcaatcagaatttcagtggcattttttacagaaataggaaactcagtggagcttcttccttctttttgactctcatgaccctgtcctcagcagattcacctgtgactatatctgtttctctttctgggtcttatctcttcttgtgcckctcatgtttaagtatctcccaatattcagttaataacattttctgttttctgtaggtagaaactgccatgcccacaggtcgagctatgacatgcatactgatgcctcccagaagtaccacttcaatctctgacctccctcctgagcatccagatttgaatttgcatctttctgtgagcatctccaagtagatgtccttcaggcactattcataggttgaaaagagtgcagagcagaaagatgaataaaagcacaaatgctggggtcaaatctctgagattcaaatcctggctctgccactaaatagctatatgtctttaagccacctaattaacctctctgtgcctaaggattctcatcagtragatggggataaaaatacttgccttataaaattattgaaatggttatgctaaaaaaaatgtgcaaagtctttagaacagtgcccggcacatgttaagtactgtttagctatcagccataatyttaaaaatagtgtttttaaaatcagtaatattattgacaaccttttctgaatattgtccaagtgctttacagggattatttmacttatcatgggaatgatcctatgagatagccactgttattattcctactttacagatgaggaaaagagaggttaattagcccaaggacacacagtttccccaagatcaaagagtcagtggtggggccataatttaaaccagggcagtctgacttcagatscacacttttgacctgggcttccctgctcaattacaaataccaaattgactccttatcttctccccagaacagcctccctttccggttttctcccctttccccaagattaccattacagcccctttctttttcacctgtgaattagcaaatgctgcacccagaatctttcctccacctctaccccattctcttcttgctgccctgactagttgaactrtcctctttatcttaacctgtcgtgacaccacctccctggtcaccgtgctcttgccttcttgccttcttgcctttccaatttatcctgctcactgacacctcagttgccatttggaaacgaaaatagaattttcagcttgataacattaaggcagagatgttgcagcaaacaaacacttcagcaggcaagacaaatatgtttcagatattttttagcagctagagaaactccaaagcaacagccagtgatttagaacagaggctcctcttacgaagcagacaggctgtagagatagaattcaaggctcagcagacatgtatctcctgttatataagcaatcagaattctcttttccaattgaacaaatccctctctgctttgatggggaaactgggatgtcagtttcsctaaaatgaaaattctatttcacagcaaaatggttccagtcaactggagagagagagaaagagaaatcataactgttttcccctccccagcctagcatcctccccacccccttaacatggaaaactcctatacatcctttaaagcccagggaaaatgtgycttttctgttgaagccctttgtcaactcttccagacactttctcctttttaatcatgcagtagaacatggcagttaggaaaatgggctctttggaaaatattcagtgttcaaatgctgattttgctattcattagctacatggctgtcagcaagttgcctcgtcttactgtgctacacttttcctcatttgaaaaatggagggcggtctcacctctctttttatatgtgattatttggaggattaaaagggaaaaattatgaaaagcatttagctcagcagctggcacttgtcagtacccagtaactgttaccagctgaattttatagccataaaataaatacaagcatcctagaaaattataatacccataggaagcatgagattttttttccaaattaagaaaaaagatatagtagtcttggagtagtttctcttcctcttaaaggaaaaataaaatgtcagactttcttacattctcataggtcagtaggttgttcctatagctatggggacaatatagtgagggtatgaggcagacttcaagttacaagttagggtttgatccgatgtcttggacatttgcttggatctgtacaaaccaggattctgtccaagaactcctttgatgaggaagtgttgctagaacttggcctatgagctctgcctgctgggaattagttttagcaaagagagagagagagagacagagaatatcatggtgatgagtgctaggacattgtcaaggctcttttaagtgtgaccaccaggkgacagcaggaaagayaggagaagacctagagttcaacttggagtactgaaagccttccctttccttcttttctctctgtgaaggttgttttccttctttggggagttgcaggcccatttggtaaatgaagtgtcatatggagaattttcagcagatgcttctcttctgatagggaatggcaaagccccctaaattcatgaaacatatrcaggtgccagccaactttgcactgccttcatgacacctcatctgttttctcaaacagccaagcagcactctgtgcccttagtgaagtaagggggaataggggccaaaagggcagcgtgaagacctaactgttgtcctccctgacagctgtcgttttgtgatgctgctgcttgcttttcatgaaatctgtgaccagctccatccctatcgtgccccctgcctctgtaaccagatttttgagtctacatataggtttactgagatgacatttacttattcattgattctgtctttggaagatgcctcttccacccatacaaggtatgctgaataattggtactcagaagtgtaattagccacacatataagacatcagaactactatatgggaggcccaatgactgatcatgaatatacacagtgagagaaatgtcagtcttgtgtgaattatcttatttaaacccctcagccaccaataagttaccttctacttttacatccttagatcaggagtaagattccaagttctataatgatagccaaccaagacattacagaacaattgccatgctctaccagtagtaatacctgacatttattgagccaataatatctagaccatggctgtagcatatttcctacatagaggggaatttactcaacaccattcttgatcagctgcccaaaccccgcagtattatataaagtgacttccctgacaagttgccccaaggcattcccataagtgtactggcattgtggttatatactatgaaatatatattataaaatgcatttttctctgctcatgttttccagcaggtttaggagtcacctaaaattattgaacatcttgcttccaaacaaaataaactgtattacacattcagctctacataataacaggaatttcttttctctgaatcgtccaatctttttttttttttaaaaaaagttttgtatgtatgtgtgttctgaatactatatgcatagattttagcttgagagaactgattaactcacattgcatcttgggaggcagattagctaggcatcagttttaaagaattagatttaaatagagggcaaagaatttcccagaaaagatgagcagaataaaaaatataaaagagaaattctcaagatcaggacatagagctaggttccatagatgctacaaattgaaatgaaccttgatcctactctcaaggaactaaatcgagctgtcacaatctctatgaagcaattgtagaggtaattaaaaatatgactgaggtagtcacaattgagagcatcaactaaggtcagtgaaaattggagcaggaggtctggctagacacaaatttgggagattcgaagcagttgaattctcaagcagcgttcagacacagagattaatgctggtcaaaggaaaaattgttcagtaccaaggacagctccctagaaagcttttattcccatagatctctgggcagagaccacaggagtattttggtagctgtgctctctctcgtaatagttcattgcacaagcattctcatgtgataatgtgtgcacatgacagcatcttttacgtaccgattaaattaccagtggtaccattatcattgtattacggttctgcagagggacagagctaataggatatgtgtatatataaaaggatatttatcagagataattcacccacgtgattacaaggtaaagtcccactataggccatctgcaagctggggaacagagaagtccatagtggctcagtccgaatccgagagccccaaaactagggaaaccaacaatgcaaccttcagtctgtggccaaaggcccgagagctcctggcaagtcactggtgaaagtcccagagtccaaaggctgaagaatgtgaagtctgatgttcaagggcaagaggaacaggaggaagcatctagcaggggaaaaagaagtaagacggaagacccagcaagcaaggttatcacaccttcttctgcctgctttgttctagccatgccgacagccagctggatggtgtccacccacaatgagggtgggtctttctctccctgtccacagtaaaagctgtgtaastggataagattaataagggataatgtgaagggagatgagaacaagggctacatctagaacctaggaggaacactcatattccagtactggaggagaaagtggcataagtctagaaccsttccagagaaggagaaaactctcaggaaagtataggattagtgaggtgaagagaagaataaatatccagaagagggttaattgtttaagctatattaagctgcaaataaatgaattccagtactagattaaacaataaataaatgtaattaattcatataaagtgattgaaggtaggcagttaagagtgtttcagcagtgtttcagcagctcatcataatattatgaatcttagctctctacatctttccaattaattatcctctgcatgttgacttcttgtccctgtgtttattgcctgatggttgcaagacggctgatgcaactctagacacatcaagatcatgttgaaatgaaatgagatgagagtgggcaatggagagaagattcatgatcttttcttccatcaggaaagaaaatcctttccagaagttcctatagacttcttatgatttttaattattcaggaccagattacatggccacccctactgttgaggagactaatgaagtatttggcttttccaggctttgttgttagcstccagtaaggatgcaattggaaatggactttgtggtgaacagccaacaagattggccacagtggaattaacgacatcagtgttctttcagacattgaaatgctttttccataattagttcttttgaataagctgataaaatagtcaagattacccaaagcaccttctcatgaaagcaggaaacaaagttttggcaatccttagccatgatattttggttgctaaaattgatggcatttcttactttttaaaaaactgtcatatgaacaagtgtttagttcatctttttctcatatgaaagttaagttctgacttattcatgttggtctcagtttttaagaatcaatcatacagaaaagttggtagattttgtggatttatagtagaactacttagctaaaaatttgtttatcatttgaaggccatgttcccctttaattagatattctagaacctctggatttttccataatactatttttcgtaagttgtactgtataaaaataattcgttttgaagatgttgtatcattgaactaaaaatcatattaatactcatccaaagaattacacagtcattctctttaataggggaacttaagaamcagaactgtttcctatgatgtttaggagacattcagtgaattttgatcatgatgaactagaacatccaattctaagttggacactggtctcagaaagaatgctggctgcagaggtctttgagataatgaatcatctggtttcttatagtattaatgcttataattagagacagaaaagagtttaatttcttgcacgaattaattaatacttacgataaatgtcttgaaagctctttctggtgtctggttcaaaaattgcagttcttgaggtctgttaattccttctaaaatggaaaagctggtaaaggttgtgacactgctgctaaagtgatctgtgaattagaggacgtttgacttctcctctgacctctaagctcatgtggccatttgcttgcatgacctctcattgagattacccaaagttgccccaactttaaaaggaagataataacagtactttcctcatgagcctgttttgataattacataagatgcttagaaaagtgcctgggacacaatgaacactcagaaatgttgggtaggaacaatggttatgatgatcatgataaaggaggaggaggagaatttggcaattatttcctgagtacccactatatgtaaaacactatgccaaatactaggaatacaaaggtaaattagacatgcaagatttaygttccagaaagcttcatttttgtgttctctaattctgtacatgtctttcttccatttataatgtagatttacatgtaacagcaaactcactggaaatgtgtttccccccattttctgctatattgaccctgtatgtagaaataaccagggtcccacaaaaatctgttttgttttctttattgatgagcacagtttaagaattgtgtaagtcctcagtagcctctaaagtatttcaggcattttcaacatgacatgtcaacactcacccaagagaccatcttttaactaagtcgttattgaaagttctcattttgttcacttcttcagaaaattcaaagaagaaaaaaagcctaaagccactcactcgttgctctttcaatggcatcaccattgtgtgatctrtcttcttctgctagaaggaaattccaggaatccttgatctcgcatcttttaaactgatttcacagagggtatccctgacagcatttaaaaaaaaaaagcaarcaagaaaaacctcaaatgggtagaatttttctaaaagtctgaaataaaagtttataactgattttcaggtttcctattattacctaggcacacctaaatgaatacttgaagaatggggttgtaaatactcccagaggcaactgcagcaatcatgatcatatgtctgttgcagtggaattctttagtataaattattgtatattaaaccctaataaatatgtaggatcaaaacatgtgtttctggttgtggggactgcaagatgtgcaagtccccttgtccctgttctggtggcccttgagcattcctgccaatctttggaacttcagagaatgccagagttgtggggaaagataattcttactttctacccccatttccctccgtcctatggcagtctgggacgtggctgtacactataactaaactttaagacatctacaagtaagaaacgtgaataagaacttcacctgggaaamcagtctagaagagggaaatccaacatggactgaacagtctagaagagggaaatccaacacgtactgaacagtctagaagagggaaatccaacagggactgaaaagtctagaagagggaaatccaaaacgtactgaacagtctagaagagggaaatccaacatggactgaaaagtctagaagagggaaatctaacacgtactgaacagtctagaagggggaaatccaatgtggactgaacagtctagaagaggaaaatccaacatggactgracagtctagaagaggaaaatccaacatggactggacagtctagaagagggaaatccarcatggactgctgtgcaccagcctacatcatagtcacgtggttagcattggttgcatatctgcagtagcctagagtttaatcacacaagcagccttggagctttagttaatttcagttgttcaaactagttggatttatgaaggccttgccatgcccttcatcccccacttttgaagcctctcttgattattttttttaagctgctgtggtaagaggtaattctggatggaatattagttagactgaggcaaactaatataaataatattggactattaattttggaagggtcactaagccccctcaaaaataaaaaggaagaaattacacattttcataaatggttttgcaagaatgaaaaagtaatctttagtcctagacaaatgctcttggaacattattgtataatttctggttcttttctctctcgactgtagttatttcacacacattacagatgaagccactgtatcagtcagagaccaattttaatcccaaggttgattagacaggtagctcttcgcagcttgtgcactctccctttgttctacagccctacactcacacagacaaagatttacacacaagtaaggatttggcctgattcgttagtggaacatcctgatgaacacttggttgcatttaaccttttgctgcaacaaaaagtcccaaggttgccatagtaatgggaaattaaatccacagagctattccttttcccttagtggttctggcatgctatcacaccatagcatgcttacaacctcggtcaagaaagagctgtgatcccaccgtttgtccatcgagttctaagctatggtatttgtaaaaggtcattctgctckcccgacattaacctgaatggaacagctggaacgtaaattggaaggaggagtgatgattctccctttggccatttgatgacttgggaattaaatgggacccaatatgtcatctaacgttagttccagccagtgtttcagccacaggacatctcggaaaggtggtcatttggctcttgcctgaagcawtcgaggaaggagagcccagttctggaattagacaattattgttcttacccttgaaccagccacttacctgctgcgttcccactcttggccaggggccaattaatgaatgaaacaagctccctgcactcaggaggctcacagagaagatgatccagtttatgctaccgcatctccaccataactccccttttagctcattaactccctcaaaaatatccttctgctaattcstctcccttcccctctcttccactgttgcctttggagctttcactttatcctaaacttctttatgtctttrgtcatctcctagaacacacatttcctcacctttagagaaacttgactctttcttcaactaatctgcagtgttcaaatatgaatacctttctgtctttccttctttctttctctttttctttcttcctttgtctctttcttcttcctcctttacttcctttctttttttctttctcccttccttccatttattcattcaacaattatttataagggacttaatatgtgcccagcactgttctaggcactacagatacagcattgaaccacccyaattaagcttgcattctaytggggagaatgaaaataaaattaaaattaaaatgagatatatagtaaattaaattagaaatgcagtagggtttctttttaagtggaggtggtcctttctcctatcctcccaacttcttaactccaatrtttcaaagctaggaggagaaatcagtattcccagggaccctttggaagaacctttcttctttcaccctctttcatccattccttctctgaagctcatgccatctgattaatcacactatgttcactcctcccagcctctgggtttccaccctaatgcattgagattctagggctctggattctggttcagttttcctgtctcctttcagcatttgagtgatttctgcatccgatttraagggtcagtttcttgrttttcattattccaataatgtttctctccccctcatttgagaagccaactcataagactaaactctagtccttgctaatatgccaactactctaattccaatatttcccaccataaatctcctcctggaccataaccttttgtttctcccaattttctctctcatggaaacaactcccatggaaacaatcacacamacacacacacacacacacacacacacacactcaygtggttacctttttgccagttttccagcctcctggactgaacagtctagaagagggatccaacatggactggaagaggggaatccaacatggactgctgtgcaccagcctacatcatagtctgcctacatggtgcttggcatgtagatagaatgagagatgctgaatgatagtcctcattctccctaagcccttagtgattatgagcccctcccacttgtcctaccaaacttaaacttcttattaacatgacccatctcttttctcctctcttgctgttaaggtgtgtggtgatcacagtaatggccccccaaatatgactttgtcctaattctcagaatctataaatatgtttctttcttttttttttttttttttttttttttttttttgaagacggagtctcgcttgctctgtcgcccaggctagagtgcagtggcgtgatctcggctcactgcaagctccgcctcccaggttcacgccattctcctgccttagcctcccaggtagctggtactacaggcgcccgccaccccgcctggctaatattttgtattttgggtagagacggggtttcaccgtggtctctatcttctgacctggtgatccgcctgcctcagcctcccaaagtgctgggattacaggtgtgagccaccgcgcccggcctaaatatgtttcttacatggtcaaagaaaccttytagatgtgattaagttaaggatcttgagatggagacagtgttattgactatctggatagacccaatagaatcagaagtgtccttacaagagggatagaggagggtcagagaaagagatgtggcaatggggacagcagttagagtgatgcagccctgagccaaggaatgtgggtagcctcaagaagctggaaaaggcaagaaacgaattctcttctggagcctcctgaaggtaccagccccactaacaccttgacctaacccccatgagactgatctccaacttctgacctctaaaactataaatcatcagagttgttttaagtcactaagatggtacagttagttactgcagctgcaagagactcatataaaataccagcaccactagataacacagcaagggagtgcagtgattatggtgccttgtgccttcaggattctcctccaccctcggcaggcctggtgctactaagcacctctgcacttatggtctgctgtcctgttccaccattctctttcccagcacatcaagaaccaaccacagagttgacaagaggccacttgtaacaatgtgagcttctgttcccctaatagtattaacaattacattcctgtgactcctttcagggccgtgaagatgttccttggacccaggcaaaggcagaactgctgacagctttggctgctccatgtcacctcayttgtgaatggcgacagaaaagccagggtgatctgtagctgatcctctggtcagttccactggctcaaattaaaattttagagaatcggtctctggtatatttcccctttgcagatgacacagagagggtcatttatgttcataagttggggcgaaagctccactggctagtagcagcatttgaatagggggaaatggcaccttttgactgctcatgtttattatgggaggggaaaaatgagttttattattgaacttcatgtgaccttccatgggatccaagagggattcaatgactgagaaacacaggaaaaacagcaggcagcaaaaacagtgaactagctcaagaaatatgtttttttgtttttaaaaacattggaaacatactacaagtccctaattagtttgacctccatggttagattttttttttttaactccaatattttcctgagttgattttagctttgtttgtttttccattgacaagattcatttttaattgtgttgtcaagttagagaataggattctgcttttgaaaaaagtgcttcgtggcatggagataacaataacttttcataacttgtgatgttttgttaaataacttcctgaacgagccatggtaataagtgctagcccaagaaatcagaactttggtgcttggcatgtagagaggatgagagatgctgaatgaatgagaaataagtagatatactagaaattagtccgtaagacaaggggatggatgagattctgtatcggtttgcgattctcttcttgcctttgttcctttggggaataagctacacatatttatttgttgatgttttatggaaaatctatttggtgcgtgaattctgttgttttcttgtgaagttcattgtttcaaatctccccatcttccartgcattcaggcactattcttggtttatttgttaaaataactgttgcactgggccaatccattacatttatctttaataaccaactctaggsgtttgttcggtcatcactttccctgtcaaggggcacaaatatcttctctcatccrtttcctagggggaagtatcttcttttcttgtcttgataagacagttaccaaaggaagaaagaggaaagccttatcctttgaaagayggcattaattcatgtgcatttggcagtgggagaggatattgcagtctggggtcagctatgacttaagactttctataagactggatctgaacaagccatagcatttacgagaaggtccttttgtgtgttgtgacacagactggtatcccatttatgacaagagtggcccattttctaagattggtccagagcaggacactctttgaccaatctcaaccacctgatttcctcatgaggtacaggggacttatgcaaacctctcctttaatatggaaacctctcctttgatgacccatctttaaggaaagggttagaaccttcagtctggattttattcattatcatgtcccctatgccaggctcagagacttcctgtgattatatttgttgcatgaccattacatatacactaaaagacaatgaagacacacacacacacacacacacactcacacagcattgaagatgacccaaaagagagaaaatgaagcttgagaaaaataaaaataaattacctggtctccagccaaacaacctactcagaatgctgaggggaaggtgaccagttgtggctaatctttccttagaacttgtgctctgcttctgtaacttggcaagcacaggcccttttgtaaaatacctttataatattccactatgacatgaaccacgtttttattttattttattgtggtaagaacacttaacatgagctctaccctcttaacaaatatttttgagtagacaatccattattgtgtacacaagctatctggagcttattcagcttgccaaaagctatctagagctaattcagcttgcctggctgaaaactgatgcccattgattattaattcctcatttcccctcccttcagcccctggcaaccaccattcccctctttgagtctataaattggactgttttaggtacctcatctaagttgatctggtacagacactatgggacacactatggagtttcctcaaaaaattaaaaatagasctaccatgtgatccagcagtttcccttctgggtatttaaaagaattgatatcaggatcttgaggacgtattagggctcctgtgttcaccacagcagtactcacaactggcaagatgtggaaccagcctaagtgtttcctgacatgcactctcttttccagtttgattaatttacagtgatcatgtttgttgcatgaagattaactatacagtaaaagacaatggagaaatacacacacatactcccacacagcattgaagaggactccaaagacagaaaacagggcataaggaaaatgaataaatgaaaaacctgatttcttggcaaacaacctaattgatgggagctaaagtagttgactcttatttacttccactttattctttaacattacaaataayagactccctgarttgaaagcaaaattaaatgtgattttatcaaacctttattcttctttttgaaatcctgcttttctatgtcttatccatagaatttccaagtctctgcttgagcattttcagtggtaaagaatttacactctcatgaaagagatcatttcactgttggtaggttgaaattgtaagaaagttctttctcaacaaggatctgaaattattcctatagtttcacccagtagtcctgtctctacttaatggtagattccacattccagatttttaaaaaagtttattctgctttcttgtctactttaatctacacascagttcttttttttttatactttaagttttagggtacatgtgcacattgygcaggttagttacatatgtatrcatgtgccacactggtgtgctgcacccactaactcgtcatctagcattaggtatatctcccaatgccatccctcccccctccccccacctcacaacagtccccaaagtgtgatgttccccttcctgtgtccatgtgttctcattgttcaattcccacctatgagtgagagtatgcagtgtttggttttttgttcttgcgatagtttactgagaatgatgatttccagtttcatccatgtccctacaaaggacgtgaactcatcattttttatggctgcatagtattccatggtgtatatgtgccayattttcttaatccagtctatcattgttggacatttgggttggttccgagtctttgctattgtgaataatgccgcaataaacatacgtacacaccagttcttataattgttgcatagttggctgcgttgaggagacaaccataggttagagttcttttacgatcctggtcctatctccttatcatttatttcattcattcatccaagcaggagatgatggcagagaggaaacagagcagaagtcattgtgcaaatcatggaggtctttgtaggtcattgtatcagtccgttcttgcatggctataactaactacctgaggatgggtaatttataaaaaattttttaaaaaggcttaattgggtcacagttctgcaggctgtacaggaaacacaatgctggcatcttctggggaggcctcaggaagcttccaatcatgcacgaagaraaaggaggaatgaggtatctcacatggtgagagcaggagcaaaagagagcaagaggggaagtgccacacactttcaaacaaccaggtctcataagaactcactctcatgaggatagcaccaaggggatggcactaaaccattcgcaagaattcacccccatgrtctaatcgcctcccgccaggccccacctccaacactggggattactattcactgtgagatttgggtggggtcacagatccaaaccatatccatcattacgtgaacttggaatttttgcagtgatacatacggccattggcagattttgagcagaggaaagagggattcatgttttaatggatccttctggccactttgttgagggatagactggagaaggaggaaggggagaaacagagaaaccaggtagaaggcttctgcaattacccagacccaaggggatagtgtcttggacttcagtggaggcagggttgctgttgagagtggtcagattgtggtatattgccagttgcacagctggaaatttcagattccctgtgacgtgggaatcttttatccacaaggttgtcatgcatttggaataagagaaatgaattaccaacatgagctgctgggacaccatggatccgtwcgaggagtatcagtagctgcagtagctccttctagtgctgtgccaggcacagaactcataccatgtcatcctataatctaccccaatggtagttaatatacccctatcacagatgaggaaactraggccaggctcagaagtaggcttcaagtggaatgyctagcaagtggcagagtggggacctatgcctacttccacgcttgagatgttcttctggggcatggagaacagtggcaaggatcccctcctctcctcaccacagctgctgtaaacagagtgggtgaaacgagcttcaagaaaagcttttagactgaacttgagaagagtgctggcctgggactggagccaccacrtgtcacttcactctgggtggagaaaggtgtagccggctctcaggctcatgcagatgtcatgagcttccccaaagggccccaagaaaattctagaaggcagagttggatggcacaggcagctgggtctctgagatgcatcttgcacacagcctcagagcatccctgatcaggaagtgcaaacaggttgctaggaatattttcctcgatttaaaaatcaccaccacaccataaatgtgtagtgttcaaagaaaacttgcatggtcctgtttgacataacatttatgtttcttcttcatggttagggttgataagaattactttcactttacaaaacagaagccatgggctaaggagtattacttatccatgctgttgcaggaggtctcctactgaactggggtagaactttccagctcccttggctctcttactgtgtcatgcttctggggaatgagaggcacagagaagccatcagcaggtgtttactgagcacctactatgtgccagatactagactagacagaccaagtccccgtcttcctggaacttactggtagagtgttgggaccagaaaggggttgccctgagttctcgtcctggctcttgtgtgaattagtccatgactatttgcttacccaacatctcatagcttsagtttcctcaactgtaaaatgagggaaataagagtgcctctgccttccccttgaggcttgttgagtagttccaatgagtcagcaaaaaatgagaaacacgaaaaagctttgtgacttctaattcagcatttatgtgaatgtgggctatcattcattactgggaaaatgcatgaccagcggataaaccacaatgaccccatgtaaagagcatcattgtttccttggtgcacctactaattttaccaaaggcagctggcctcactccctgtgactgcaagaagttttcatgttcatttttgtgagcttggggatgagggtggtttctcctattgactcaggagtgtaaccaccagaagattcattaccccagcaggaaagaaaggggagccctctcaagtccagttgtgtggacccggtgacaaatgtggcaaacaggctgatgtagattccttgaatgtaccattagctactgccatgtcacattacacttgtttatgcaagaaccrtgcagcagataagagtgtttaaatgcctttattacatggcatcatggtattggtagtagttggtaatgatttttttttcctcagtgcaaagcacactcttaatctaaaaatatgaattatgcttagtggctcgttggaaagtatttcctttgcgttgggggggaatcaatcttttctattacttatttttctttcctttctagcaaggttaatatgcagaacattatctgatggactttattttataaggtgagaggtttcccagaagtgcagtacaaggctcattactccagtgcagaataaattgtccaaagtaatttgaaggggcatcgttaatagcccagtcttctatgtacctaagctgaggtaccaccttgccgctcaggttattgagaattgtccagcatctcaacgaactctgctccagtttcaagatggaccccattagggccaggtcatggtacaacatgggagaatcatagggcttggaattttgagacctgcgttcttgtcctacctgctccatccactggctagatagccttggctctgaacctacttccccatttgtgtgacagagatgacatgcaagatgacttcctcaagggtcatattccctgttgcctctgaaatataaagcagtgtctatctctggcgtggtccagccctgccacctctcttcaccccatctcattccactctcccatgcccactgaagtgccaatgattcaagtccacatgctgaaaaatctaacctagagtccctcctccactccctccatctcaaactcaattaaaaaaagaaaaaacagatccatccagtgtgccacagtgagataccaatcagtaatcatgtacatagcccttcctcttatccctgtcttagagccaatccatgtcccagccctgccgatgtcacccctcaatatgtctgcaatctgttgttttgtctttggttcctctgctgtcgccctaaccaaggatatgccccaatttctctcttggactctttcaacagcctcatacctggcatacctgcacctatttaaaatatatatatatgtgtgtgtgtgtgtgtgtgtgtgtatgtgtatttaaaataaacccctattttatttatatatataatatataaatatattttatttatatataaaacataggggttttatttatataaataaataaatwtatatatatatatgtatatatatacacacacacatatatgaaggaacatagggtttggaattcagagagagatatcgagagagtttcgctcctgtttttctctcaggctgaagtgcaacggcacaatctcggcttactgcaacctccacctccccagttcaagtgattctcctgcctcagccacctgagtagctgggattgcaggagcctgctaccatgtccggctaattgtatttttagcagaaacggggtttcgccttgttggccaggcttgtctcaaactcctgacttcaggtgatcaacctgtctcagcctcccaaagggctgggattacaagagtgagccactatgcctggccccctrtttgacatatttttaacggtgtaggcaaaatgatcttttttccaaacactgcaatcgtgtcatccccttcaaagccttctgtggctccccgttgccccaaagcaacatctaactctgatgtggtccagccctgctgcctctctgatgtggttcagccctgctgcctctcttcactctgtctcattccactctcccacgcccactgtagtccaccctggtctccctgaacgtgccacgtgctctctccctgatctcagggtctttgttcatactgttctctctgtctgagttgcttttccctgtacctcacatctaagtccagatgactgttgctcagcctccagcttcagctcagctgtctcttcctctgataaatctttgctgtgtccctaggagaggccaagccactctgttactccctctctccgtgttcactagagttgtccttctgcatttcctgctgtctctggttggctgtctgtctccctcattgtattgcagactccgctgtgtgaagagaggaattgtgtggctaacaccaggcctggtacatagtagccactcagtatggggaatgaatgtcttacttttttaattcttcaatttaaaaagctattgagagtttgtccatgatccccaaggatacatttgacaatgtctggagggttgtcatgactcagggatgctagtggcgtctcgcaggtcaaggccaggagtgccgcttcatatcctgtagtgcaaagggcagcacccgtcacaaagaatgatttggttccaaatgtcaccagtggcaaggtggagatgccctgctctagaaactgccaaagaagctgttgccaaataaaaactatagggaacaatgcaacaaatgactcttgatctaaattccatttcattggttgtttcattctggggcaatttcgctacatatgtttcttcatattggagcttataataatgcttatgtcatagtaattctgaaggagttgtcttttttaaaaaaacgtactctctctagaggctggagagggaggatcgcttgagcctgagagttcaaggctgaagtgagttatgacggtaccagtgcctcaagsctgggtgacagagtgagaccctgaatctaattaaaaaaaaaaaattatacaatgaataatgacccaagtactgtgttgtcttcatgccatggacaccttaatgctttcttcaaagcagtatgaggttgttaatctgagaatgaatctgttagmcttccctgaactcataaagtttgcttcctctttgaaagaacttagtgccttttaatgcctatgcagccgtgatgtgccaagtaatatgttccatgtgtaatcccagttttctgatagtaaaaagaaaagttggaaacctttggccaactttggtgcctgtggctgggagaccttgcagaggttttcaaggtctgctgtgaatgtatgatttagaccacagctcagttgtgacatttaatccatagagataaatcatcacctgccattggtagggytctttatggataaacaggcctaaaatagttacctgtaaaactccatcagagtctccatcagaaatcaccaccatttttttttaatgtaggagactgggatggtgaaastctttcttgattttggtgcttgagaacaaattaaatcaaagtcaaaacaactaactttcccttggctgtccttgaggcatgcttggtactgttttgtktgggtttttttttcccagtagtaggctggagttcttatggatttgattctgacatcagcctcccaggagaggccatggtgtataatggttaaaagcacagagtccagaaggtgactctcatttatcagctgtgtgaccttgggtgagttacttgacctctctgtgtctcagtttccttctttgttagatcggataatgatagtccttacctcatagaaatattataaatatgaaatgaattaatatccataaagcgtttagaacagggaacgtactcagcttaataatgtacatattcgattaataagataaaggctggccrggtacggtggctcatgcctgtaatctcagcgctttgagaggtcgagtcaggtggatcacctgagatcaggagatcgagaccatcctggctaacacagtgaaaccccgtctctactacaaatacaaaaaattagctgggcgtagtgggacatgcctgtagtcccagctactcgggaggctgaggcaggagaatcacttgaacccaggaggcagaggttgcagtgagccaagatcatgccactgcactccagcctgggagacagagcaagatcctgttccaaaaaaattaaattaaaaaaaataaaggcttcacataatatgcagccaaagtcagaaaaaaaataacattcttgactgcccttttcccatgaaccccagatccacttgatataatatgccctgatgtataatagtttggccaaagggtagaaattaatgtggaattcaacttaggagaaaaagcaaataaagattatttgttccatgtcactccaagatggccagttatcgcccaactctcttccttctgcttcctcaagatctcttccatctgcttccctccatccatcctcctggccactcccatktgyatgctyctatcctctctgcttcagccacccacccctcaccggtctccctactctcccctgtgctagagtggactctaaagcacacacctgatgatgccactgtcctgctcaaaacccctttcatgacttaagaagcagtgtgcatcgaaatcgcagaccctagattcctttatcaaactgcctacaggagagcctgagggacttgtctgcaaagctmttctggagtcagatgaaactggaatatttggtctttggtattcaccatgctccatcaccccaactgcaggaatcatttgcagctcatggacattttggatcacagggtggaagggaactgaagctccccattgttgcctaaacctaatggcaccaggtgtatattgctgacttaccttcctgtaggttgatttaggaattgaagtatgttaaaggaatacatttgagatggcacagacaatagcacctagggcagggcccggtcacagttgtctcttcataacattctaagtcgaggtatgtttattcattgaccarctccctggagtcttyatttctagtacagctgctaaattcagtcattcattagtcatgttttaaggacaatggataggagacattatttaaaaagcaataatacaaaatrccaagagctattcagctcttttatactagagcctgtatatagtacgttctttcccacaaatccctgtttttaaayattttctccatttcacaattataatcccccaaatgacagaatggttgtctgacaatatttcttctgatgttgaacatattttgtacgtttgagactgtgccagaaagtctatgcagcagtgacattgaaagaacagaacaatctaaactgcagatattcacagagggctgaaaacctacaataactattgggaatgttaatcatttcaaatggaggaattattagaggcagcacatttatcatgcatatcctcatcactagcttagagcacctgrcatagtttttaaaggaaagggagaaaaaaaagaaacactataataatgagaaaatatgcaagatttgaagtcaggaaaatgtgggtttaaactgcagcttcttccaatagctatgtgatcttggaaagttacttctccagtctgaacctccatttcttcaactttaaaatcagagtaataatagtaatacctataytctaatgttttattggaaagaacggtgtctggcacatagcaattaacccaagcaatttacatagcaattactygtgaaaaagaagctattaatactatttattgttattttcccactgctgttgcccttcagccaaagagcaccaggaacacatccgtaattaagaagttgggttgattgctcattgcaatgggagagaatatactatagggaactatgggatgtcttagtaaaagtgtgttagaaaagacatataatttgggcttgcattattagctgctttggcggaagggtcacaaaactgaaccatttctctgaattggttgctattcggaagcatgggtagttctatgaccagtgctaaatctcatctttaggtaggacagcctarggtgaggctacagccgtaattggcaaagaagcagctattgttttagccaggaaaggcgayggcttcggcaatgttcrggtctgtctgtgttcatgcataattacggaatggccttctttatggtctgattgactgtggtcatagagtggccttatctgatgttggtattctctgaaatcatgtttgacaggagaacaccaacatctaattaatgtcccaggccagctcctggaggtcagtggctacttttcttttccccatcatatttattcatatatttagtgagtagagtactgtcaatccttcgtgtcctttctctaacaaagtccaaattctatgtaaaaaattctatgtaggtcaacaaaacttagtaacttgggtgtcaaatgtaaagaagaaaagataggctcaaaggagagagtagggytgatgtggtagagggtggacccacggtgtctgtgcaggccagggtagggaggctggctttcattttaaatgacatctgaaaagtttgtcattttaaaaagtttgcttggtcccagtaaggatggagaatggcttgttggggatggagaaaaagggaaaggaggttcaaaaagtgaagtaaagcttttatcatttaaatgtggcagcattagatgtgggtcacagagttgtagacaggcttaggacacggaaaggagtttggttattcatctggcccagttgcctcctttacatgtaggaaaatcagcactgaccaggacagatgaagtggcttgtccacacccaaatatttagttagtgcagagtggagagctccaagtgggggccagagcccagaagactccttcagccttgtgcccccaacactgtggaatgggaactgaatcagtcgtggggaggaggggtctctgcaaacgtggcaggtcacagaagatggacagcaagggccagscacggtggcttatgcctgtagtcccagagcttcaggaggccaaggcaggcagatctcttgagttgaggtcaggagttcgagaccagcctggccaacatggtgaaaccgtatctctactaaaaatacaaaaattaactgagcatagtggcgcacacccgtcgtcccagctactcaggaggctgcggcaggagaattgcttgaacctgggaggtggaggctacagtgagttgagactgagccaccgcactccagcctgggcagcagaytgagacttcatctcaaaaaaaaaaaaaaaaaagcgggggagggagattaatcctggtgcccttctagaactaccacctggcctttcttaattgtcyacttggagtgtttgccaagcgaagaaaagatgaacccatgactgtgacctacctggagggtagacattctggagagcttcccctccaacaatgtcccaaatctgtgttcatccctgaacacaaccactgcagttctaggaaaccaactttctaatatatttaaggatgcttgtcaagattttattatctgttctttcatcagagagatgtttacaacagcagaaaaatttaaaaataaaaatgaaatgttttgaataagaaaataattaaattatggcacagccagggtcagtagtcatctggtcgactgtggatggatcttccagagactcctctcgcctgtcatttgttggcactcaatctctacctgttgttcaatactttgagtaccactctggtaatgaaataataagagtgatggaatactgtatatccatttgaaagatgacaattcaattacttgggaaaaacacaatacatttacaattggcaaaatacaagctctagaacatcagcttaatctatatctatgttaaatgtatgtaaaacttatgttcctaccaaatattaacagtgactttccccgattggtagaattagggatggttttaattttcccaatttttggtcagtgatattttcttaatgtttaaaaaggaacattaacagtttttatgataaatgaggaragtttctttacaacatttttttgcatgccattccttagagttgggcagcttttgcaagctgtgagaagcccagctcctgcttttcctgatacggtttatgactcacagctgccaccaagatgtcagttagctctgtgacagtgaaatgacttcatttccctgaacccggatagaaacggtgtctgggaagagagagagtacctggtggagccctatgagtaaatgtgatgatgattcagctctggaccctatactctactccaaaargaaatgtttcagggcatcagagggcatgaattcatgaatgtgtatacgaggctttgttcaggatatttttaaatatagaagttcattgatacaacatccctatgaggtagggattattaagagggctttatctataaggaggctgggattgagagggtttgaatgatttggcccaggtcacaccataagagctgggagcgagatgacagagtcttttttgtccacaagcaaaatagccatgcctgtacttgcagtcggaccggaggaacacacaggccaactctgacgcaaagcatggttatcaccatgctcctccaatgccacctgcgtcttagctctgggtttattattcactgagtgccttaatgggcacctatcgtttattttccctgggcctcagttacctcatccgtaaaatgagacaagaaggtatttgaggtagatgaacttcaggatcccatcagccttgacgagtgcaggattctatgtgaatctagatgagatttatccaaggacctccacatcctgcctcccacctccatgagcagctattccaaagctaccagtctggtgattcagccaaagacccatcattaaagagcacaaagacatccttggccagtatctttctggatgctgatgcttttctcctgaattgcatgtcaccttggagaackcagtgatggatgagagagatccagctttgacctggaaaacwttsacattgcaagtttttttttctttttctttatagatttatagkcaatacttcagcctttctatgacaagaagcttatatttttctggastagatgtaacaaacgactttccaagtgatcagtgacatcccaagttagggctgcattttgaaattgttctttagaatctctaacttcattgggaacagtgatatcagaatgttaccttaatactctgccagaaaggcatggagaagatgtaaaatgtttataaatgaacatccagtgatgtgcacttggtaatttcattcaaagatgtaaaggaagagatactataagggacatttctgttattttgtcaaatgctattatttactgaaaaataaaatttcaccctayatgcttgaccttcagggacttattttaagatcatatggcttttcctaaacagctgaattatttagtgagattgaactctcaaagactttaaaataaagcccaccaaaataccagccactctgcagtgctacagctgttcagacctcaatctgcatatttcatctcagcagactgaagtttgcaactgaaaaattgctcagaaaatacttatcaccttccatgccaaacgcagaaaggaatttatttgaagctgagaatgtgatagggtgggtgacttactcccacagtgatgcttagaatggtggatggagttctagctgcgtttttgctgcttcacccctggggaggccacgcctctgagaaagaggctgggaggcccttccgcaacaggtgttcaggtatgagtgaaagaatctaaggagtgagcttggagcactgcacccacagacaggaccatcattaggagcacattctcagtgcgtgttgaatgttacgaaaaggtttgatttatacatttttgacctaaatagaatttaatcaaaatgtctagagaatttttacgggttactagcccctcactttttctgaagtactaaaagcagaatcaggaattcaagattatcatgttgagtacaaagcactctagtcttcctaaaggaatcagtgtcagactgggctggtggttcacacctgtaatcccagcacttaggcaggctgaggcaggaggaccacttgagcctgggaatttgaggccagcctgggcaacagagtgcgaagtccctacgaaaaaaaaaaaaaaaaaaaaaaaaaaaaaaaatatatatatatatatatatatatatggagagaaagagagagcgagagcaagccaggcttggtggcatgtgcctgtagtcccagctactcaggaggctgaggtgggaggatcatttgagcccaggaggttgagactgcagtgagccaagactgcaccactgcactccagcctgggcaacagaggaaaccstttctaaaaaaaaaaaaaaatcaatggtacctcctatagagtcaggtgatggtgttgattatgatgatgatggcaaagacggtggtgaaggtgatggygatgatcatggtgatgatgatgggctgatgatgactgtgatgatcatcatggcaaagatgacaatagtgaggttgatgatggtgaagataccaatagcaacaatgaagatgtggctgctgatgtgacaaagatgatgatggtgatggtgatgatggcaacagtgatgacaatgatgatgatgataatgatgaccatagtaatgatgatgatgatgacgatgatggtagaggcttacattgattgaacccttgctaggtaacagatatgttaagcacttaagccctgagtgttcattatcttatttaatcttcagcaccatcacatgaagtacatgctgtgattttcccattttaaagatattgaaactgaagtttaaactcggtaaggaacttgctcaaggacaatacttcttaaattttgctatacattagaatcacctggaaagatttttwaaaatcttgacccagaggttgagtaatgtgctcaagggcacccacctgatgagtggcagaaccaggctttacaacccagtcactgagcaccagaaccatgtcctctcttgtgaagagccagtcatagtgcccaaggaattttcagggccatcattgctcatgtccctccggtgatgctgtttttaataatagtaactggcgagctggagtataatgttttgggtagcatggcagatctttgtggggcagtgtgctgaaaccagcttaaatctctgactgccgagttaatttatttcattcataatattctgttcgaaatgaaaatattctcatggttggttttgcctgaaggtataaaattccaaccagtattagctgcttttaaagtgtagcagttagaagcctgagtccctagagatggagatagaagtccatggtgcaagcagttccccaaatcagcaaatcagcaaatcagcgctttcctctgatgaagagggagttcacggaagactccaaaaatggaccaaaatgcctctgttcccacgttgcaggtaggaaattaaagctcttaagaaacgatggcattgtttatccatattcagaaaccacagggctgggatttttttcaaatgaggccatgctagttaattannnnnnnnnnnnnnnnnnnnccagtcatagtgcccaaggaattttcagggccatcattgctcatgtccctccggtgatgctgtttttaataatagtaactggcgagctggagtataatgttttgggtagcatggcagatctttgtggggcagtgtgctgaaaccagcttaaatctctgactgccgagttaatttatttcattcataatattctgttcgaaatgaaaatattctcatggttggttttgcctgaaggtataaaattccccaaatcagcaaatcagcaaatcagcgctttcctctgatgaagggggagttcacggaagactccaaaaatggaccaaaatgcctctgttcccacgttgcaggtaggaaattaaagctcttaagaaaggatggcattgtttatccatattcagaaaccacagggctgggatttttttcaaatgaggccatgctagttaattaagactttgcctttcagggattatttatattcttaatttttgatatttttcatggcagtggagtctgaataaactcacaggtgtgacctccttccatgccagctactactctctcatttaatcctcatacaacactgacatttgagtaatagttttcccattttgcagctgaggaaactgaggctgcgagagtttataatttataaaagcttttataatttataaaagcttttataatttataaaaggttttataatttataaaaggtttgcatcattttcacctacccgaatcattcttctacaaaagaagaaaagttatttcagaaaagcttcctaagttttccctaaaatgaatttctggcctagaaaatcagatcctgctgtgttcacacttggcctcaatttcctcaggcttctgggtcattaaggaggagctttatcacctggctgcagggtggaggaagccaagattctggaccgatagcctcccacagctgcrttagtattccacaaaggcgcaaccagaagatagcaaggaactttcacacttggctttaatttctctctgcacattttgttagcgataaagaccatcatgttttttctttctccaccttttttgcttttagaattctgaatagatgttttcatcacgtggctaagtaaaactggaatagctgagatttccagaattcagttagaagatctgataagcatctaaaacttgtcctaaggtagggggagaagtgtttagcttggaaatataastcggagttcccagtcttcctcaagtaggtacttggggagatactgaagtaggaggaagatgattcctacaaaccacgccgaacaacagacagttcagagatctttgtgcctcttgactcaaaaaggcaactaaaagatttctaaagcattatccccatccctcccccatcaaacttttttattgggtatagaaaaacatgaggaaggtcaggtgctgtggctcaggtctgtaatcccagcactttgggaggctgaggtrggggggcagattacaggaggtcaggagttcaagaccagcatggccaacgtggtgaaaccccatctctacaaaaaatacagaaattttctaggcatggtggcatgtgcctgtaatcccagctatttaggaggctgaggcaagagaatcgcttgaacccagcaggcagaggttgcggtgagccgagatcatgccactgcactccagcctgggcgacagagtgagactgtctcaaaaaaaaaaaaaaaagaaagaaagaaaaaagaaaaaattagaaagtaccttcactagatttagaagtaagcccttaggcatagatggtcagctgagcctttttaaaaaaggaagttgcttaatgagatcggtttccaccactcagtgttagagttttgtgcctccagttttataaaataatgtaaattattcccagccgcagagaagaaaggacagaaaatgaaaattagcagggtacagaagtccattctgctgaacaatggaagaaaaaccacacagggatttggtaccattaaactctggggcaattttctgctcatttctccatctcctctctttctggtggtaatcaaaggaacgagctccagataggaaagtcttccctgtaattaatttaaacaagttcagtagactccaattatctagtctgctacaacwtggagaaatgactgggaaaggaactcctgggcaactggaatgaattccatgatggctttattaaggagtacatgtaacaaatccaaagtctttaagcttatccttttggggggcttttaaaagttatgtctttataataaaataaaagctggggaccatgtttacctctatctcaagtgttaagctgaaccattgatttatttccttagagtgatgcattactgccacctaatggtcatgtacctgcattgaaggggttaagaagtaaggaaatgatttaaatagacttaccaccaccactggtcacccgtcttaaaaaaaaaaaaaaaaaaaaacaaaaaacmccttatagtaaccttttttttttttttttttttttttttttttggtttgtgctggatgcggtggctcacgcctgtaatcccagctctttgggagggcgaggcagatggatcacctgaggtcaggagttcgagaccagcctagtcaacatggtgaaaccccatctctactaaaaatacaaaaattagccgggcgtggtggtgggtgcttctaatcccagctactcaggaggccaaggcaggagatttgcttgaacctgggaggcagatgttgcagcgagctgagatcacgccactgcactccagcctgggctacaagagctagactccatcccaaaaaaacaaagaaaaaaaagtttgatggatgaagcagatgagttactgtggatcaggactgtggaaagcccgccagttagacaagggatgttgccctcacccaaagagcagataaacaccattggtgctgtttgagctgggcggggcagatgataccagatctttagcaagatgagtttcacacctgtgtacaggaagaagcgtgtgaaaacaggtcaagaggatcctgaaataaaccaagtgtgagagtatcaaggtgacaaaagggtaatggaggctggaatgtgaagttagagataatcatttttttaaattatattaaattatattttatattatatatattaaatattgatttattttttataatttataatgatttatattaaatatcgactgtttgccaggcaccatagttaaaatgagatagaccagttctctctctcaagaagctcccacatcaagtagcccttgatgtgattcactctgtggtctgcagaagttgccccacctctctggtccccagtctcctctgttacagggaaaaagattgctctgggagttttcagaagcccctttgactcccaataggaacttgcctggagcaggtacttccaagggaatgagaggaaaagcacagtgtttagctgagataggggtaaatatggtccccatcttttattttattatagagatataacttttaaatgatagctttgtgtaggtgatagtggagctgagtgagctaaagattttttttttaatctcatgatctgagtctagctatctggagtggagcaggaaatgtggtatcactgatatgtaaagaaatcagtaaggaggggctcatttgcagataaaagggaataaaaccagggcaggcatgcagacaccatcatggtagctagacatataaatgcagagatccaagataccaacttcagcttggagggagaaacaagatcaaaggaagagggttcagcagttctgtgcatgacactgggtcagatctcttccctagaacaagatgctcaatggctgtgtgccccagaacaaggtgctcagtgtctctgagcttcatgtcactgttgtgtaaaagcagcactatgataggggcctcttcatagagcagcattgagtatctttggtttaacatgagaagagtgactggccctgtaagcttcagcagatactaactagtatcattatagctcctcctcctcttcatgatgatttatagaattggtcaatttttccagggaaaagcagtagagatgagagtaagaggatgcattcattccatgcctgcaagacagcccagctggggaaggtgaacttcagtggtggggaggagtgaaaggaatagaaaatagagatttggggaggatagggtggactggttccacacctctgagacagcaaagactccaagaagtttctgagcaaaggtcacaggacttgatgatttggaggttactgatgactttcgaaagagcagccagtgaggaatacaggattcttcgtatggagacagattacagaaagaagtcaagtgaagcaacaatatgctcctagataccgaatttccacagcctggcaatcctcaacaaaagggagacctgggctagttttagactcgagaatagatcaagggcaatgtgtgtatgatcagcaggctgcagcttccatattaacctacgttttaaatgtcttacattcctctggacaaaataaatcagcccggatggaattcgttgccacaatgatctataatgatctatgatatgtcttctcatttataatgtcaagcccttggagataggaggccctcaatgtttctttgagacctgagatgagaggatgatcaatgaaagtaaacgaagaggatcatggtaaagatctcatggtaccaagaggaaaacaactgataaacagggctcatggaagtccctgtccgctgggcaaaggagaaacggctcccttacctgatcacacatcttcgtcatgtccttcagggccccagatcctgttctaatgcagagcaggaagatggtgactttttgaaatttctggaaatakcactcggtgaatcaaagcaaattaattctctcttttagtcactctgagcctggatttccagtccttggaatttcgcttctaccaacagttctttcagagtcatttatggttctaaatacacaggatgcagttcccacatcacctcccctcataacaccatgggatgaataatcatggtgaagacaaggatctgtggccaaatgatggtttcaagtccctgttctgcaacttgcctaatgtgtcatcttggacaaatcctttatcctcactgcaccttcgttttgtaaatagggacgttaacgctgggacgtactctgctggtttgttttgaagagaaaatgagstaatgcaagggagagggagctcagaccacagatttgtgcaragaaagtgccgaataagtgacggctgctgtttytgtttttattctgcgaggaactctaatagaagaaaaagagcatttgatgactgaatcaccggtcttcgctagcagggcagaggcagatagttcccccgccccgaccccgggcccagctgctcatcactggggttgcagagttcaatgccgacatcccaactctgacccagcacggtgcctactggggaaggcagatatggataaaccacagcagcgccctgtgattgattctttgccagacggtggagaaagtgcacattcccagatagctcctgcagggaggttgcatgatgcccacaaacccacctgtgaggcccataagcctggatgttctctcttagctgcttaggctctgcccctcaaaagcggaaatgttgagtgtggagtgcagcttgttctatgaatttgaagtacgtggtccctggggttggaccagcaacaagtgactcagtccctctgagactctgtttgctcctctgaaaaatgggtggtgttgtgggggacaattttctacctgatgagctcctcatgaggatctatgtaaagggtagtatctgattcattaccaggattttgtatgctttataggcatgccaaatacagctgtatcttactttattaaatcgaacggaaaaaaatgtgaaaatcaagttgtgtgttaaatttgataaagagggccaggggcggtggcttatgcctgtaatcccagcagtttgggaggccaaggcaggcagatcacgaggtcaggagatcgaggccatcctggctaacatagtgaaaccctgtctctactaaaaatataaaaaattagccaggcatggtggagggcgcctgtagtcccagctccttgggaagctgaggcaggagaatggcgtgaacccgggaggcggagcttgccgtgagccgagatggtgccactgcactccagcctgggagacagagcaagactctgtctcacagagaaaaaaaaattgataaagagagttcatgatgtaaaacagtagttctcagccttgtgtgtgcgtcggcatcccctggagggcttgtgaaaatccatatggctgagccgcacccccagagttaccaattccataggtctgggtagagtctgagaatctggatttttaataagcgcccccagtgatgctgctggtctggggaccacacttggagaaacaccttcttcaaggagtcacatgtttctgaagcaaaggagaatcatttgtctttgtattactctgttctcacgctgctaataaagacatacctgagactgggcaatttataaaggaaagaagtttaatgactcacagttccacatggctggggaggcctcacaatcatggcagaaggcgaaggaggagcaaagttacatcttacatggcagcaggcaagagaaagcatgtacagggaaactcccctttataaaaccatcagatctcatgagacttattccctatcatgagaacagcatggaaaatacctgcccccatgatttagttacctcccaccaggtcccatccacaacctgtggcaattgtgggagctacaattcaagatttgggtggggacacagccaaaccataccactctttttttcttttgtttttgtttttgcttttttgagacaggctcttccgctgtcatccaggctggagtacaggcactatcacaactcactgcagcctcaacttcctgggctcaagagattctcccacctcagcctcctaaatagctgggaccactggtatgcaccaccatgtgcagctaattttttacttttttgtagagacgaggtcccactatattacccaggctggtcttgaactcctggactcaagtgatcctcctatcttggcctcgcaaagtgctggcattacaggcatgtgccacacgatgcccagtccattttatttcgtactgaaatattcttcctcctattttttcttttcaaactgaacatctttatattcgaggttaatttaaaatggagccttcagtgcatctggtatgtgtgtgaattggacccagctcagggattttgctcttctgtttaatctttgcttttcctgtggacccatgagtgtcaggactgatatttctgatttttcctttgtgccaaattgagcctcatctgcccggtcagccctaatgtcacacgcactccccaccgcctgagattacaggacaggagatacatttcgattcaaagttctgaaaatatgattaatctcaagactggagagagaaaagttattggaaatattttcataaaaattaatgtttatagtcaaccttgtgacagtcggtagtatgtcagcaattcaggtaaggttgtgtttgtgttttcttgtgcagaggatttagctgcctataatcagtttcatgaaaccttgctcttacatgactcatttttttcatttattcactcatttgttcagcaagtgtttatattgattatctacttggtgccaagttctatactaggctgtgaaaacagagacaaatatagacatcctctgttcaggcaatgagagctttgtaataagtttcttgttttttaaggacaaaggcttttatgattttagcatcacgtggctcctcactttctcggttcgttttgtgtttggttgatgttttcgttgttgttttgcttggggatggtacttgtttcctgcccagcaattcttgtaagtaagtaataatatagaataaccagatttgttgggttcctgcaaagacaaacatgatatttaaagaagcttgcaattaaatagagaaaataaacatctaaaaatagatgtacaatgcagtgtgatgaggaacaagagaagtacctcggtgaaagaaataatgtatgtgtttgtgatgtctagagaagtattcgtggatgaagtgatactggaggtgggttttggaaggagaaatctctttctcatattattagtctcagtcagtttcccctccttttgttccaggaacaccagcatttcattagacttagacccactgtaagcaaagggcttaagcacaagtccctgggggagaaactcaactctgccatcttctagctgtgtgcctttggaaatcacttaatttttgagcctatatgatggaatactactcagccctaaaaaggaatgaattgatggcattcacagccacctggatgggattggagactattattccaagtgaagtaactggggaatggaaaaccaaacattgtgtgttctcatctgtgggaactaagcaatgaagatgcaaagacataaggattgtacaatggattttggggattcaggggaaagggtgggtagtgtatgagggataaaagactacaaattgagttcagtgtacactgctcaggtgatggatgcaccaaaatctcacaaattaccactaaagaacttgctcaggtaaccaaataccacctgttccccaaaaacctatggaaacaaaaaaattaaaaataaaatgaaaaacaacattgatcatgaaaaaaacatgaataacattacaccccacacaggattgttgaaagaaacaaaagaaaatattatttaaaaagcacttagcatcgtgtctgacatgttataagcacttaataaaatcatagttgccttagttattataattatcacaatgttgatgggtgtcctacaatacaaagtggacggagtcagggctggggaattgagtctatctgtggggtgtgcgtctgtttaatggtggggttctcagatccttgcatgtacaagggcattgtgaattggctgtatgtgggcaatgttctctgccatactcccgaacttgtttaaaaaggaaactctttatccaccatgtatctgtgagagctgggactctgcagatcacttattggttcacagcctccccaaatcagcctgctctgttcaggggaccatatgtgcctgataatgaccctgcctttgtagtccatggtcaaaagcttgccatgagtctgtagtgccagctcaaatggcatcatgctgtgctcctgccttcccaagcagggtgtgcacgcaggcaccctctgaaggctaggytctagatatcctctcatctttatctttgcaactttatcctggcttctaaggggcatgggtgtttcactgtcactatctgtggaaaaattgattcagtctgcatgttccgtgaaacactaggagattctccaaaagaagcctcagttagcaactgcaagtatgcaaaacaggtatattaaggggtgatgactcacctcagaaaaggaacctctgtttatagaaaagattaaccagaagacgtctttaaattacatccatctctgggcatagcttgtgggtgtctgagaaaatgattgagaagtaaaatctgttttgtgtgcatgatacacattcccaaataagcccaaaagaaatcaaagtgacagtttgatttaccttttttaattcagaaaataccttttcaatattgacactagaaatcagccctaattattcccctctgactttgctactttgtctttccttctcatctgtgtccacttgcttcctattgcattatatattttactttgcatttaatgtatcataagcacatcccagattgctgtatggtccttatcattataatttttaatgactgtgtaatggtccatcaagtagctgagtctaatttatttggccattttcctatggttaaacatctaggccatcgattttctgccatttttagctgtagaaactgtgttttaagaaaccatatgtagaacctaaatatgttctattgatttttttttttgatatagagtcttgctattacacaggcaggattgcagtggcatgatctcagctcactgcaacctccacctcccgggttccagcaattctcttgcctcagcctcctgagtagctgggattacaggcccctgccaccacacctggctaagttttgtatttttttagtagagaatggggtttcaccatgttgaccaggctggtctcgaactcctgacctcaagtgatccacccgcctcagcctcccaaagtgctgagattacaggcatgagtcaccatgcccagctctctattgattatttgtgaatacttcagcttatttaattttcaaagtaatctttaaaatcggarccattgttatcacactttctaagtgaaaattgatgctcagagagattgtagagtttgctcaagtctggatacctagcaggttatagacctgagacatgaacccacgtatctctgactttcagagggtggatttttcatcagtgaacaatacaacttggaccatgtggagtgagacaaggaaactggcaaggcccaagagattcactaaccccctctaaacctgcccctgatgaatggcagatggacattcaaccaatgacagctgtttctgagcatctaaaatgcagggagcctggtgtgatcactggcccacctgaggctctgggggatgagtcgcaggttccatccattgctgccgtgtctctgtttggtttagaagtggctttctccaaggacgtgaatgttcattttagtgcaccttctggattttctcctcttccctagatatttgcttttgtgtattcccacgcaggagcttcagccattgctacacgtggctccttcttgtgctcttctctgcttccagctgcgttttcctcaaaggctttctggtrtccgtcaatccctagatctctaagaaccttgagctttgcaatttatscctcttcagaatcctatatgtcagtggcattggcggagtgggtggacacctggacaactgttcctgctttccattcgttttcctttgtcacttaaagtgcagggccagggcagcatctcttctgttagtggcgcagctttccctgtggacaagtctccctttccttctctgtgctagctggaaacaaatcactaattaaatttcatctctcgcagctctggaaaaacgacagactagtgcttccaattaatttcatcaacagtgtggaataagaggcatgttgcatcctgtaaagacagcagggctgaggggaggaggctcccactgctgttaccctgctgtctgtcttcagcgaggctggagttctgagcctttctcacctgcgttccaatatccagccctggcttgcttagagggtgagaagactgcatttcttcatccaccaaacaccagtggggagtcacctgtgtgccaggcaccacgagcctcccactgttgatagaacagcaaacaaggcagacacattccctgctctggagatagtgccagacaaaaataaggatgtcgggatgtggcagttacaggtgtctctgaacatttcactaaatcgaatggaccagggccaacgacctagagacaggaaagggactggttgagcacagtgaggccccgtcttaggtaaagaggatacagaaatagatcaacatggtcccgggctttggaaaaatccaaactggtgagaaagttacctgaggggtcagttgcagtacaacgtgaaagacgtcatgacagtagaatgcacggggaaccctgggttcaggggaggggacttttgccctttgtgggttcagaggcaactgcaaggaagagcagatacttgagccattttcaagagtgtgccagatgggctaatggaaggaagggcatttcagacgctgagaagtccggggcaggctatgtttaggaagcagtgaatgatgtgttgcatcagaaagataccctagggggctgggcgcagggttcatgaccgtaatcccagcactttgggaggccaaggcgggcagatcacctgaggtcaggagttcgagaccagcctggccaatatggcaaaaccccgtctctactaaaaatacaaaaattagccaggcatggtggcacacacctgtaatcccagctactcaggaggctgaggcaggagagtcacttgaacctgggaggcggatgttgcagtgagctgagaagatgccactgcactccagcctgggtgacagagtaagactcygcctaaaataataaaaagaaagatcccctagggcatgtccctgatggagctgaaatgccaggtaagcaagaggcaggttactaggggtctgatatggcttgattttgactttgggcttcatctcagaggcgatggaggatggagtccaagccaaaacacctgggcaccggcccaagctctgccacgtccctggtatgaccttggcgagctccacagttcctttaatcactgggggtaataagagcactgacaccttacggttgttttggggattagacccaagaatacacatgaaacactcagcacgtgcctgggctttaagcgtttgataaacattacctctaattgttacagcttagtagtgtctgtgttagtattgatcaccatggtgggcagccaggcagggtgggcactgaagggctttgaagtcagaaggacataggatctattctgccttgccatcactcattacatagccccagacacgtcacttacctcccttaccccctctgcttttcaattaaggattgtgtgtgtctgccacccagccccagcttcagcacatggatcctcaataaatcacagatgttgtcgttgtcatcatcatcatctacctctattatcctcaacaacaatgacatccacagtagcaataagcaggrggagcacctaaggcagactctgctttagagagatgagttcagrgcttgaggctgaaagacagggaaccagcaggccaggccatgcaagccttgcagctaaaagacagggaaccagcaggccaggccgagccaagccaatagtcactgacccactcygcatccaagatccctgaggcaaaatctgaaaacacacatgttaggaaagacatttgtctctctcccagatttctgatttgacaggtcatggcaccctaaatttgcattttcaaaagctccccagggaattttgcttttccagcaggcgtctgagaaccctcatcggacatacrcagtgatgctggtaaagcctgagcagaaacaaaasagggtcccgggggcagaatgggaggcagctctgggtctcttaagatggccctggtgtgctaagtgcaccagaggtaggaactcacccactgtcgccattacagacagaacgctcctaacagagagcttccaagaaaccccagggctttcctcgtctgctgggacgtctctgtcttcctgtgcctgctcctgctggatccaggatcccaggctggctccaactcaagatctgctgyttctcctgtacttgacacctggttctttgggctgttcctttgttgatctgttattgtttactttttagtygcctttgaattaccaaactaagtcattcttgtagcaaaatctcaagcacagaaatgactacattaaaatgagccttccacctctcctaattcctccccaacacttcccaacatcatcgccattaacaactgtgtgtagtcctcttatattttcctttccttaaatataactacatrtctacagacaggtctttgttttgatatgattttacaaacctatggagttatagaatggagttcatcttataactcatctccccccactacaaaaaatcttgtggtcatctttccatgacaatacaaattcttactattttttcatagctatggtagccttgtaacttatttactgatttccctttttcagccatcttcctgttgttttgcaaacccaggccacccagcaacaatcttctttatatactgtcttttcatactgacacttctcagtcctgttggatgaattcccaatggtgcgattgctcatttctgacattctgtctgctgatcgtgggccacagcaccggttgtctctttctctgactcaacccaagtctgatgagatttcagtttcactgcagcattgcagcaatgagaaaacatcccatcatgcactgcttctagatattgtcaagagaagggtatattattatgcaaaagcagtgtctatttacagatgatgaaacracaatttttcatggggtttttctttttatttaacatcttaactgtcaattccaacaaacacrcttgttttcctctatgactaatctaagaaccaagatggccaacagcacaataccaactttttgtttgtttggtttttaaatatggcaaaattayatatgagcttcccattttacaggtttctaagaacatcttaatgaaaataacagaactcagaaaatccactgtcattttgtccagaaatattttgttagcattgggatgcagcaatgccaytgacaagaaacccatgtggaccaccttttaatgcttaatgagcctttcttcctagcatgcattccagtgggagagaggacagaataaacgtgattaaattatcggacagaaacacatgactataaataattgactctcccatgtttcatgagccttaacctcacacttcagaatgtttatttcctttatttcaaaatgtttgtttacttttctccatggactttaattaattttgcctttggcttataaacgggtgaaactaaaaacttttttatttgcatttttatcttgaagcaagctaactaattaaactttgcaatttggtttcactgtgctgtaccagagccataggaaaatggctgacagattcgcagatttgtgaccgtttttctaatgaaggagattttggaaattttgatggtttcatgtaaatgctaaargtaaaacctgtattaagagtcacttgatcacaggaagaaaaataaccaaatgactcaactgcataaggaggtgaaaggaaggatctagaaactacataccagtaaacgtcccctgagtaccacaaaaagtgtagaatggagtatgagcattgtagttttcaatagtgttactcaactggtagaaaagaggaatgcccaaggcataattcacatagatttcagtctgatatgcaacaggttcttccatgagatgtgagggcttaaaagaaaaggtagagattgaagacgttatcttttaaaagatactcacagcacatttaattgataggggatcagtaacaagattatataaagaacttytaaactcaataagatagcaaaaaaaagtaaaaaataactaagagataaaaacagtcatttcacagaataagaaaaatgactaatgtataaaaaactgttcacactcattggccattgctaaaattccagtaacaattagatgtatttatataattttatgtcttcctgattggtaaatattaagcctagaaatgccaagctttggcaataacaggaaaacagagaccctcgctgactgctgttcagagagtaaatttgtacaacaactttgaagaacagtttgtcattatctaccaaagtggaagatgtgtaacctatccctaagataatctctgcaaggaattctcatttatgcccctgggcacagagacaagaacactcctagaagcatttctagcaatagcaaaataggaaatggcctacatgctcattgatggaagcatagctccgtacccggcagtgtgtacgtctgatgaactgcagcaaggatggtggatctccaggacatgcatatgtggaaaacacagtctgcagaaaaatacaaacagatgatttcatttatatagagttcaaaaaaacaggaaaaactattaggtttagaaacagataagaagtaaaactatgaagcaaaacaatgaataatagatttaaaattgcagatagcctgagtgcagtggcttgcacctgtaaacccagcattttgggaggccgaggcgggaggattgctttagcctaggattttgtccaagatcagcctgggcaacatagcgagatgttgtctctacaaataattaaaaaaaaaaaaaaaagttgggcatggcggcccatgcctatggtcctagctgcttgggatgcttaagcctgggcagtcgaggttgctgtgatcactccactgcactccagcctgggtgacagaattagaccttgtctcaaaacacacacacacgcacacacacacacacacacacacacacacagaacaaacactgcagatagccattttcctaagaggaaaggtagcaggctaagatcatggaggaacacacaggagctgcagtggtatcgtaatgtgatatttcttaagctgggtggtggatacaagtgttgactgtactatttattataccttgctatatgttgtatatgcatgtgtgtatataggtacatatacacatacatgtatatgtacatattcctatttatatataaaatatatagcttttaatggaaaagaggaagtatcagctatgtaacatttatcaggcatgaatcttatctcattcaacatttttatcaataatttattaaaatctggctcatccagagcaggtgagggatgatgatgattgaatcaggttttctgaaaggcatggacaagctccagccatgaactgattatttaatggaacagaggtgaagatgaaatcttccccttgagattcttaaaaaccagttcactaaattgaggtgagacccccgcctttgttaaacagcaattcatgcacaaacaatattggggtcttagttgacaagttcaaaaggagccttctgtacaagtgtctgcccagagagctaatttccactctaggaagagtgatcatcctgcaacagctagcatgcatcaaggtgtatcttgtatagttttctcccagcatcttgatttgaatagagagttgacaaatcaaagcatggtcagagggtggtaactagcaatgtaaaagatcagcttgtaagtttgtagctcatcggaggggaatgtataagagctatagtggaacttcgaggtttccagaagatcgattctggctctgtgtacccaagatctcaccaaagccaaacataccccagaaagcagtggcctgccttgtaaggtatgagctcaggtccctggatgtgtttaggcaaaggctgtacacctccctgtccctacatgtgtgctgaaaggtgggctccatggctccaacatcccttccacttcgtggctctcatgagtctataagagtaacccaagagaagtcaccagcagaaacttggaaatcgttttaacaggggccaagagggaaacatggggcagtgcatgactgacagctgtgctctgtcacttctacatctgccttgcagttcttcaagcagccatgarcccctgcaggcaaacctgtggtctgttcagcaggacctgtctctgctgccttagcccctgggaaagggaagcaatgctgtggctccattttcagcagcgggcaaggaaaagaacttgggttcgagagtttcacaacttgagattgaatctccttctgcctcctttcakttatatagtctcaagtgcttatcttcctttctctgaatttcagtttctagctctttaaacaagggtcagggacagcttactattgcagaaggtggtgagatcaagaaagaaattagaggcaaggtgcagtggcttacgcctgtaatcccagcactttgggaggccaacgcgagcaggagtttgaggtcaggagtttgagaccagcctggccaacatggtgaaaccccatctctattaaaaatacaaaaaaaataaattagccaggtgtgatggcccatgcctgcaacttgctactcaggaggctgaggcagcagaatcacttgaacctggaaggtggaggttgcagtaagtcaagatcaygccactgcactccagcctgggtgacagagtgagattctgcctcagataaaaagaaagaaattggagcacctggtatatattgctttctcaatgcccaaccctgaaacatctctaatactatttgttcacttactcatcaatttgtccaataaaagtttatgtaatacctagatcctaggtacctggtggcctctgagccattgggaatatgcttgtggaaatacaccctcctctcgaggaagctatggtcttgtagctgagactgatcacccarcagacaatggtaaacccagtgtgccaagctctaggcagaggataaaaccacgaagacaagcagaatggaagaggakgaaaatrtaacactgcctcgggaaggagtgttggggcagactttctagtgtaatgaaagatgagcagaaattatttgagatgaagcaggaacaacctggggcaggggcattgaagattctattgctgaatgaacagcagggaccaaggcccaggcgtsagatagcacagccagctggtgaaagttcaagttaagtgcatcagccaggatgggccagcttatgctgtcatagtaaagtacccaaaatgcagcgattcacaataaaaacagttcatttcttcccattatctctatcctccagggactggctgggggctcggctccatgtcaycctctctctggcattcaggctgacagagtggccactttgcagaacagcggcagtggttgtgcagaggaagatggcataccacactacacacaggctcttgaagctttcacatgaaagtggcatgcaggccaggtgcaatggctcctgcttgtaatcccagcgctttggcaggccacagcaggaggttcacttgagcttaagagttcaagaccagtctgggcaacatagtgagacccccatcwttataaaaattttaaaaatttaaccgggcatggtggtgcacacctgtggtcctagaaacttgggaggggctgaggtgggaggaccacttgagcccaggaggtcagggctgcagtgagctatgatcacatctctgcattccggcctaggtaactgagtgagactctgtctccaaaaaaagcaaagaaagtggcttggagcacttcggattctgtttcataggccaggtaagtcacagggccactcgtaaatccaacaggggaagacagtgcagtccttctgtgtggccagaaggagaactagaagtatcagttgacagcactaaggaccaccacttttgtagcaggagaagggggtcgtctggagtgggagagggtgagaaagaaacatcagccagattcggaagctcctttatgctatgttctagggggattttattgttttgttttgttttgttttgagacagagtcttgccttgttatctaggctggagtgcagtggtgtgatctcagctcactgcaacctctaccgtcctggttcaggcagtctcttgagtakctgggattacaggcacacaccactatgtccggctaaattttgctgggcatggtggctcacgcctgtaatcccagcactttgggaggccaaggtgggtggatcatgtgaagtcaggagttcaagaccagcctggccaacatggtgaaaccctgtctttactaaaaatacaaaatgagccgggcgtgatggcacatccctgtaatcccagctactaaggaggctgaagcaggagaatcgcttgaaccgaggaggtggaggttgcagtgagccaagatcgtgccattgcactccagcctgggcaacgagagtgaaactcagtctcaaataaataaataaattttgtagttttagtagagatgggatttcaccacattggccaggctggtcttgaactcctgacctcaggtgatccacccgccttgagctcccaacatgctgggattacagacatgagccaccacacctggccctcctcttattacaaggataccccaaggctggacggaatgcctgccctaatccaccataacctcattttaactaattacatccgaaaagacacattctgagattctgggtagacgtgaatttggggaggaccctagtcaacctagtacagaaagtgataatgtatttttgatggggtttcaccaagttgcccaggtgggtcttgaacgcctgacctcaagtgatctccctgcctcggcctcccaaagtactgagattacaggcatgagccactagwttttttactgtatctagcaagggccattgcaggatatcaagtmtgggaatgacacagtttctcatttcagaaccattgaattggatacagcctgagtagtattcattcaytttttccacaagcatttgggtggtgacagaaggcggcagacaaagtccccccatcacatttggcaaagagggttgcggggattcattaatcaacgagctaaacaaatgaatttgtaatgtttcagatggtgataagttgcaagagtaaaaataaagatgggataacaggagctgacagcctgttagagaaagccagaagtgttaaggtgtgaggagcgaatgggctagacagctacaaaggcgacagaagcaacataactgagtgagcttctagaattacaagagggtccctgagataaaatctatagcaacgcctagggcaggaggctttgataaacatgatttgcatctgagtttggagttggaatagctcttttgaagcactctgtccccatggacatagatgtaacaccaaccctttccaggagagtgggtaacagacaagccactcagccggttttattaagatggaaattttcacaagggctaaaataaagattcaagtcaatggaagcygcctttttaattgataagagcagctcagcagtaaaggaaataggagatgcttgatgcctgtgtcgttctagtgttggggaattatatggaacactcaaagcagacctccccatcagctcagagacaattgatggtctgtgcatgtccttgtgaggctttctgtggggtaggatgagattagaagcaaagttgcctcttttactcttctggtttcattcttcactctggcagtcagcacaattcacaggtgtatcagccgaggaagcatctcacaaactctattctctcttacttccatgccattttggcaccgtgaacttgaaatcactggtggtgttctctttaccctgctggaatcacagacactgcaagttgaaagtcacccagaggcgatctgatgttttccttcctctacagggargagaagtctcttctgcttttcacagcaggtgtcattcaacctacacacatgtgctgaaccacaggagcttgtggtctctcgaggcaggaccacccccsgcaaccccatggtcaagcagcccctgcagtagccttgttcttccccaagacccatcacccgtcctagctgggagccacgtgacgttacgctgtttccgtttaagcatgaagtcattcaaaagttggaaggtagcacgctcccattttagaactgttgtgccaaaccctattaacctcagtaaggaagacaccaggttcaagaggctgaagaagagacccagagccagcaaaggaggcatggggttttattaggggcttacatccaggcragagagtctagcggcaataagctggacattagaaccgccttatatacagaaacagtccagcaacagagggctggataagatttcaccttcctatgatccactgtcagcaggctagatgacatamrcacacagyctagtggcagtgggctgggkaggaaaactgcaaacatcatgcaatttatataacattttcccttaacacastccccctaatgacctccacctggcaacyttcatcaacccaaaactcagggcctcaatgtgtacagctcatgtcccatggaatgaaacggagtsgggggctcagatgtttatcatagacaaggaacaaatctcctggtcgacctctcctggattccctagtttggaacacacattcaggtgcatctgccatcctgggtcatcccaagggtatgcttaagtcactgttatcagrtgcatttaccctacaggaacaccttcacatcatgttagcccaattcctttctttctttgtatcattgcttccctttaaatctaaaaagaagattaagtcttccatgccaagccaagcccaattactacaaycagtctttatatggcagtaccccaccatctagactgccgactaacttctctcctcctgatagtctctgctttatgtattttccttaaaaaccacaggaaccagctggatccaggactccagccacaatccaagggccagagtagagggttctaaaatttctccataaaatttacttctcgatacaagaaagcaatataagccataatggctgacattccagaaaaacactcttaccaagccccggctctcagtaaactcaaacgcatctctctgctcaaacgttttgtggttccaagagaaaacaaatacaccgtgcacatttttctttctttaaagattggaaagaaatgaagaaaagacttgtcttgtccatgtttttatagaaaaatataaagcatgtctcctctgtgacagatttcttttcctgtaaatccagcaagcccatgaaagagcttatgtgtgagcggatgtcacacattcatcttccccagccactttgctgcgtttctgaaaagataacatagatgcctggagtgcagacatcttgagatttaggagctggcsccttacagctctttgtgaattgagcctagaaaacgtgtctgtttttagctgaccccaagaacagaactggcaaccgcttcgtgcagaggagtcttcctccacggagttggttctcaagaaactgacgctgaaactttctttgggcacgagacacctgtgtgcttctcatatttggacccaatgctgttccttctgccctctgctgtctgtgtcgttcctggctgcagaacacagcccccaagcagagatgctgagtcctcaggacccaacccaccacacaccggctgtgtaaccctgagccagtcacttctgttctcccactaaccaaacaaggacaataatggagtcttcctggggtccgatgtgcacactggtactcagcacagtaccctgggcagcataaacagtccgtttgacagggtgaatcaaggctttctgtcatgaggctttctgtgaggtaggatgaggttagaagcaaagttgcctctttttctcctctggttccattcttcactctggcagtcagcacagttcacaggtgtatcagctgaggaagcatctcacaaactgtcttctctcttgcttccatgcccttttggcaccgtgaacttgaaatcactggcatgatgagatcaagtcctattccttggaccttgtccatgtgatctgatttggaagaagagtctttgcagttgtgatttattgaagggtctggggatgagagtactgtggattatccaggtgggccckgaatgccatcacaggtgttcttagaagaaagaggcaacaggagagaacacaggtgcacagaagcacaggcaaggtgaaggcagggcagagagagatgtggccgccagccaaagaatgtagatagctaccaaagctgcatatggtaaggaagagacctcccctagagtgtccagggagcacagccccgcccacaccttgacttctgacctgaagccttcagaactgtgagagaccaaatatccgaaatcctaagccacccagttcgtggtatttgttacagcatccccaggaaatagatttagtgagtgaagggtgagccatttgcattagcagaacacagaactgaggagacagaaacccagccacacttgwgtgaggcgtagggcaaatctttcctagataataactcaaatcattcagactgctgcctctctgcctctccctttctgtctcttttcaccgcctctccttcccttctttgttcttgatgaagttgagctgcctataaatcatcgtcctgtgtaaagtttttaaaattttattttaagttctgggatacgtgtgcagaatgtgcaggtttcttacataggtaaacgtgtgccatggtggtttgctgaacctatcaacccatcacctaggcattaagccctgcacgcattagcccagtgtaaactttgatctccctttggatgccagctgattctttcttccattgcccgtgggtttctgattgcccaccattgctaaagcgagttgtataggctgcaggaacaggtgcacaggactctacggctttccctggtatatcttttctctgctgaggtcagacttttagatggcaatactttttagttttgctgggccagatgtgtttccaggaggtggaattcagcagaagcagaaagttcaaggccgtggaagatagcagttcaagtggcagctgctaagggcttttcaactcagtgttttttcagcttgacttgcaaatagagcctgaaagttcccaactcttaaaaatgttcagtgtgtccagtcttatagcaggaggaagaatttgaagatggccagygttgctgtttctcaggccctaatatttctttgtgctcagtgaacgggcaagttatcctgaggaagaaaatatttcagaggcttcrgtgctaagtattaatcaaataggtcgggggtcgagcaggccttccacagtcattcatacaggaaaaacatattgaggctggccccaccctatatctcagcggggaataactaaagctattcaagagtcaccttacatccacggtgagccacatttcctgataccagatgctttcagggcaaccttgatcatgggtttttgtctattgcatcttcatgctgcaagaaaattctgtgtgtaagcatctytgtctcccagcaaaatgtggccagtggaaggtccacatgaggccttttcagtctggcatccacagcactagcacagggcctgccacaaaataggcccccataaagactggggttgaataaaatgcattgtttgcaacacgtaggcatgatttcttctttcctgcggtgggggatgggactgacccatcaaagcacatctcatatttgaaatgtatgagattcttggatagtgcaaaatacaatgtgtgcrttacacactgaggaggctgctgcagtttctccaaacccctacaggctgggagacttttaagagacccttagagagtgtcacctttgttwatgcagttttcataaatttcttttacttggccgtagtctctgggtgatacttgttgtaacaggcaactattacagtacaagatatcctgcttcagatctgtgcagctctcctgggctcttagttggagtgaatcaaagcccctgcacacacatacacctgtgtgcacactctcgctttgacattcacctatccctctacttcccacctccagaaccctctgctgctggtgtttttctgtgtgtttgttttagatttttgctttttttagagaaaggtgtctcaccatgttgcccaggctagtctcgaactcctgagctcaaacaatccttccgcctcagtctcccaaactgctgggattacagatgtgagcactacacccagccaatctctgctgcttcttgctcatggcaccatccctttggctatcaaaaggtagctctcctggccatccctttgcataggccatagtggaagcttataatttgatcttggttttttcctttagctttgtcctttctgaaattcttcattttagcctagattcctcttataatagagcataacattccagcagtgctcaaggatgattcattgcctcaaagttgccacctctgaaagagtgtaatatgtccaccctactcattggcaggagggagaatctgattcttctaccccttctgctgctccaaatgataatagcagccaccacaaccacaggctcagcagataacacgcctagcccagagctgcacgtcctctgcctctcatttgcccaccacagatacccaataaaatagacaccgctagtatgagcttccttttgtggctgtgatgaattgctacatatttatggtttaaaatgtgcaagtttatctttttacacttgggtcagaagtccaaaatcggtctcattgggttaaagtcaaggtgtaggcaaggctggttccttccagaggctccaggggagaatccactttcttgatttttccagcttctcgggtcacctgcactccttggctcctgacgccttccttggtcttcaaagccagcagtgtggcgtctccagatatctttctttgacttctgcttccctgttcacatctccttctctgactcccatgtctctctcttacaaggaccttgttgggcccacccagataatctaggataagcccctcatctcaagatctttaatgacattgactaagtttcttttaccctgtaagataacatggtaagatattcacagttgttggggattaggatataggaatgtttgggaccattatttttctaaccaccctttttttttttttttttttgagacgtagttttactctgtcacccaggctggagtgcagtggtatgatctcagctcactgcaacctccaccctccgggttcaaatgattctccttcctcagcctcctgagtagctaggactacaggtgsctgccacagcgcccggctaattttttgtatttttagtacagatagggttttaccatcttggccaggctggtcttgaacttctgacctcgtgatccacccgcctcggcctcccaaagtgctgggattacaggcgtgagccacctcgcctggcctttctaaccacacttttatgcctgcctttgtaactgtgaagcgacttttgcagctcagagaggctgccccatgtgtccagcctccccagtgagtaaactgaaggcagggtttgaagcaggcaggatttgatcttggaacctgggctctaaaccactactacaccatatgctcacccgagcagtgcctaaatacccagcttcttagccaggctctcagcaacttgcaaggaagagtcatattttaattacctcttgagtctcatcgagcacatggaggagaccttgggatattgttgaggcttaatattgagttaaaatggtgattgtctcccttgtacaaatctacttctatttagacaacctaaggttactttggttttaaaaaatatcatttcacactaaccttgctttcattgaagacttctcttctgcttctttatcaaamgtggtgcttctgggccatgcctctcccgtcttttgataacaacaatattctcagagaacacagtrtcctgggctgaatgttacatgtagtcactcacttaatccatgcaccaaccccatcaggtgaaaaccattactgtccccacttagtaccgttatacctcaggctcactgttgtccagagtggagcagctgttcagtggcagagctgggactgaaactggggactctgtctcctgtgggcatgctgctaaccctctgagtattgtgagtctggatgggaggccagtggggatttatgttagacggtgccctgtggttgcaacaaatgaaaaccaacccagactttctttaacaaaggggaattgatgaatagatctctcccctaacaagaggctggagatrtgagactggggagagcaggagccatgatgactctggagccctgaggtcggccccgggagctggcttgtagcagaggcagtggagtcagggcaccgccgctcaggggcgggactcacaaccccagatccgagggagcatctagtgcagctctcttaagttgtgtccattggcccttggggtgtggggagcaggtgcctttggtctctcttctgccaggttgtttctaagagaagaacattgcaatctggaaaagcagtattattgtagggtagaaatgaacacatggggaagagcatttaaaaccaaaaatgaaacagattattcatacagagtgtgccagaagctactggatcgaatctccttttgctccttaaatatttattgagcacctactgtgtggctggccctgtttcattcagaggatacgagggtgaatcaaatgtgcattgttaagttttatggatctaagttatcccttgagtggtggcctgatggcttggaagaggtaatacatctgtcagttctgacatccacggtggagagaaatgaatcctgccaaatggaaatgactctccagttccatgggggcacaggtggcctggaaaaagctaccccagtctgtgagcccagacagtccagaaggccccctcttagatstcaatcccagcacatttaatttcagttttgtgtgaccctaatagagatccttcatcaagttttattcttcataaaagatccatttccatagactcataaagcaactccttctaattcagtgttattttatacatactttcattgctcgcatcaatcacaggcagccgacttcccagccatgaaacaacagcttgcaacatcaccatgttacccaatatgtatttacttatcaagttggagaacacatgtttgcaaaatcagcaacattacagctttactagcaatttgctagcactttcttcccgttgaacacggagtctgaattgtgtggtatttcactatcctggctcatttgtatcttgtaactgcagtagtcaccagcaccctgaaacctcctggagatccttgttgatcatacctggaacttcagccaggtcacttacctarcaggtgtggttctggagtcatcgatcatctgtcctgcactacaactcaaggatataggtcctatatgtccctcgggcttctggacctagcctaaagatgccccagacaagctgtaatgcagggcaaggtcctcaatagccactctgtagggagaattctggaaaattatcctacctgcaaaatgtaatgtgaaatatctgacatgagctgtgtggagctgagtagggaagtkgggagaataaaccacacttcctgggtttgcctctcgtctcagccacttaccagctagataactgaggtgatgggcaagcggctttacctccctgggcctcagcttccctstccataaaatgggctaatgacacctgcctcatagggtttgtgggatgattaaatgcttgcaatgccctgagtcatctgctatggtacgaaccctcataaaggttagctccccatcactcctgcaccaacttttgtattcattcaggattatgcttttgtgtgtccctctgagcccatactcagccacttgccagtagtgatgatggagtggttatttgacttccctgagcctgagtctctttcttttaaaatagagatgatctaattaccctggcagggctattagaagaactatttctggtgcacagtccacacatgtatctcctcctccatggaattactgcaaaggtctcctcctcagtgccccctatattttacctgcatctttaagccaactttacacagtcataggtgtcagcccattttacagataaggaaattgagcctctgtaaggttgtgtatgttgctcagatcatgtagccagtaagtaaggtgccagagtctccatctgttcagcttctatcattccaaggattccactctcaaggccccayaccaggccagtagaataaaaatctctgggggagagtctcagacatcaagagaattttaaaatatcttcaatgagcagccagggttgcaaggcatacccccaggccatgtttgctcaacctcattctcatgtacggcccacatctggtgggtcccaccagaaaaaacaagagggtgggggaaatttagcagaagtatttcattaaaaaggaggatgtagcttagaattcagcaaattaaagcagaagccaaggaaatagcagttctctggtgtccaaagcaaggtcaagagctgggagcccgaggaataaactgtgaagccagcacagatctcccagaacagggaacccagagcttagggctggagaaggcactcccagagaaggtccaagcctagagcagtgactgttygacttctgcccaggtacatcttgcttctcaccccatagggaaacaaccgctggaggagccaagtgttcagtgagccggtgcagttctggggccataatgatgaaaaggaaggcatgtgcattgttgcctgcgcagctgagtataggcactgaggccgagacactgagtgtccaggtgaccccctgtgtttcccaggccttccgccatctggctcctggctcttgaccacgactggctgcgtgatttgcagagcccrttgtaaaatgaaaactcagggtcccttgttcaacaacaattaagaatgtcaagagggtgacarcagagcactaaacccagcacagggactgtctgagcaaggggttctgtgcaactgtgcaggtcacacgttcatgaagtccacctgctcttgagcttgccttagacaccaggtctggccgctgaagtgcaggcaagagtgctgtgtgtcrtttctgactgaagcgttcaatgagtcagcatgtgagtttgcaactctctgccgctcctgcagcagtcaggaagctgcatgttcaaggtggcctggctataagatgcaagggtctggatccctaagctgccacttggagagaggatctgccccttgaagtgaacccccaaagtggactgaatttgagtgagaaattaactttatgtgctaagccactgaaatgatagggttggactgttatctcattctagcctagcctaatatagtctatgtggtttttgttgttgttgttactgtttttgagacagggtctctctctgtcacccaggctggagtgcagtggtgtgatctcggctccctgcagcctccgcctcccgtgttcaagcagttctcacacctcagcctccccagtaactaggattacagggacatgccaccacgtttggctaaatttgtttgcatttttagtagagaaagggtttcaccatgttggccaggttggtcttggactcctgacctcgggtgatccacccacctcggcctcccaaagtgatgggattacaggcatgagccaccatgcctggcctatggtctgtgtttttaaagagcaaattgctgcgcctttgcccttaaatagatataaatgatagcgacaataagcccattgttcagaattaacccaggagttcattaatatttagtgtcagttaagtatcaattatttacctgcttcctactccagctttatattaccttaagctgtaaacgaagaaaaatgataaaaactcatcttttatttattcacttattcatgtatttattcacttgtgcatttggcaaatgtttactagactcttaatacatgcaaagcattattctggtgcctttgaacattttcatatttgtcagatatagagcagcatccttgatctctacccactagatgccaatatcacatctcctgccccagttgtaacaaccaaaagtatccccaggcattgccaaatgttccctagaggggctaaaatacccctcattgaaaaccactgctgtaaaaaggactaggcttgccatttaaaaatctcttaaattggctgggcgcagtggctcacacctgtaatcccagcactttgagaggccaaggtgggcagatcactcgaggtcgggagtttgagaccagcctggccaacatggtaaaaccatatctctactaaaaatacaaaaattagcaaggcgtggtggcgcatgcctgcaatccaagctacttggaaggctgaggcatgagaatcacttgaacctgggggacagaggttgctgtgagcccagattacgccactgcactccagcctgcactccagtgacaaagcgagactgtctcaaaaaaaactcttaaattggttaaacaaacaaaaaaaaccacaccgtgtccttttgttgtttytaagggtttatggaaaaatatattggagagttacaaytacttcaggctaattcaatataaagagtatttttattattagtttggaatattaaagtttccacttaaaattgattttttgaartgttttcaggcaacatcatttaattcagcatagagtatcctatgtctttcaaaaagaacttcatgggaatggtagataaaaagattaagtggaatttttaaggggtgtaagaaaaatcttactgtcgaagtctggataaaaggaagaaattaggacagtaaaatgaatcatgatgggggaccccagttttggccatgtstcacctaatatgtcataaacagttcttcagcttcattaaagaatagcttaccagaaagaagggcagacactggaggctgaactgcagcgaatgaaaacctgaaataatcacaaggtggtcctgttgccatcatctctttatcagtataaarataaacaacctttgaaaacagatggagacagtcattgctcaacttgtcataacttattacatatttggctgtcaatttgtacttaaaaaaccaactagctccagggaggcaaagcaaagtggagaggagaagcgaagcctgttgcatttcarttcaagcctgtggtaatttcagctgcatggagacacttaggactgtttttaaatgaagtcagcaactgtcccaaaatttaaggcattctcattttaaagagcacagttgtgttcctatgggatggcacttcctcacctcaaacctgtatcaggagtatatatatctcgtgcccgtttagtcagtgctgctctcccacagggtgagatctctctgagccagatcattctcggacagatgatgaatttttctgttccaaacagggaggtgggaggargaagggcaaaatgtttcccatggatgtaccactttttaaagttgtaatctggagtactcatcaacaacatytaattcrtgcctttgggggaaagaatggctctaccaacagacaaggtcaaaagctggtgggcctcagaccgaagcttgccataacctcttttgtttggccttctagtcccactgagtgatcttttattttttaaatttgaactagtgtctaaaaatccaaattcccaccttttcttaaaaaatcaaaagatggctggacgcggtggctcayacctgtaatcccagcactttgggaggccgagtcgggtggatcacgaggtcaggagatcsagaccatcctgactaacatggtgaaacctcatctctactaaaaatataaaaaattagccaggcttggtggtcccagctgcttgaggcagaagaatggcatgaacccaagaggcggagcttgcagtgagccgagatcacgccactgcactccagcctgggcaacagagcaagactccgtctcaaaaaaaaaaaaaacatcaaaagatctggctagtccagacttgtatttcagacatgcagtaattcctttgagctaaaaggcagctgccgcctgaggcaggaggcacacgctccagtttgccaccaaccccacctctcccggttgccttgagagcgctttactcatgtgaagctacctgtatgggcactgggtgagtaggtgagcttctcactcctggcccagctcccagtctgaccacagagagtcccacctttgaggccagtggaactaggctcctgttagaggactgaccaaaggtcattagcatcttcatcaaaactcacattatcaagcactttctggatcaaatgcacagctggaccaccatatgaaaatgtgggaggggtccttgtgctggtgaataacaacccctggataactgggcaacccagggaagggccgccaaaggagcaagggttacaaagccaaatctcccagaccttgccttaggcctaagcctgcttccttcttctcttttccccaaaattgggctggaatcacctcttttctctgccactctgcagttccatcctcctaccctcagagtacaggggcagggatttctttaacagtcttcacacccagaactgagaaccaacctcccacctrgctggccagtagagtcttttgaagatgagaaaaaaaaaaaaaaaaagaaaaaaagaaaaagctgaatgatgagcagtggcctccaattggacatcccctcaaatgaaaataaagccagtccaaatgtaagccagtgggaaaatgagacattatttacaattcatcacatgggtagctttccaggaacgcatgccctgccaaacgtgggctgcctctggatccctatcaggttggttggttatctttcatcaactagtcattcgacagtttccctatcaattgctgtctactcaagaatgtccacaagaccagaggaagcggatgcatgcatatgtgcactcaacagaagtatctaggcttgtctaagggaagaaaggaattgtttcctaacaagattttaagtaactcctgtttctgtagatcctgagagtgagtcctagaagcagtrtgtcttaaaccctaagtggttgggtcccacaagctatttccctcgtcatgattgcactcagcagtgggtcctcacagaactgagttctaaattgtgagagtcaatgaaaataacaaacttacatttctcagctgggcgcggtggttcacacctgtaatcccagcactttgacgggcagatcacgagttcaggagatcgagaccatcctggctaacatggtgaaaccccatctctactaaaaatacaaaaaaattagccgggcgtagtggcagacrcctgtagtcccagctactcaggaggctgaggcaggagaatggcatgaacccgggaggcggagcttgcagtgagccaagattgcaccactgcactccagcctggtggactgagtgagactccgtctccaaaaaaaaaacttacatttctccattacttaccatcatcctggcattggactttatatagattaatttgtgcattctcaaagggggtaatattacttctaagcaagagaaagttggtcattaggagagaggggtttatcacatcagatgtattagatattacaatggcttgtgccctgcaaggggccatagcacataaatagatacacggtattctatagaattaacgttttgtgatggagtgagagggtgtcaagtcgaataaatgtctgaaaatattcttgggggaaggtgttaatggaaacacargaggctcagagagcattgattcactcaatgcctccaacaacccatgagagaagagccattttgtcaatgaaaagttgaggtggggcgtgatggctcacatctgtaatcccagcactttgggaggacaacgtgggcagatcgcttgactccaggggttcaagaccagcccaggcaacatgacaaaaccccatctctacaaaaattagccaggcatagtggtgcgcacctatagtcccagctaattgggaggctgaggtgggaggatcacttgagcctgggaggtcaaggctgcagtgagctgtgatcataccactgcgctccaacctaggtgacagagggagaccctgtctcaaacaacaacaacaaaatytggggcttaactgcccagagaagcccagcaggtgaggccaggttttaaaactagatagcccaggtcctcagccgggccactggcttgattctgctttggttttgcacaccagggtctctttctttgttactgaggacggttaggagasaactggctcatgtccacctgcttggtcaggaaacaattttagattggtgtgtttggggtggccagttgagtgaatggctgtaggctgtgtcccaggcactacagtcacatttgcaacaattctcacattggcagtctgctgctcatgacgaagagacgtgtctacayctgaaagcaaaacttggcctgcagggtgaccacctcattctggttkgcccaggagtgtcctggaatcccctcagtcctgggagaactatctggttctcatttggaaccaggaggccmcaaacccattcaaactaaagaatcttcaatggaaatttagtttccaatgagaatcgttccaactagatattccccaaaatgctagaatttaaaatagcagcttctacatctgtctcacctggctaagcaccctaagctgctgctggtctaaggcttgtcttctgacacaggggcaaacacacaagtaacgttgtgcactacaggatccatgaccacattctccttttgaagcaccactattagatcattcggtcacagaaagcatggtttgattggaattagaactcactgcctcctctggtgagtttgatgcttgacaaygatgtgccattttgtcacatcaaagaggttcacctggtgacatctgccatctctgctcatgtttgctttaacatcacacttctccctggaaagcacactgttgccctaactgtgctatcagaaatccagtgctgaatatagatctgaatgtctatgtctcaatacgtgattcgcttataggaatagcattttgtaaaaaatgagcctgacactttttgatcaggcaaaggaaatgtttagggatggagtcaaagaaatgttaagaacagcataattttgtcactgtcttttggagcatccccatcctcatggccagctgaaaaccccccgtcactctcagatctgcgctctcctttctcaaggggttggycgtgcttgaagtcacaggaaagcaaaacttcaaagctggctttcaaggtcaagaaaccaggcggcacttgctttaatgagagagctgcagtcaggaggaaggggctacctggccacaaggaagcgatcacacttgttaatcagcctgtcaggctggcggccgtgtccttcggcaaaagaaaatgacggcccaacttgagactttcaaccaggaacctgggatgttttyttccccctttggaggagctgctgctagttcatctggctcagggagtgacagggtgattataatttattttgtcactcaggagagtattgtgacgggggaaaagacagaaatgtactgtgtggaagccccaatgcgtgtctgtcatataattaccctttctctgctgtctggaaacacaagacaagcccggataggaagctgcatgagctggtgaaaacaaagtggtggwcatggagtccagtgtgtgggactgcataagaggagaggcacaggcatcacccacaggcaattggagcaggtgcactgaggcccacctgctgcatgtcagccctgggcatagcattggtatgtgacccaggaatcccattccagcaaggacctccaaggcgcattgaacagggagctcagaggcagtcgtggaaaatctccaggcacgttgctcagttgttcattcttcttggaagacaaggtactggtggctctggtcagtgtggaatgaggcaacactacagtgaatggcaagaagccaattcaacccaaagaacactgatgaggacctaccgcgtgtcagacactgggcttacaaaatgaacacaacagtctataccctccaagagctcacatctaggaccatgtggcccatcacaaaaagatagacagttctgaaataaagaggttccatcaacagcaaagtttggtgagtgctgcagagagacaccctctcttggagattgatgctgtaagcgtgcttaatagaggcactgaagagtcctctggggaaaccttgctttgcggtgtttgccacgtatttcccaaatctgtttctcgactgaatctatggagccagagttcctcggaaccaatttagagaatgctggtttaggaggtttatccagcctttgcagaacacagaagtaaggaaaccatgatccagcctccaggggaaggtactggcaagagccaagcattgcactcagcagataggttggggttcaaagtaaagcctggtcttagaggccractagaggaccacgtggagacatggtgtagactacagaatgtgtgtgtgcacgtgtgtgtgtgttgttgtgatatccacagtagaaacccagatctgcacactaagaccatgggcagggtgggagaagggacccggtgagagagagggctgtcctgcraccctttrtcccacattytttggacaacttaatcctagtctcctgtatctgaggcctttgcctgcactgccataattggctcagaacccaggacagagttggataatgcaaggcttcctctctgaacactaatgtactaggcactgtaccaagttctgaaaataggtcatcccatgaaatcctcacaacaaccaaaggggaatgttgaaaacagggaaaccgaggctcagagagagatgaataatgtggccacggtcacgcagcttgaaaagacttgaacccagataygtcacctcagagtcgttgtcttcaatgctgcaaacctatttacataactcaggcacaatgcggttccytcagaggcgcgatttcctccagagtaaatccagtgatgcattcgtgtctgggtgaagacaaacacggggcttaagaccgagttcacctgttccctaacaatccattaaaataaaaaccattttctgtgtatgcttgggaatattccagsataattttgtgttacatcatgttatccaacctgtaaacaaaaagatatcctcagtgaatttcctgatgaaaactaaagactcatcaacctgaaaggtctttttttttttttcttcctctaatcattttaatgcatatgtcagttgcaagccatgatgacttcatttttataccttccatgacttcaattaaaggcagattaaatagggcacaaatccaatcaatcgagcattcattagacattaactaagtgcaaggccctgggtcaagtgtacttaactggagactggtgtggaattgatggggttaaggcctcctcctatgtctttggccacatggagctccctttagcatgtccctgggtaagatcgcaggcctgaaatctgcctctgatttctgatggggatatcctyaagtttgcctagatcaggaagtttaatatgtgtcacatttcacatcagtttccatagactgtgagtggctgcctagaccactgttggataacactaattctgtagcatgtcaatgggagacagagtcatgctgttcctgctgtcttccagagacaggggggctgcatgggccaagaatgttcttttctgaagctgaaccttgaagcttgccctgagaccatctcacagggcaaagaagctaggtggataggaagtgcaccttgaagcatgtggccggatggcaccattggtgaaaatagctgagactgcctaacaaatcaatccaacctygagggtggccagatcttcgttgtttatctgatcaatcaggcctaatgactgatactctgattccagtggtgggggaaaaaaaactggctttgatgattagagaagcattgctatggaaggaaaaggaattctgggtggtggtaaaaccagatgaattctatctttcctttaggcttcagtgttttctttgtatgactattcctgctgctttgttgaatagacatctgcggctttgatctcttcyggttaggtcacactttgtgagtccagacagattcaaaatcagaagatgggccttatatttgtagaagactatattgggataaaaagttatggttaggcaggatgccctaatccaaatgtgrtagcaatacaattgctattgtcartcatcaaaaccagcaggcatgtttttgttggtgcttataattatgctctttgtaaattaaattttaattgccaaagcaatacattcaccttgtaaaaataaacaaaatgttatagatgaggccaacatctttcccgatgaccatgccaaatcccaatcccctctcttcttctccagatttaaccaccattaccagggagaagttctccttatagasttgttctatgcacttataaactgtacctgtaaaacatgtgaataaagtattgtggcatgttctgtgtgtaagcatgttcacaaaaatgrtatcactatccccctgtgggtaaggaaagttaaaacgtgccacatttcacatcagtttctgtatacttcaagttgytacctagaccactgtttgagaacgctgattccatgacaaggtcaatgggaaacagaaccatgttgttcctgctgccatccaaaggcaagggggctgcatgggccaggaatgttctcttctggtgctgaaccccaaacattcctcaacctaacatttttactaattaatatatcttgaagagtttcccacattagaacccattagatctacagtctttttaagctgctgcaaaatatctcagtgtgagaatactatcattttggcaattcccctgttgatgaacagctaggctgtttccaaatttttcaccttgacagataattcagctagaaatttatttgcacagatcccttgcggacacgtgcagttgtttctgaaagtagatgccaaggaggcgaaggcattgtttttactctttgctgcccartggtccttgacaatggayataccagtttccctttatatcagctgcatgggagggagacccattwtctgacacccttatcaatcattgacataatccaacactccacatgcttgttatagaatcaggtcctatttgtatgactcttgcttgtttgtgagtgaacccaaccatgttaccctcattttatattggaagtccctaaaataacacggctgctacatagtaggtacacattagtgtttgctctcattccctttaactggaatgcctttttgctctgaggtccctttgacttgttcctgcctactctcttcttacgggtcctcatcagacacctttgtgcaaaccccagactagataaggttgttcatctctrtattcataatgccctctctcagtgtgcctgataagtcttattgtttgttatatatttatctcttctactgatttctgagctcctgcacacccaggagcatgcctctttgtactcctgtttccccaacacgcagcccaggcacatggagttggcattgaatcagagctttaaaaatgaaggccatggctagatggaatcttgtaatcccagcacccttggaggccgaggcaggtggatcagctgaggtcaggagttcaagacaagcctggctaaaatggttaaaccccatttataccaaaaatacaaatattaactgggcgtgatgacacacaactgtaatcccagctacttaggaggctgaggcaggagaatcacttgaacctgggaggcggaggttgcagtaagccaagatcacgccgctgcactccggcttgggtgacagagcgagactctgtctaaaaaaatgaatgtccctgtcacaaagccacatccacagtggaatgaaagcccctgaaaataaacagtgtatcaccagagggaaaaattaagcagtcactctgctgaacagcaaagatgttttcttctttatttcaggtcttttcatggaatgaaacagagagggaaaggaggaagaaaagctgaaacatagcaaagcttgggaaatacttttcttttttaatttggaaagtgatgggcacactgctgcactgctattgcccaggtggggaaggggctctggccgttgttgacccattgataaccattccgtgcctttctgtcttgccccgrtaggcaccacagtgatgcggatgacagcctttgatgcagatgacccagccaccgataatgccctcctgcggtataatatccgtcarcagacgcctgacaagccatctcccaacatgttctacatcgatcctgagaaaggagacattgtcactgttgtgtcacctgcgctgctggaccgagaggtgagctgaaaagaatacactttctttttcacgagaayagaatgtggctttcatgcaagggatgatgtggggctccagtcartggtttwttttaatactgtaaaggcagaaatgaggtgtttaccatgttttggtggggaaaatctataaagggaaatgggatattatgtgacccaagaaaasacgtgctctaaaaggctaaagcgcctggaactgtttgtattcactcaacctgatgcctatttcctcaacagccacttattctctaggccctggtgattctagactctgcctctggcccctgctttaatgctagaagggagagggaaggacaagggaaggaggggaagggaggagaggtggcttcatccaagatcacacaggctgtccttgttgcagagtcaaatgcccatgactcctttctccaaccctttgctgcaggcatcctgcattcccccttgaacccctctcttcctccatctctgttctcatccctttaggctttctccgtgaaatctcccccgtctcctgggtcacatgtcacaaacaggtgacccctggcccagtcagtccacatgcctgctctttcgttttgcctgcagtgttttacagcttttagaattagttgtcatatcaaaatatttagatttcacgtttctgttttaaaaatgccaatttccagtttttctggacatcagaaatcctggagacatcaggtccactttccacatgtgcactatcggtggtgtgaggygtgatgctccagtggatccagggtckgctgtcccctttagatgggacatgtgctcccacctcgattacgtttccacgtgcatgggcccctctggtcctgccctttcctgagtttgaggtccaccstgtagcttaccataagctactttaagtagaagaccctcgcggacctccaaacacagcatccttaaaccaactcgtggattcctacccatccttcactctccatccaccctaaacctgctaccattctggaattccctgctcctgacatcatcccacaggcgtggggccttggagttgtccttgaccttctgtaagaaccatcagctccacgtaactgctgggcttccctcrggggctctgtgcatttccccctcagtgtttttgatgaaataaatccatggttcggagtgttgtttcctctgcyttctcctctcttatgtgctatagtttctcaagagattctggattacatcaaccccttctaagaagctgtcctcatccacctgattcttccacagtcttgttcttcctcccatctctgactactcttgcctgtagccatcatatagcagttggcatgtgctaattaggttgtcatttgtctctgaagaagattctctttctcttggtctagacctgaattgtccagtagagtaaccactagtcacatggggttattgcaattttaaagtatattaattgaaatcaagatgtaaaaatcagcttcacagtcacagacacatctcaagtgctcagcagtcatatgtggttggtggctattgtaccggacagtgcagacctagaacacttccatcaccccagaaggttctactgggcaacaatggcctagactgtatgtttcctgacaacagagactgtggtcatatgcatgtttatatttctactgcctagcatggttgaagtacttctaaaaatcctaattatrtgtttgttggcatagagggaaaaaaaggaaaaagagttggaaataaaactaagatcttacataagctgtgagaaacagaagctagaaataggtaattattgaaagggagagacagagaaatttgcattgaaactctgattgtcctttggaaaatgtaatcgtttctagttaaagaatagggaagtagaaaaagtaatgagtccattatattcatttcatctcccattctctttccaaccctccctatttttttatttttttattttttttattttattttatgagacagagtcttgctctgtcrcccaggttggagtgcagtggcacgatctcagctcactgcaacctccacttcccaggttgaagcaattctcctgtctcagcctcctgagtagctgggaatacaggcgcctgccaccacacctggctaatttttatatttttagtagagatggggtttcactatattggtcaggcttgtcccaaactcctgaccttaggtgatctgcccacctcggcctcccagtgtgctgggattacagggatgagccactgcgcccggccaatgctccctatttttatgactgacatattttcttcttttggaggccagtgatgacttcccaaggctctctattccccacttgacacgtgtgtgcaggtgcacacacacatgccagcttttctatagtccttaatgctcccaaagcttctcacaagatcctttcacaagaaaaagatgaagcatggtgatttctccgtttcagcttctctttgttctgagagaaaatattttataagtctctatttataaatcaaagtgataatgtagtaaattatcccatttttaaagtttattttaggggacaaatgtgtttccagctcatgatcttttcatttgggctttcattaagttgtaataagtatgtaattatggaagttgaattaagcatttctagtcacaaaacatcaacagccccccaaaaaagatcaactcaatttaaccgaaattggaaaatcaatgaaaatgaataaagagtgtcactcttctgtgagggtttccagagttcattgctgatccaggcaacatcagtgcaatccaaaggaaagaaatgtccctaaatttaggcaagctttggctagttccttgtgctgtgataagcttcacttcagcatgtttgctgaggaggtggaacgtgattccaagttcttgtctttgagggtaaaaaacttgcacatcagatgtccagtggagttccccagagtttgcaatgttttcctcccattgagacttggcactttttgtaggattcacatggatgcgatactttcttcagcaggtttgtgagattttattattaatattatttctgaagaccttctgagaaggcctgtcttaggtgtggttttaaagtctacttctcagccagatgggcagaaaaaacatttaatacagacttttgcagcattcatttaagaaagtatcccatttgggaccctgtggactttgagatgattcaagttgattttaaggtttgttaccttgtctcctgtcttcattcgcagtatctcaaattgcktgttggaacaatgaatatagtgattccagttctgtcacaaactccttcaagagcaggagctgcagaaaccacacacacacacacacacacacacacacacacasacacacarctcaccagcacctctggctctcacctgaatgagggacaaagcaaacgtgtgtttcctggcttgttgggagtggatactctggaatcccattgggtgacacgagctaagttgacacaataacaatttttcatctttattttccatttagtcaatttcctttcttaagtgcatctaccaaggaggaccccagcaggaagtgtttaaccaagggagaggcagatgatgcaagatgagtggggaggtggcaggcactgggaattttctgtgaatctgcctacctaatcatcttccctgccttttatagattcactttgtaacaaggcttgtaactgaggatagtcacacagggcagtgtagaaatgatccttactatgttgtcactttggttgttatcctttcttcttcscaccctcctcccttcccaggatgtctcacatggagccatctgaggcaggtgcactcatctaatctgctcctctcctgctccaaggattggcagccactattcttgaaagagtctatggcctatctgcytgcactcaccatagtcaatgctcaaacatgcaatttgtgggatgatgtttggcttgcccatgacctattgccagtacctagcacatgagagatgctcaaagaaatatctgttgagagttgaaaggcgggaaggaagtgaggaagacagcgtgattcacactggcttgaaagcaggtgaactggccatttcttccccttccatatcttaagctccgcattaatagatatcaagtttccccaagacatgtgcgttttccattacacgctcatccatttacttgttckgaaaaccctaccagaacatacgcttctggaagaaagggaccttggatttctgttctctctctctattcccattgccaaatatagcaccagataaataataggcactggataaagatctgttaggttatcagggtggatgagtggatgacctgtgttccttaagtttgtattatctcagaacattctgcaggatccacattctggcatggatatataaacagaggaagttactttattataggtgaaagcttagtcttacccttgtgcaatcatctggtaatctaatttattcactttatgtttaccttctgcaggaactgctttaagaaatagtgtcttggtccactgggtgaataggatggacaggagtatctgtgcctcttgcttaagtgtttggggagatgtttgcggaaaataagagccatatattccagtaaatgaaattaggttcatttggggcacttttttattattttctatagccatacttagccccccatttctggcatctctgtctatgtttttaaactatgtctggctgcactacaaaataaaatcagataaaggtctctaacgtttgataaatgttttatttagttgatcatcttggctgctagactgaaattcatctgctggaatctgccagctttctgaacacagccacaatttgcaactactcagagtaactaatggtcagggttttttttttttttcttttttaatggaaatagtttccaaaatagactcataaaaaagcaatcttaacatttgcattgagaaagtatcattagtctttttaaggggtttgagctgagcacttttctgtctttgtttgaatttgcctttaccttattatctattatcttccagataatctagggaaagtgatagcctgcccgtgaaaatgtacatayaatacaagatattagggctgtgaatgtaatttgttttgtattttcagctggtaacgcactttctgaaactttataatgcccaaatttttaggccagatgtaaaaatggagakaatttctttctttctttccatggtaagtgttacataaggacttagtcttagatttatgtgcatttacttgctatgagatattcaagagtccttgaatatgtcagagaagaaaactgaagaatgttagggagaacatcctatgccatctagccaacgaatttggatgtgtagctgcaagcccaaagagaactatgtatttggtcaaaatgacccatgttaaaatattgtcacgtagcatgcatctccagaaacatactaaagacatctgtgaaaatgatgatatcaaatcaagctgccagaaaagaacaatggtaaaaaaaggatagcatttcctccagtgccttcaatgaaagatagaggtagtagtcatactcttaggaaaataaatgtttttaggcctttctgatttaatgctaatacttttctcattatcatcatgtttaaaacattggcagtaattacacacaattcaatcatgctgtcaggaatattatcttgctttgttttggtgggtgggaccagaatgattcagatagtagcatcctcacaatttcttsgagctatttactcataaatatttctgttggggtaattttccccattttttttatcacttgctgctgtgaaaattgagatggaaaaagtagatgtaaataaattgccttattatttttaaaataatgcattatcctttcaaatgaaacacagctaaccaccctatgctaattgcacttgctccgttgtttcagcaaataaagtagaataggacattcaaaaggcagaatgctaagtcctggggtctgaaatttagttccatgagtgcaggcctcctgctgatggcaatggggattggtgggagggttagagatggggaaggccagggtctttatcttgtggcctyatttgctcctccactctggataaattctagaagaagaccttgatgagtctcaggactccactggtaaccgtaaccacttcccccatccctctaagtgtgacctatcaatccattaaagctaagaccgtggctagtctcttagtatgaccgcaatttagttgaaacctggcttcagagaaatgggccaagggcatagmctacctgtgttttttgttgttgttgttgttgtttttggttttttgtttgtttgtcagttgtgagacctctctaaacctcgatttcttcatcygccacagtgagaataatcacaatcccaatctcattggcttattgaaaaaattcaaataagatgtgccaagtactagcgtgatacttatctataagcactctgtaaatattagttggtattagatgtttccatgattgacaatgagactgaagaagcagaaagaagttggagtttctcctacaggacgtacatttacactttgcccacacggcagagactatggcaagtttctttaaattgaatgaaagacagagctaatccagcctacaaaattcagcaataaaagctagtaaataagtattgagcaccacaaatgtctgctgaactcatggtgctggatatcaggacgcaaagattgagctgcctgcattggaggtaaagcagatatgtcgacagcacacgcatgcaaagatgtgctgttcaaaccgaaccttgatrgctgtgtggaaacctggagtgcggaagcagaaggaagggcatcgtggggaaaggagtggcatggacaaaggcatggcatattcacatgctacttaaagactccagagatgaggctgtggtatagagagataccagaaaagggcagggagtttgaacaagattgcaaaaggcttctaatgtcattcaaacgattatagctatatcctactgtaaatgggaaaccaccattatttaaacattaaacacagctctgttcaacacagcattcacagagctgtgacttggacagaaaatgagttaagctaaaggagagatcgtcagtggcaaagttcaggcgttttggagacaggttgagactgacaagttgrttctcgacatttctagcctgatggagagaagagctgaggagctaccacttgaatctaaattctgagcttgttaaatagattaataaacctcagtccrtaggtattttctttcttctgttcttgggcttcttaaagtatcagacaatcagtagttactgggcacatgttgaatcaagagacacttaactttatcatgaagaaagattcatctttttagatttaacaaatgtttaattctctaagatatttcttttctttttggtattttatatggtaaagataatttgcagagtgatgatgaatttagagtacttctcttttttgtcattttaaatttcttcattttattttatatgaagtaccctaaaaagctaaagaatgttttcatttttggaaaaagttcttttcgagagctgtttatttttctttatcagccaaaaagtatgattactatgttaatgcaggttttgcttcatcaagagattttccagttattgaacttaaataacattgttctaaaccccaartcctctaaattcctgttgtcagtgaaagaggtaccttctaatttggaaagaatatctagttcagttctgatttcaaaccagcagagaaaaataagaaaaatgttgctcctgccatatggagaatgaccatcatttaaggaaagaaaagttggttgagagtttttgggaagtaactgttttgtacttcctttaatgtactcagtgtccagagcaggaactgggtggttagaacagctgcaatatgattccactggaaagcagtttgcagagaggcaatcaaaagctgcaacacttagattaaggcaaactaatgatagaccatttcaagacatgatgacatctcaaaatgcctgggatccasatttctttcacttttgttttaagaggtatctcatttgctgtgccttttcataggataaaagcttgttgatcgtattatttagttgaacactttggggttctaaaagccgtgatcaaccttattggacatatggcactatgatgtcacattcaacaatgaaaggcacttcaagttataggatcakctattgcattggaggtcaggaaactttttttttaaagggccaaatagtaaatcgtatagactttcttggccaacaggcaaacttgaagatattattatcaacagaaagagtcaaactctataaaatttgaagagatttattacttcattctgaaccaaatatgagtgaccatggccactgactcagccctcaggagaccctgagaacatatgcccaaggtggtcgggccacaaataagttttatacattttagggggacataagccattaatcaatacttgtaaratgtacaatggttcggtctggaaaggcaggacaactggaggagggtgtgtttccaggttataggtggattcaaatattttgtttggcaattggttgaaagagtttaaagacctggaatcaatagaaaggaaatgtctagcttaagataaggggwtgtggagactgaggttcttactatgtagacgaagcctccaggtagcaggcttcagagagactagatggtaaatgtttcttstcagactttaaaaggtatcagactcttagttaattctctcttggatcaagaaaaaggcatgagaaggggaaaagggattttctacaaaatatagtttttttcccccataagagacagctttgcaggactatttcaagatagggcaaagaaacatatttggggttaaaatatttttatttccttccttatctgtcatgtgatgttattgccagagtcaggctggaaagtaagccacattatgtagggttaaatgaaagccctcttwtgagactttttggcttgtagagcatgattccccagatgtcttagataggaatttgggcaagtgaagaaaaaaggtcagagtttagtcctcattatgcaggtacttatataaccattaacagacaaacagagagcsaaatcatgagtgaactcccattcacaattgcttcaaagagaataaaatacctaggaatccaactgacaagggatgtgaaggacctcttcaaggagaactacaaaccactgctcaaggaaataaaagaggatacaaacaamtggaagaacattccatgctcatgggtaggaagaatcaatatcgtgaaaatggccatactgcccaaggtaatttacagattcagtgccatccccatcaagctaccaatgactttcttcacagaattggaaaaaactactttaaagtaagtatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaatcaattcaagatggattaaagacttaaacgttagacctaaaaaccataaaaaccctagaagaaaacctaggctttaccattcaggacataggcatgggcaaggacttcatgtctaaaacaccaaaagcaatggcaacaaaagacaaaattgacaaatgggatctaattaaacgaaagagcttctgcacagcaaaagaaactaccatcagagtgaacaggcgacctacaaaatggggaaaattttcgcaacatactcatctgacaaagggctaatatccagaatctacaatgaactcaaacaaatttacaagaaaaaaacaaacaaccccatcaaaaagtgggcgaaggacatgaacagacacttctcaaaagaagacgtttatgcagccaaaaaacacatgaaaaaatgctcatcatcactggccatcagagaaatgcaaatcaaaaccacaatgagataccatctcacaccagttagaatggcgatcattcaaatgtcaggaaacaacaggtgctggagaggatgtggagaaataggaacgcttttacactgttggtgggactgtaaagtagttcaaccattgtggaagtcagtgtggcrtttcctcagggatctagaactggaagtaccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcgtttgtagggacatggatgaaattggaagtcatcattctcagtaaactatcacaagaacaaaaaaccaaacaccgcatattctcgctcataggtgggaactgaacagtgaaatcacatggacacaggaaggggaatatcacactctggggactgttgtggggtggggggagggggaagggatagcattgggagaaatacataatgctagatgacgagttggtgggtgcagcgcaccagcatggcacatgtatacatatgtaactaacctgcacaatgtgcacatgtaccctaaaactttaataaaaaaaaaagtgaccattaaaaattataaaaagcattttaaagctcatgcgtcatcaaaacatagacagcaggctggatttgaccaacgggccatagttggccagcactggtctattagatcattggccacaatgctcagataggagcagttttatgtactgactgcagcatgttatcatatgtctatatctgaagtccactctcaaaatattaactcacacttattaatcatcaccttgaagtttgattatagggacagaaactaatcatgggtgatgggtctgatttcacattttgacagcatagttcatttctcccaccattaagaaacaggcaacctcagacagacacttggtaattaaatctagctcaaaatttggttacagtaatttttaaaaagcagtccaacagaaaaagagtaaacgaaaaagtgccatctagacattgactaaatattggagggaaccatcttggaatggctactttcattatgttagagccctgataggtgagaggagagggggcaaggggagacggagatgggaacagaagatttcccagatgaggggcrctccctggagctgagtcttggagccagatggacttgttcacaccagcatggastgaaataaggagaatcagaggacctgggctcataccctgtctctagaggctccaaaggagtccctgaggtaaaactgagattattctagagccacctggaaacaaaaagacactctggaccaggcttgggacattttcctgaaggtttcttccacctctcattgccctttctgtcattcctgaatttgagaatggggctgtgataacaaagaaactgaaagaacagtgtcaccatgtgtcttacatatcaccatgtgtcagtccctagaaaacgtactttatatggcatttgactttgataggaatctaatgaggtcagtaaagtgccctggttacagagatagagacctcaatgtcactaagatttaaacccctatcagcccatctccaaagcccatgcattttttctcccactatacaaatcaatattattgatatttatatgtgtgrtaagcttgcagaataaatagattttgaactttctttttaacacagaaaagcaaaatacagtgaagttttggtggaactttcattctcatcaggscataggcttcagtgccgcattatcatatgggccaggtgggctttttccaggttactgagcccagtggcttctatagctcggttttaggaggctatggagaacagactctctcctgcccttggggggaaatgcaaatcaatacwggtcatttgttgagtattttgtcaataagaatcaaatggctttttaaagtacccctagtgttttttgatgcagaartttcttgtgatcaaatacgtgtgcaaagatccagcaacaagggtttttgtyggatctttgtttaaagcaccaaatgaaatggccaaccagtgggggtttgttcaataaattatggtatattcctacactggtattctattaaatcatgtaaaatgatgtggcaaaatgtttaataatatagaaagatgttcaccatgtatcagcaggtggtttgcaaaatactccttaagctgtgatacttctttgtttatacacgtagagcatcttggtccaaggtacaaaaggatttgtgtgatgttttaggagtggtcctgttgggactatggttgattttaactttyccacagtgcagtgtctgagatgaccgtcttcagatctgggttgcttgagtctgaactttaacttcacctttcaccagccttgtgctagagaaacatcattagcttgaacaaccagtaaccataattatgatttgcatgtcataaaacattcttctctcatatcattgttaatgctccctgagaattcccttatcataatatggagaacaaatcccttttggttaaaactatgccttggtttcttcaactgtaaatcacagtaatgcctctctcaaagggctgtcatgaagagcaaatgaattaatacagcacatgcttaggagggtaatagctgagcatgagctattgctgttatctgtattttctagtttggrtgcagtggccacatgttatttttgtaatttagaaaaccaattctgttaatcttttttttttgagacgaagtctcgctattattgctcaagctgtagtgcaatggcacgatctcagctcactgcaatctccacctcccgggttcaagcaattcttctgcttcagcctcccaagtagctgggattacaggcgcctgccaccacgcgcagctaatttttgtatttttagtagagatggggtttcaccatgttggccaggctggtcttgaactcatgacttcaggcgatccgcccacctcggcctcccaaagccctgggattacaggtgtgagccactgcacccrgcccaattctgttaatcattttaaaaagcagttgtatcagtggtcgtaaggcaagagaaaggttaggatataacaccatgatgggtcaagcaacactatcacatttgacttcagacactagtttnnnnnnnnnnnnnnnnnnnnctccttttctttctctctccttctttcttttcctttcttcctttccttctctcttctttctctttcctctcctctttcctcccctctccctctcttcccttcttttcttcgtatttttatactacaaaaaaacaaccaaataatactctccacttcccttcctcccttctatcctcttctcctccctccgctctcatctccttcttccccccctacttgtgcgtctctttctgcctctcttcgcttctttgttctagttcttgtgagacacaaggccggagtgggttgctccccctcctcctttttctttgtcgtccttcgtttgcttcctctttctctctgtttttcccttcttttctttgtcttgttctcctcctctctttctcttcttttttgtctccttctctgtctcttttctctcctcgcgctgctctccttccttctccctcttcgtttcgtctgatctctgcttcgcgttctccgtctccttcttgctccttctctcttcgcctcttctcgtccttgttcctctctcccggctgtcgtcttcttgtcctctctctcactcctcgctctcctttctccgtcctctctctcctccttctcttctgcctctcccccccgctccctcgtctctgtcactccccccccccctcccccgctcctccggctgctctctctctcgctcccgccgctggccctgctcgctctctcgcctctctctctccctccctctccctctcccccttcccttcctctctcctccctcttcctctctcctctgctccccttctctcctcgcgctccctcctcatttgttgtgtttgttcttttgtcgttgtagtcaagttagctatgagtctgtctcttcattctgtcttgtctgtcgtctctcttccttctcttcgttttttctcttgcttctttgcttggtttgttgtgttttcttctttcctcgtgtctccgtcccccgtcctctgtctcggtgggggggcggcggcggcatgcggtggtaggcggaaggccgcagtcgtagggcgcgggcggtgtcgcggtcggggcgtcgtcggtgccccgtccccggtcgtgcgtgccgtgcgtcgtccccagtcgtgcctgcgtgtccggtcgtcctgcgtgtccctcctcctccctcctcctctttttttttttgagatggcgtctcactctgtcacccaggctggagtgcaatggcacgatcttggcttaccacaacctcagactcctggattcaagcaattgtcgcacctcagcctcctgagtagctgggattacaggaaaggcacccaccatcttgcccggctaatttttgttttatttttgtagagacggggtttcaccatgttggccaggctggtctcaaactcctgacctcaggcgatccacccgcctcggcctcccaaagtattgggattgcaggcataagccaccacaaccggcctagagactggtttctatatgagccagtttatttgttgaccaaacagagggagttgtgccaggaatcatggcctccgttaatatttttaagattgcaggggaagcattccaaatgttttcaaaggtgtgttaaggtaagtcttgtcaaaacattcccacttgaaataataagcattcttatttctttaagtgacagagacatagcaatggctttcctggctaaacgtgatcatcacagacacactgaccagctgtttawctttgcttccacaaattccaacaggcaacttaatagacattttgtggttatatgtttctaagacagccatgggaaatgaatttatttctacctttgtgaagaacagctatagaaatgaccattgaaattcagtgaatggcatttctgcttatgggccttaaaactgggaaccaaaattaaattcttttaggtattttctctcccgtgtcttctaaattgttgtgtgggctgatttttctccatgaaagactctcagagtcctaaattcaggttttctgtctccttgggctctagcattctggaataagcaagagtcaagagacttctccattcttatttcctctgcatgttagaatatctaataggtgtgagacagtttatgttgtgctcagcattggacagccaccatgtaaacaattacggcgttttttcatccaggcattacattaggtccataacactcacaggagctctgtaaggctgaaattgccacatccattctactaggasggttatggagttcccaagggctgacctgcctttcctgagtcacccactggagagccagggcattggatttgacctcatagccgctgctctatccactcccttgggctattaaagaaaagcacgggacatattgatggaaaaaatctgacagatgtctcaaggacaactttatcttttatcagactcatttcagggatttctgtattcattgctcctggacttttcacatatttggggagcttgattgagttyccctcagctcttccattagaaagcccatgtggtacagtgrctcagagcttgggcttaggaattcacaaatgtgaatctgtgaatctgagctctgcatcttattacttgtgtggccttgggcaagtcacctcacctacctgagcctaggtttctttggctgtaaaatggaactcatagcacggcctgtgtggaagacagaataatggctcctccccttcaaagaagtcctcatcctaattcccagaacttgtaaatatgttaccttacagggcaaatgggactttgtagaagtgattaagtcaaatatattgagattggaagattattctgaattatccagatgggcctgatayaatcacagggtcttaataagggggaggtgggaatggctgggttggagatttaaagatgctctagtgctggctttgaagatggagcaagggcccaccatgcaagggctgtggacagagcttctggcatctaaaacaaaaaaggaaaaaaaaaggcaaggagagaaattcagaaggattgcagctctgcccacaccttgattttagcccactgagacccactttggactcctgtcctgaagtgtaagagaataaagtcacatggttaagtcactaaggacatggcagtttgttacagcagcaataggaaatggatgtaaccttttttrtatggtttgtgggcttgaaagagatgacgtgttaaatacagtagcttttgaccttgaaagagacgatgtgtgaaatacattagttttgggggcttgaaagagatgacaggtgaagtacattaactcttgggcatgaaatacattagcttcatggccgttagcattggccatgaagagctcttgaccaatagtagctggtgttaccaataataaaataatggtgagacttgagatgacacaggagtgttctaacagaggcacagtccacttgaccagatctttctcaggcatctccatcgacagtgggrtctccctagaaggctgggtggctgccatcccacccaaccagcctgcctgagttggtaaaagtgcatgaaagtgttcctctcagggggtggccttccattggccctcacaagggcacagcggagctcgttggttatgcttcagttacataaatccagccttacaaaggctacacagrgagaggggctccttgcctcstagatstgtaccttgtaggtgctcaatacacattggtaagaatgttcacatcatcaggtaagcaaggggtataaagtgaggccttgaatcgctcacgtagattcaagtagtgttgagaaactaagaagtggtgaattgtacccttttttcccctcccaaattagaactcctaagaaatacaggacaactggagaccaaaccgtaggtttcattacctatgaagctgattaggaaagccttgagtttgtacccaaataaatttgctaatacttttacctaaattagagagattcggatggggtgggataacaacasgccacatctacctgggtggagcccatctcaggatgcctctgcccaggaggaggggcagtgagaaggaggccggaaggggaagagaaacaggagagggaaaggaggaaaggagacatagctagggagatgccactcagcaatcagaaacctccattccttttcctggggtggagtggaggaaaagggaaggggcagggaggctcctagcccacaagccacttttgtgcaataggaaaagatgcttgaccagtgacgatgagcttttttccaaatgttttttggccacagaagtgtcttgagaagtgtctgttcatatccttcrcctgctttttaatggggttgtttgttttttttcttgtaaatttgtttaagttccttgtaaattctagatataagacctttgccagatgggtagattgcaaaaattttctcccattctataggttgcctgttcattctgatgatagtttcttttgctgtgcagaagctctttagtttaattagatccccatagtcaattttggcttttgttgcaattgcttttggtgttttagttggggggtggggggcaagggaagggacagcattaggacaratgccsaatgcatgtggggcttaaaacctaaaatatgggttgatgggtgcagcaaaccaccatggcacatgtatacctatgtaacaaacctgcacagtctgcatatgtatcccagaagttaaggtaaaatttaaaaaaaggaaataaaagatgcccgttcctctgaatggacatagcccatgccaagggtaaggcttggtgagtggaacaggctggattttaatcctcaggttgctgcacccttggtgaagcacagggcactagagaagagtgttcacaacctccagcccctccacaaagaagcctgattctggaaagacagaggttccaacctcacccttacttctcttcygaagatctgctgtgcatgaagcattttggaggtatttcttsagctcagaacacagcaactttcctatgaaagagagcacaaagggttaatgccaccagaagacactcagcctgtccagtgtcgctaccactgggacgggcaatgggaggcatctgaggctttgctgacaacttcttctgctgtgagggtggaaagcaggccagatctttatgacctggactycacgttttgggattctagcaagatgggacccactccgggtgctgtgcccattctcagtgccagtggggctgatatggggtcatggcaggtagcgggagataacagcctcatcctcaacactagacatccagacagagtggctcaggccctgtaagcaactggtgttagggcagataatgagattttctggtgtctgcttggtgacaagagtagtggcttcaaggaatktttttaaaaaataacatttgtttatagttgtgttttttaaagtagaaaatatattcatacgagcaagtaattagtgtcctgccaggtaagtctcatggtgacatgtcaacgtaattattttttaaagtctgcctcaaataaagcatcaaaatttcctgctttaaatctcctttctctgtaaaaatggttaagaggagtgaaaagagaggatgggaggggtctgagagcattgatgcctcatcatagtcagccagctgtggcaccacctctgtctttgcctgtcactctcatacaaaggatgtgcataggaaatgtgatcctacccatcctcaaattctagatttggacttgaatttggtgctcttatttccacattaagttaaaatctagcctccagatccccaggcttcccctcccattgtacccagaagaaacaagaattgtttctcagttctaactgtcataatgcctagcgggcgttagcctacaacgaaggataattcaatstatcctcaccttagtgtacgctggacaacactaggactcagaagtgctttgctcttgatcttgaaaggccagtggaaatccatgcagattcctcccccaggaccctcccagccagcctgataatgaattcatgggaaacagcctacatgtgagcaccaaagggaacacatttagtaaactctgccaaaggagcacagttcttgtaaagctgatgaggtttgtgattaatccttttttttgktttttttttttttttttgagaaggagtttttgctcttgttgcccaggctggagtgcaatggtggaatctcggctcgccacaatctccacctcccaggttcaagcgattctcctgcctcagcctccggagtagctgggattacaggcatgcgcctccacgcccggctaattttttatttttagtagagacggtgtttctccatgttggttaggctggtcttgaactcctgacctcaggtgatccacctgccttggcctcccaaaatgcctaacccagtttaaagagatccaggaagcagattgtgagctgcagatatgatgtgattattaaaagcagcctccattgccaacattgcaaacgcatcagcatrttccttccttcaacattccataacgtggtggtggtattcccaccttaccccgggagaagctgagagtcacagggagyatttactttccaagttcacacattcagggmatgggtagaagtggaattcacacccaggtcagtgtaagaccaaagaggctgtcagaatggtttgctgttccactcatggcraacagsatttgaagttgttccagtccaagggagaccatcaggccatgcaggaataaaaaggccaaggggaggaaagaagatgctgtcttcattaaggcctgaaggaaaaggctggtcagagtgaagagtatagacaagctcctctgtatcctctcaaagatttggagccactgatctctctgggggttggggaatggggcagttcctgggaaagggacttattggtgggaatccagttctgctatgaatgctcctgactcctgcactcaaatcccaacagatgaaasggaggagagactgacagatgcagtgccttcctttatgtaacctccttgatccaaactacagtctgacccatgctttctggctttatattgtaccactacgttcctaactcaccctcgttccaatggcatcagcattttctcttccctcaaagataatgcacttctgacttttgcatattatggtagccagcccccaggagggctcccagtgattctcacctcatggtacccatgctcctgcgtggtcccctcccacatcgaataggaatgacttgtgtagccaaataggacatggcagaaatgactttgtgtgaattctgagccttgtttattcttgtcctttcttgctacaggcaaagccaaatgccgtgttgtagggaagctcaagtagcttcatggagaaatccacatggcaaggaactgaggccacctactaatagscagcatcaattctttagccgtatgtgtgagccaccttggaagtagaccttctagcccccatcaagcttttagataactgtagcctcaccaacatcctgactgaactacacagctgagcrgcttccatatctccaagccacaaacactgtgtgcaatcataaatgtttttagttgctttaaagcactaagtttggggtaattttattcagcattagataactaatacacatagtctgtttcaccagctaaaattgctgctcatttctctgttaccccccaaacctggtgtgagcagcccctcctctgtggactttttctggtcttctttgcatgactcaatccctctttcttcattttctcacacagattgtttagcattctattaatgccactgtcacaaggaaaagcaatayttttattacagtctctctcctctgtcrattctaggcttcttgagaaagtttgtaatgtatgcattcttcaaagaggtattgttattaatagaggctcagaagatggctgaatgaatgaagagtgtgtgttagaacctggggaaatttaaaccaaatacatttaaagccagtgacattttcaaagcatatttggctagaaagactaagttctttaaagtagtttagaagcagtattaatggtacacagtctttgtcccattcttaacagtacaataatgataattggttgctactctggaaacaaattaaagagcccaggaaacgtttccaaaggtgactggaatgcttaactgagctagactgttaatatctaatgctagccttcctgtgggcatagcaccctgaattgcctgatctcatctaatggcacatgctcagacatccttggttttaaataaaaattgtcttatcacttagtttaaaaatgttttgcttagtaaaaaatttatgagggcaggtgcggtggctcatgcttgtaatcccagcgctctggaaggccgaggcaggcagatcatgggctcaggagttcgatgccagcctggccaacatrgtaaaaccccgtctctactaaagatacaaaaattagcagtccgtggtggcgggcgcctgtaattccagctactcaggaggctgaagcaggagagtcgcttgaaaccgggaggcagagggtgcagtgagccgagatcgcgccactgcactccagcttgggcaacaagagcaacattcggtcaaaagaaagaaagagagaaagagaagaaggaaggaaggaaggaaagaaggaaggaaggaaggaaggaaggaaggaaggaaggaaggaaaaggaaggaagggagggagggaggaaggaaagggaaggggaggggannnnnnnnnnnnnnnnnnnngaaaggaaagggaagggaatacatttaataaatgtggagtctgccaaatcaggtcggcagtttacttctcctgtccccggttcaataactcacttactggggttctggaggatagcagtgagaagatggggtaaaaaattagagagaagttttgcgttrccccatggctgcttctgtagtgtagtccgtgcatccgcccttcgatgcttgggttggatcatagagcagtgactgttgatggctcacccagatccccaggaacccaccactcccatayaggctttcaacctgttaatccctgcagctgcctgcctggactttcctctgaccatgggagtgtgctcagtcttactgcccagggaacagccatcagcctttgagtggcaagagttggtagattaccatcccttcttgacccttggaataggacaacttcgagatrtgttctcccgagtctcccagatgaccccagtgagtttgaacaccagttgtccacagagataatctgcccattgccacctgtgtattgactcttttacatattctgtctcacttctctttctccctcacttgtgcttcttaagattgtatcctgaataagctatttgcactcaaataggcagagagctagctggatccattattctctcttgtcttctatattttagatatcttgtaacaggcacaaggtaccgtgtagagctgaggtgtaatgacccagctgatctgtttgtactttctcatgctgctaatgggtacctggagttgagaatttatgcataggtgtgtacatgccrtcrcagctctgtgtgcatgagtgcctgtggggtctgcrtagcatgcacacatcacagaaaccctctgccctcccttctcattcctctatttgaagccaagtttccataatccctctactcaacccccttcttccccagcccccaggggcttcccatacttagggtcaccctttcttacctcagagtttcaaagatgtaagagctgatgcccaccttgatggtattcacaaagtatagcagggaggcggccatggaaatgactctttacagcaggatgatatgtggaacatgccatggccagggaagtaactttgtctcaaggggatcaggaagatgcccaggtatgggataacttgagcaaaagatttttgagcactgatctgcagattttactctctgtaaagggccagatagtaagtattttaggctttgtgggccatatggtggctgctgcaactgtgcaactttacttttttgtagcacaaaagcaagcatagataccacataaatgaatgagcatggctgtgttccaataaaactttatttacaaaagcagatggtgggccagatttgtcccattagctgtggtttgctgacctctgatttaaagagtgggaagtagatttctggaaagsgagaaaggaagactatttctagcagagagaagaaaacatataaaggcaaagagtgggaaaccagagggaataagacaaatttgatttaccaaaaagtcctttttggtggtagtaaaaaatactaataataaaaactaagttttattaaagccttattatgagtcaagcattgggctaaatattttgtggattctcatttaattattactctctctgagtttggaggaccttgttttcctcatggcacacacgaggagtaaattaagctcagagagggtagatgactggctcaaggtcacacagctmccagctggccaggtggcaagaccccggacagaggattgggagcatggtatwgtagccagcgtacctccttgtgtctatcattagccctgctttaatggactttttcagaagtgtttttgcttgtgttttacaagtggaatgtgattccttgactcagcccagtagccctgtgaatggatggctgaaacgagtctgacggctttttctcctggggccattttgtaagaaataaaagyaaaacagtgagatatttaaattcttcagggatattattttcgagtrgataaagtgaagaacattttttattcatattagaagtgatagttggatgtgtgtaatttttttgctctccgagatggagagagaacacagcacagatcttagaatgtaaaatatgaatttagatgacattttgagaaaactgataaacaccaccattccacaattggacttaacttgcctgtgaaaatccttctgcagcccacaaaatgatagagataggtggactacgtctaatggatattaaaaatacacaacacaccaatgaaggaataattttcttttgcaaagttttcatttctcaaaatgctaccaggaaaagagagataccttgacagctgacagtaaccctgggaataaggatatgttagaagagaagggctgcagtagttgtgaaatcctacctggaatctacccctggacaggagacccagggatcaagactcaaagctgatgctctcaacaccaatgtttcatctccagtgtaccacgaggtccttgtccacctacttctagatagagccaaactgtctaagccaaasggggtttgggtttctttcaccacccacctgtgcacatgattagtttgaaaaagtatgtcttaaagaaaaataaatgcagacaactaagtgagaacagttacatgtactaaaggtctttcagaaaatcagtaatgtaggtcagtgcatttcaggatttggaatttcacacaaaatttacccttgaaaactttagactgagagaagactaccatgcctattctgtcatgtaaggacatctaaagaagaactgcacacattggtattaccatcttcccacacacatacacggacacgcacgcatgcacacgtgtgtgcacacacagacacgcacacacatgcacgcatgcacacacacatgcacacgtgcacacatgcacgcatgcacacacatgcacatgtgcacacatgcacgcacatgcacacacgctcacacacacagaatggttcgtggccgggtgcggtggctcacacctgtgatcccaacactttgggaggcctacaagggcagatcaactgaaatcaggagttttagaccagcctggccaacatgacaaaaccacatctctactaaaaatacaaaatttagccaggtgtagtggcaggtgcctgtaaccccatctactcgggaggctgaagcaggaagattgcttgaaccagggaggccaaggttgcagtgagctgagatcacgccactgcacagcagcctgggggacagagtgagattccatctcaaaaaaaaaaaaaagtttcatactttcactcacatatacactcacacactcgcacatacacctacacatacactcatacattcccatagaaacaagtgagttataatctcagagtgaacaaaattgagtaaattttaccatacaaacatatttattatgcttgtctcactaaaaagcagtaaaaattctgatatgagcatcacacaggttaatgtaagatagtaagaagaagaaaaaagtataattatcctagaagtcctattgaagaatgaaatcgcaaaataaaaatggaaggggcaaaggtaggatccttagaatgcttacaatgggaatctgaatgtttaatgagaaataagcccgacacccatagcacataaggactcaggctttgggatctctcccttcctagctttgaggcctgggcatgttatttaacctctcataccctcgaaaggggctcataaaagcaatcactgcatggggcttttgcttggtgaatagttccagcacatggttagtcctcagtaagtgttagctaatagcattagaaactagcttttttaaaaaataaaggaaggggccaggcgcggtggctcacgsctgtaattccagcactttgggaggccgaggcgggcggatcacgaggtctggaggtggagaccatcctggctaacacggtgaaactccatctgtcctaaaaatacaaaaaattagccagacatggtggcgggtgcctgtagtcccagctactcgggagtttgaggcaggagaatggcgtgaacccgggaggcgaagcttgcagtgagcggagattgcaccactgcactctagcctggcggacagagtgaaactccgtctcaaaataaataaataaataaataaataaataaataaataaataawtaaataaaataaaaataaaggaagggctgggcgtggtggctcatgcctgtaatcccagcactttgggaggccgaggtgggtggatcacgaggtcaggagtttgagaccagcctggccaatatgatgaaaccgatctctactaaaaatacaaaaattagccaggtgtggtggcatgcgcctgtagtcccagctgctcaggaggctgacacagaagaatcatttgaacccaggaggtggaggttgcagtgagctgagatcatgccactgcactccagccttggcaacagagtgagactccgtctcaataataataataatataataataataatwgtaataaagaaagtacatggggaaggaatatgttctacatgagctttcacaggggcaccgatctagaccagtgtggactagaagtagccacatcccctgagatcctgtcggtaaaacacattctcgggcctccccacaaacctcttgatttggaaccctgggaggtggcacccaataacctgtgttttcaacaaaccctctagatgatgccaagccacactaaaatttgagaacctctgatcaagccctgcaagctttttaaccctggtcctgggcagtcagctaaatccaggaagtatttcgcagattgggaataaatargaaaaaaaaaaaggcataagtgtctttgggttgaatctcattttaagccccagaattaggcttgtgaaaacaattcaagaattgtcttcgagcctataatgcctgctagtcccatgagaaaaagattttgaaacaaaataagttgaggttggatttgctttttttccaagcttcaaagcatcaaacaaagatccatgttcacatctgaatatctgagttcacatctgagtcagccgctgactcagcccctgaccacagagtgatgaacagagaggcaggcatcatgggacctgaaatggcattttctccaaaatattagaacgtccttagatcccttagatcaatggtgatcgtgggcctggaaaacttctccaaaaagtgcaaacttctcctgtagttagcatattagtttgttctcatgctgctataaagacttaccctagactgaataatttataaaggaaagaggtttaattgactcacacacagttctttgtggttgggaaggcctcaggagacttacaatcatggcagaagggaaagtcaaccgtccttcttcacagggtggcagcaaggagaagtgctgagcaatgcgcagggatagccccttataaaascgtgagatctcttgaaaactcattcactatcatgagaacagcatgagggtaactgccaccrtgatccaattacctctcaccaggcccctccaacaacacatggggattatgggaactacaattcaagatgagatttgggtggggacacggccaaaccttaacagttgggttcaaagacaaatgccaccataataggccgcagatcacctttattgccagcctctctagtccccaagtagctgataaaaacatagacaaaaattatagagaatgaaggaraaaaagtaaggggttattttgagagcaaagtttgcctcatctgtccaatagagactgtcttgtatgttaaaagttcatcatcaggagctgaaagaattgaaagtaaaatgaaactatcttgtgtgcctcgtaggaatacaacctggacgtagtgtccattactaattaaagccaatgtgtattgtactttcacagtgagacaggccctgctctttgttctctatatttatttacatgcacttaatcctcacaattactccatgcaataaatcccattatcactttctgtactaggttgactagggtcctccccaaattcatgtctacccagaacctcagaatgtgtcttttcagatgtaattagctaagatgwggttatgctggattagggtaggccctacgtccagtatgccttggagtatcctcataagaagaggagggccgggttcggtggctcatgcctgtaatcccagcactttgggatgccaaggcaggtggatcacctgagttcagaagtttgagaccagcctggccaacctggtgaaacccaatctccactaaaaatacaaaaaattagccgggcatggtggtgctcacctgcagtctaagctactcaggaggctgaggcatgggaattgcttgaacctgggargtggaggttgcagtaagccaagatcataccactgcactccggcctgggcmacagagtgagactccatctcaaaattaaaaagagaagaagaggagagagacagagacacacagaagatccaggagagaaggccaagtaaagttggaggcagagagtgggatgatgagtctataaaccaagaaataccacgggtcaccagcaaacaactagaagctaggatagaggccgggaacagatgttcccccagaacttccagaaggaaggactcttgtagatgtcttcttttgtgcttttggcctccaggactattagagtaaatttctgttgttttgagcccctccggtttrtgacgtgtagttactgcagctcctggacactgagatgcccctgtttcttgatggcgaaatggagactgaaagatcatgtcttacccaggtgcacacagccagcttttggaggtttagggtcagaggcagcttcgggggtaggaatctagaatctggtttcctcatcttgtgctgtgtcgtaggtctgctgggttcaggttctggagacgtcattccatgtttctgagctctcttttctcccctgcagatgtaagaactctgtacttgaggactcatgcctcagctgggtggtgggattggattccttttaaggtctctccaaaccaaccctgagcctctttgattagaattctagaagctttgaaaccaccactacaaaattcatttgcacgacatttctcttttaagcattacacttctctctgcagtaactttgaagttactgtcgttttatgcactcacgaagagttaacaagcaataataaacagtcaagactgcttttcatttcacatatctgcatgtgttcagtcttttccgtgacacaattgaaggagcttctgtaatcaggagagaaactttatatcatgctgtaatttcccttgatacaagctagaaaaagatactggtttagattcactggggtgattgactagaaaattgccccagctgtcaaagtttccagtgttaaaaascagtgtaaaatttctcaaatgcttagaatttctagatgtcacaacagagatgttaccaaaatatgagaatcaagttttttataagcaggacaaaaatacattatttttctcaagttctcaatatttggttgaattcatgaagaaatttttaaaacacaccaagcaaagcgttcattttgtttagaaataaaattaatargttgttttttgatattgtattaatgtgtcctgccacattaaaagattgcctatatatttataaatttaatctttatataggaattaaacagacaagccagaaaaagaaaagaaatgataagctgatatttgggtataatattatcttgttatccatgttctttgtattagctgaattatttccatttctgctccaaccaagaaaatcarttcaaacattgttcctcgtgatttattcaaaaattcgcttttccaagtttccgtctaagagcatgtggtgggttcttatcttcatcataaaagtgtataacrtaaagagatgtcctcagatagctcatggcatttgttagctcaggggggttgtagaaagtttcctgtaagcgttttacactcaaagttttcyttatagtgccaaagaatgagaagcaaaagcaattcagcactggaaccgtttggggagtgtggctccattctgaggttctcttctcatcagagtgggggcaccctataattttgagaccttgagccaggctttcatgtcatctctctttatgaacactccactagtttctagcctataaaaatagtgtcaacattacagtaagctaagtataaggcagaatcaagaagccaaggatctgattttatttcagagttctgaaatggaactaagtgttacagaaagcaatttgtgggaaacaattctctacagtatgacttatagactgcttcaaaggagaggtgtcttctcttcctagacctgggattttaatgtgagagctcccttatcatgttgaggagaatggctgtctgaattgttctccctcttatttataaaggcaatgatcagaagataatttgtaagtacctactctcttccaggcacagtatttaaaatgaatatatagtaaaaaagccagctgcctcccctgtcatcatggaatttataacttagtagagaagatgtcaaaaagatattgcaaatgatctgagtgttttttacaatggcattgttgtgtacaacaggtggattcccaccttgttggggaaagcaaggagtgctccctggaggaagtggtatttattttgagacctggaaattgttagccaggaaaggagataaagtggcgggagtgagagcaaaaatattgtcaccagagaaatcagtgagtgtaagaaattgctggtgtagttaaaaactgaaaaaagtctggatacattgactgtcgtgttttcccagttgtaggtcttgtaattctggcaaagggaaatatgaagtgaattcctggaatctcttgctgatcccagagagactacagttctagcataaaaggaagctcaacagggtgactgtaagaggttccagagcagcaggtcatactcagcttagaagtgcttgcaagacagtttaaggatgtagactgtctaaaagaggctcataaagagattatcaatctaaaagcaaacttgaaatattaatcagggctagattaggttatgctgcagtaacaagttaacccccaaattttagtaggcatagcgcaacaaagtttctttcttgctcaagctgtgattccaacatgggtctgctggggagctctgttccacgtagtcattaagggatccaggctgacagaggctctgccagcttgcagcatgtggagcactggcctcctttgtgcctgtggcagaagaacaaagagttacagtatcaaaagcagcccttaaatgcttcaaccatccctttggctagaactagtcatgtggccccacctacctgaagggagggtgagaaatgtgagggaacacgtgggcaatcaccaggaagttcctttgtttgttgcagtgacagtctggaaaacaatgtgaactggttgasaagcttaaaaatggatctaagggcaaaaatgctaaaggagagaaagaattgttgacagtgtataagaagatgattaggaacaaagtgagatgggcagtttggaggctctttttttagctttaatggtaatagaatacacgtggcactctcactaaatgcaaggcattgggctttatgtagattgtcccatttaattttcacagcaactctgaggtcgatattattatcgttctcattttacagataagaaaactgagccctggggtgatgaagtgactaaccccagtgatatggtctggctctgtgtccccacccaaatctcaccttgaattgtagttgtcataatctccacatgtcataggagggacctggtgggaggtaattttatcatgggggtggttaacctcatgctgttctcatgataatgagtgagatatcatgagatgtgatggtcttttgttttgttttgtttttttgagatggagtcttgttctctcacccaggctggagtgcagtggcgtgatcttggctcactgcagctctgcctcccaggttcatgccattctcctgcctcagcctcccaagtagctgggactacaggcacatgccaccacacgtggctaatttttttgtattttttagtagagacggggtttcatcgtgttagccaggatggtctcgatctcctgaccttgtgatccacccgcctcggcctcccaaagtgctgagattacaggtgtgagccaccgcrcccggccaagatgtgatgggtttttttttgttttttgttttttgtttttttttgagacggagtctggctctgtctcccaggctggagtgcagtggtgcaatgttggctcactgcaagctccgcctcctgggttcacggcattctcctgcctcagccttccgagtagctgggactacaggcacctgccactacacccggctaatttttgtatttttagtagagacagggtttcaccatgttagccaggatggtctcgatctcctgacctcgtgatctgcccgcctcagcctcccaaagtgctgggattacaggtttgagccaccgagcccggccgatgtgatggttttataaagggcttttccctgttttgctcagcacttcttgctgctgccatgtgaagaaggatgtgttggcttcccctttcaccatgattgtacgtttcctgaagcctctgcattcatgctgaactgtcaattaaacttcttttctttataaattacccagtctctggtatgtctttattagtagcttgagaacggactaatataccagactctacagtttgtaacgtaggcactaggattcacagatcctaggcasctggttctcagattcgctaaactttaccattgttctttgtccgtagcctggaagcttagaatctggaaggatagagaatagagttttatagggactgggacacactggaaatttgaggaattttagttaggttaggaggcagttcctacatatagrtggaaggagaaataccaggagtcttgtcttgtctcagcctaacaagatgacttctgagaatatgatcaggcctgtttccgscctagcattggagtccagtgatatccaagggcctttatcaggaaaactgcaacatatgaacacaacacagcctctgttttggagtccccagaagacagctgattggtttaagtaatagtctagggacaaagaaagaactaatacttcaatgaaaaagaaacaaatacttcaatgaaaatgaatttcatatcgcacttctacattccttatttgagggtatttgagcaaactaacagaggaagaaaattagccactttaactataataccttgagtattagactaatccagttataagtttacagaccctttgatcagaagtcagagaagttgcctaggaaatgagttaaacctatttctaaaatgtccaaaattagctgttcaaagaaatcttttttatagagcctaaaatattctaggcaagagataatgaaggatgctctagggcaatggtgcggggagaggaaagaaaggtgcctcaatacaagcagcatggcaaaggtacaatcctcccagtgtgaatggtggggggaacaaggggaactgaaaaacatgcatgaggacrttagctttgaatgggtttcttagagctgggggacaaaggaagagtcgcagatgatcagaaaggagatgtgaaatcttctgcttgctatgttgagtttgaaaaataaatgaaaaaatttcaggtaaaaacagcaaatcrtagcaaataaagatctcatattcaggaaaagggctaggcctgggtaacttcatgatataaatgttcaccattgctaaaacttaaaggactgacaatatcaagtgctgacaagtatgtagaacaactaggagtcttgcaatgtttttcaaaatggtagccccagtcttgaaacaatacatatgacttctaatgacagaataagtcaatgactagaggtaaacagtgatgaaaaagaatgaatatggttgacactcacaggctctaagtggagcaaaagaagccaagtgtacaaaaaagtacattttgtatgattccatcgtttatgaagttcaagaaaaaacaaaaaggatttatggtgatagagatcagaatagtgactaccttgcagagatggcagttaggagaggacataggaaagcctgctggagactgggaatgttctctcagtctgggtattagttacatggatatatacttaagtgggctgcagggtttgctctgagggagcaaacacagcttgggctgtgtttggccttgaatattgtgaataatatgtttaggcaaaaatcctctgtgtctcgacgtcattgcatggatccactctatggttggccttagagccaggttcttgtttgcatataattttgcggaagtgtttatgtttgccgctcaattgccaattttgattacagcttctcagcctggaaaattgtcctggaagggcttaatggaacacttgcaggaatgtggcatcatcaattttagagccagaacaggacgtggctagcttttcagctggccgggaagagcctggagagtgctgagggacaccagccagggacaggcacaggatccaccacatggctctggcctcagttctgcccagctcaaaatcttcatccaagttttatttaaaaatcctttgaagggagagcaatgggctgccccaccaagagaagtgttcacaggaagtgcctctcctcaggtttcaaccatcgcctcccaaacttcaattttttaaatttcacctttgtaatgtctgctatttctaacatctgttctaatatatacttcatgtgctttttaaagcaacatgctctcttttacttcagtaaacatatttaggtaagacataccccatcaccacagtgccacagtaaatggaaaaccagcactttgctaacacgttttaaatttaaattattgcatgtactgccttgcgtgttagctctcagtaattatttttcatcctcttargtttcttccagctttaaggctttattattttaagttataaagtaatcggccaccctgtatgactgtgaggtccttcaagagagaaggtactctttgctctttgaaatttaggaaaaaaaaaaagaatggaaaaaccaataatggaaaaaaaattgtatttttatgctaatagagtagtagcggccaggtgacctttagcaggttccttaatagtgtgtcaccaccaacacagtgtaaacaccaatacggtgtcaacaacagcaataaaatgcagkttaaagacagcttatcccagggtatgctatgagaattggatgagaatattgttaaatcccttgtgagttttaaagggatgtaaaagtcttagaaatattgatgtgatcattggcaaatgcagatggatattagagaaatcaatctaaattgtatatgtagacaccagccacccccggaaaagaacatgagtgggtaattcttccacstatgggttttcccatgggatgcaacctgggtgcatggaaccagccctggcttcagagttagaggggcctggctagtgctggttctgccactgaccttgacctgagtgaccttgaaaaagaaatctaacctcttgcattttcaataacttcacctataatacagggcaaatcatcctactatatgaggtcgttgaagtttaaatgraagagtgtagagtctgcccttgaaacacgttgttatttttcaagcgattttctgaagctagagcccctcatgtgagggatggagagatgaatccatcagctgttaaatgcctgcattcgggtgccaggccaccttccttcctaggtaaggtctgcaaatccagttctcccctgctgcgcagagtgcaggtccagctctctgcccaccgggtgctgtctgtttagaggagccagctctggcttgcgctttaatgtcatgtttaatgcctgctctgctgcagcctccacatgtttattgaatctttatggaaaggccataacagctgcttcgggtccattataatggatcacgtcaaaatgtagcctgccattgttttaaagtcatgtattattcacttgatggagtgtatacgtccatcttatgtcaatttgtgttatggactgtcaaaattaacatgagtatatgaggtaaggcatattggggaagaaagttccacagcgcaatatgcaaccgtggagtttctartcttaataattcagtgggtgccaacaagacgtggtctctattacagacttgaagctggtaatacttcatttttaaaaatgtaaccatttttgagttacaggaaaacaaaaatggtctgtggccaataaatgtctagttttataccgttctataaatgaaagtaataaagcacagcaaagttgccgagygcagtgggttcttaaacacctgcagcgtcatttctcatcagcmggtgggcggcagagttcacatccctgggccctgtcggggtctggccatctccaggtggtgacaggtggcatcagactggcctgaattcagccttggggctgtgcattctcctggggcttattacagaggctctgacctccacctataggttcaattcccctccaccccaaggacttaaagaatttttccagacactttatgactcaccacctagtggctcttcccartgtgactccagctagccacaccaagtccctttcagactcatgaccttagcaggtgctgttccctctgcctagaactttcttcctttatgtcctcacctggctgaattatactcacccttcagttctgctgaaatgtcacttctccaaagaagcatttctggacccccggcctccctattccaccctcctctggtaccccttttataggtgcttcttcctcatgcacctgtccaggttgtatctaaattagtaataaaagtttgatgtcatcctctctacccacaaataatgagtgcaggatccatgtctatggcgtccaccctgtagctgtagcacttagcattgtgcctgtcatgtccataataggtgctcagctagcatttttgaataaataaatgagtgcatggatggaagaaagcaaggttgtctggcagactgtcttggttgaacatgatttcctattcatgatracctagcccatgctcttcaatcctgatagcttttttagattttttaagcccaaggctctgtcttgtcatatgtaccctacccttttcattatccttgaagagaaactcacctcccaccctggaatccactggagcagcctgtaccctgccaaccagtgccccccayaccaggactctctgccacgtgtgtgtactcaccaagtgctcctccatttcccattcctgagttggatctactccagggtcactcccttgcttcatggtagacccttgatgtcagttccctggcagctggcttgggctcttcctagcgctcagattccacctcagtgggcatrtccggttgcacatcccagaagtatatatcttccccattctgtggcatggttgcaaggacaacattgaacattgggaaaaggaggcaagaacgacaacagtccccatttcaaacacttcagtccctcgttatgcagctcctagaagtatccattgttctgggaaagatgaagcatccagaacctgtgtcaggactctagaatgaagattcaccttctctgcaccagcccagatggagagcgtcctgggcaaccaaagtccccaggagtatttgcacctctcaaccaagattcttagatcacagctcttaatcayttaccctgcagtccacccacaggagatgagctttatttcagttgtgtaaattagtgaaacagaaccccgaagagctgaaatgtcctcatatctgtcacgaccttaccatgcactagatttgtttccacagataagcttgtgggtttgcacgacaaccaagagaatttgcagttaagagaataaataatgcattattagaagaataaatcagcatgcagtgtacatgagtaatatattcataccaggcccagtgaaggagtagacacttatttagtktgtttatgcagacatagatttaaaaatstataaccacattattatgggttctttacaattgtaggagcaggaagttcacacaggtcttccagcctgtctagcaggtggactgagagtcatgaatttcatgtctttttcttttttcttttttttttttttttttttttgagatgaagtcttacactgttgcccaggctggactgcagtggcgcgctctcggcttactgcaagctccgcctcctgggttcacgccattctcctgcctcagcctcccaagtagctgggactacaggcacctgccaccacacccagctaattttttgtacttttagtagagatggggtttcaccatgttagccaggatggtctcgatctcctgacctggtgatccgcccgcctcggccttccaaagtgctgggattacaggtgtgagccacctcgcccggccaaattgcatgtcttaacaccccctcttactagctgagaggtcttggcaaacctgtagcactgagagtgtcaagtttatccatctttaaatggggccaccatctaacacagaaaagccacagggatcagagaagaaatcatatgagtgggttccgtgggctgtaaatcctgaatgcgcatgagatgggaaggtcagtagaccaatgattttctcatcatagattcttgctgtgtcaacttggacaaaaaacttaattttcggggacgctgattctttttctctgtaaggagaagttattggtctgatgcacacagtggaatcaaacggcaatttacttgkaatgaaaacctctctctcccggtgtccttatagcaaccccagggacagactccagttggctctatctgtgcctcatgtccatcctttgaaccaaccacgggccagtmgaatgtagtactcggattgaccaggcacctgaagtctaagacagcttccatcagtttcctgataactggcatttactgagcaytttgtctgcactagatcctgtgtgtcatgcacactgacttatttaaccttctggacaacaacgtaaaataagctttagtacaaagagaagttctataacttgcctgtggtcacatggttaaaaagtggtgaagctggaatttgtaaacaggtttcttggactcctaagcctaatttgtaaatgctatgttatactgacttggttgcagtattggtgggagagggcatcctaaacagcacctgcttgttgccaagcccttgtggatttaagctcagttccttccccagaccttgtcgtgtgaacctccattctgacttcacatccatagtaggcaagataatggccctcccaaaggtgtccatgctttagtgccccagaagctgggactatgttgcctacctgagggacattgcagatgtgattaaggagtccttgagtcggggagatgattctgagttatcktggtggatccactctaatccaatgagtccttaaaatcaaagaattttttctggctcagagaaaatgtgaagactgaagaagagaacgggacagattgcagcataaaaacaactttgtccagcactgctggctttgaagacagaggaggggccacaaaccaaggaacatgggcagtcccaagaagctggaaaaagtgaagaaatggagtttcccctggagcctctggaaaggagtgcagcccttccagtagctagatgttagcccagcatcctgtgttggacttctgatctgcagaactataaaatttacagatgtgttaagacaccgtgctgtcgtaatttgttacagtagcaatatgaaagggatgtaacattcaaggcagaaccaaaaacaccaggaaatgctgcagccaccaccttcgaaccagcttcaaaggtcagccagtcatcagagtcagaagttttgttttgtgggggcggtggtkgttattgttttgttttgtttttttcctctttattctgaaaagtgccagctctcaagctggggcaaaaatagctttgtgttgtagcctcaatcaatagtccgcaacctttttggcaccagaaaccagtttcatggaagacaatttttccagtgggattggaggaggatggtttccggatgaaactgttccacctaagaccatcaggcattagttctttagattctcataaggagcatgcaagctagatcccttgcatgcacagttcacaataggttttgcacccctatcaggatgtactgccattgctgatctgacaggataccgagctcagatggtaatgctcgcttgctagcccactgctcacctcctgctgtgtggcccaattcctaacagcgtacagactagttctggtccgtggcccgggggctggcggctcctggcttaaatgatgaaatttgctgccactgtttaaacactgactctttcacttccccagcccagcctgtacaatcttctgctttaccttctttaccttagccctttgtcccagtttgggaacagtgaaactgctggcaatcccagtaattgtcttgaagcaggcaggcagacagaatgggaattcaggccagggatggtggctcgtgcccgtaatcccagcactttgggaggccaaggcgggcagatcatgtgaggttgggagtttgagaccagcctggccaacatggtgaaaccccgtctatactaaaactacaaaaattaggcaggcgtggtggtgcgcacctgtaatcccagctatttaggaggctgaggcaggagatcacttgaacccatgaggcggaggctgctgtaagccgagattatgccactgccctgcagcctgggcaacagagcaagactctgtctcaaaaaaaaaaattgttttaattaaagaataatttaaggctgggcgtgctggctcacacctgtaatctcagtgctttrggaggctgaggcaggcagatcacgaggtcgggagatggagaccatcctagccaacacggtgaaaccccatctctactaaaaatacaaaaaattagctgggcatggtggcaggtgcctgtagtcccagctacttgggaggctgaggcaggagaatggcgtgaacccaggaggcagagcttgcagtgagccgagatctggccactgcactccagcctgggygacaaagcgagaccccatctcaaaaaaaaaaaaattaaaaattaagaatgggaattcagatacaaaaagagttgtcttctgcgttaaccgcagcacagggagagaaaaactacatctacccacagcattatagaaacggcccagggcaactacatccgtttgatggcattatagagatggcccagggcaacctgagtctgctttttcatttgtaagttagtgatgatatatacacctgacccaggtgctacgaaaggacccagtaagcaaatgctgagacaacacccagtctaggacttggcatcaaataagcaaccctataaatgccagcacctattacggttgttgttgtcatttgggtgataatggcactcaccaaattaaagacttttgagatcactggtatccatatcacactgtaaagtagaaagaagtctatattttctcagtaccactttaatgttaatttattacttaagtaccaacaaaacttcaaacaatattagagccagaggaaatattagagatcttcctcgaatgagtnnnnnnnnnnnnnnnnnnnnnnnnnnnnnnnnnnnnnnnnnnnnnnnnnnnnnaatgagttcggtgactttctaagggcacgcagggagtttatcgggaaggccagggctagacaatccaagttcccacagagctgataatgagccagaagtgggccccctacacacaggcatacctacttagccccatctgtatatcccaaactcacacagcctctttaataatcctcttaatagcagtgataactaaacatattcagctttaatcacacttgcacgcatgccttcttccttaaatctaagtaatatccctgcagctattccaaaaggaacactataactggctatttgmcataataaggatgaggaaattttggttgaycacattttaaatgggaaactgtatttagagagattttaaactgcaaaattaaaaatgcaaacgtgaaattatttttccattaagtcttctccttggggaaatctcttcctctgttgcagttgggcggtctggatgggctggttacccttgtgtggggtgtatagtkaaacatcaactcccatgaggctcattctcaggggttgagataatagtagtccctagtggggtcgtctaagagcccttgggagggcacttatcttcatgtatatattacataaatcttatttcaaaagggatttctactataaatattagaycatctgtctctaaattctccaactgtttccatctatctctaaatttcccaactatctccatctatctctaaattctctgacagtgctgagatgtaacgaacagcattaaaacactaagcactgaaaaagagttatcatgctgaacacagtgttgtttttattctaatttctaaatccatgtctcgtttagcattggttgtagtcaagagagagactgttcaatcccagtctccccatgccttttttctttgttcattatggtgaagggatcatggctatataactgtttaattagcaggagtcaccttgagaaatgtcaccagggtggtcctgctcagttactaatggggtagttatatataaattgcttggtccacctgactgaaatatagtggattcagtttagggagtatgaaaatctcagattagaagagaagatggaggtcattccacccaaaccccctccccatgaatacctctgtcttttttttttttttctttttcattgtagatctaggcgagcttgcttcttcaggaagttaagccccattgttaggcatctctgaagtacaagcagtacatagtatttatggttggaggtcagactctgaagtccagtgtacgtggattggaatcctagctttgcagtgtacaagctaattggatgacatatattaaacttattaacaggctttgtcttttgcccagaaattttacttctgaaaactagcctaaaaaataataaaaccttaatatttgagtttatatgtataaggatgtttgttgaagcattgttttttgtaggtacaaaaaataaaaggttagatctccattcacactacactgtactacatccattctaggaaatactatatggctttaaaaaataactgataatatctatgatttactagcccagagcaatgtacacagcttacataaagaaatgtgcatgccatttttttgtgaaaaaaatcataaaaattccctgtgtgtgtttttataggattctgtaaggatagtaaaagacatggatgatctgtactactgttttctgagtaatataaatggaaatagagattttaatacaagcacaaaggaaaattatgcataacagaattttatctattaaacgaccacataaaagaaaaatacaatattgatattgattttaaaaaagatgaaaataaatgtcaacatattgaacatttggtcaggtgattatggagcgctaatgtttttcttacatttctgttattttcatatgtatttgtaataaaataacgttattaaaatcacttataaaggaaaattagaaactacagtcctagttaagtaggagtgcaaaagaacttgtgaaatggggtcgggtaagaatctagtgacttctctggakttgcaagcagagggtgcctgatgcagacactgagctggacatgaagcrtgttctctgaagattattgtctgtcttccttctaaacccatggctctgcgtacctgttcctgctggcccttgaagaggttcatatatttgaaatgagcattttggggrtgttcagcttggtgctattcatgataatttgtaataggttaaatgctttcaattaaagcttaagtcagtgaagctctcagttgagaaatatcagaaaattgagtgcactgtaaagtcagtctctgtaggtctccatagcttgaattttgtggagtcaccactgagctgaccttgtgctgagttttatgattctcatattagacaccttcttacacattcagatggcatttccagctggctgtctaaagttgcttcgtagtcacggaatcaggaccccagaacagagagccaaaattgagcactgtttcctgagagcactgtggctctgtccttgaggacagatttggcctgtgttaagttgttgatgagcaattgttaggattaatggtctctgtgagtctactccttctataacccagcacccaggctttcacatcaaccacgcaccaaccatcacagcagctgttttcaatctgcccatcatcttaaccacacacacaaggctgcagaattcatctcattaacttccttattttgtaatggaagactgaggttcacagagggacagtgactttcccaagtcactcaactggtcctgacaaagaaggactagcctatggcaatctcagattgccacctctatgttgaaatgacatttaccagtaactagccccttggcagagaggaacccatcaggcaggcggtctgtgcatggtgggtcagaggcagagctgtgcattcacacagactggattcaaatatcggttccttcatgttttagctttgtgactttcgctgggtcctttgatgtctccactcctccatttcctgtcctctaaagggggaatgctggcagtgtgttttcatgggatagttacgagcattaaataactttcttccggtaaagttcttggtgttgtttctgacatctaataagcaatcaaatgttacaactgccaccaccatggtagcacrtcctcttctgggtaacacctatgttaaatcaacgtacatggcttgactcaggtgatatctgtaatcttgactttgtctgtttacatgtaactaggcctctggtctctgccatcctatmaatccattcagcctttcagcctcagtttctcctggtagagcctggcatggcctgaaggcagcacagtataatagaaataggaaggtgtgtgtgatagactaaaagatggctcccccagacacccaagtcctgatcctggtacctatgactatgttaccttacacagcaacagagactttgctggtgtgattaagtcaaggatcttgagatgaggggtgaggggcttataaagcggagtttccctgcacaagccctcttctcttctctgccgccatgtgagacatgcctttcactttccaccatgattgtgaggcctctcagccagatatgctcaattatctaagttgtccctaaatgtaattacaaatgtccctacaagagggaggcgagtggtattgactgaagaagagggaggaggcaatgtgatgtggccactaacccagaaatgaattcagtctctagaagcaaaaaaggcaaaatatacattctctcccggagcctttggaagcagtgtggccctgctgccaccttaattttagcacagtgaaatggattttggactcctggcctccaaaactgtaagagagtaactttgtgttatttcaacctaacagtttgtggtaatttgttagggcagtcacaagaagctctgatatggtttagctgtgtccccactcaaatctcatctttaattttagctcccacaattcccatgtgttatgggaggcacccggtgggaggtaattgaatcatgggggcaggtctttcctgtgctatgcttgtgatagtgaggaagtctcatgagatctgatggttttataaaggggagtttccttgcacaagagctcttctcttgtctgctgccatgtgagatgtgcctttcacctgctgccatgattgtgaagcctcctcaaccacaagggactgtgagtccattaaacctctttcttttgcatattgcccagtctcaggtatgtgtttatcaacagtgtgaaaacagactagtacaagctcatacagtgtagaagtcactcctcaaaggtgacttctgtcaccaccctcaccccaagrttagaagagttcccattgcaccttgaaattcattttcaaagcattcattgcacttgggactattagtttaatgcccagcacctggaaccagtgcttgraacatgggagtcccttaataaaatgttactggataaatgaatatttgtcttcccagagagacagtgagcttcctagaagccacatgcgggctctttgctgctgcatccagagtgcctagctcagcgctagtgcatggtagsttctccataaatatttgctgaatgaataaatggctgcttgtctcctcaagtagcctatcagctccacattcgccatgtcagtttcttcctctgcaayctctgcagtggcttgcaccatgcctggtgccttgtaagttctttgcaagcaatcattggccatctgcctgagtagtcacgctggtccggacttgagcgatcctctccctctgtccctttgcactagagcagttgtcccattaagccatgtgaaccctaccggtgtgtgttatgagccatgcgttgtgccaacatcccggcagacggaattcagcagtgccacgggagagagccagcggcctcccctgcatctgagcagcstggcttgttagttcccagtccttcagccaccagctgtttctaacacaaactcgtggtgacagagctctctgtaggagaagctaactacaattgtcagtctgcagagcatcaggcatctctaaaaggattccaattattgttctgttctgcctgctcctattacagtctacctcaacatcagctcttattcagggagaggagagcgagatgctaactctgtctccactcactcttatgccagaggaccagcagatgccagcagctggtgtcacgctggagaagggtaaacataggtaaacttcccctcaatgcgacggctcacttttcattggtgtgtattgcacttaaatgtgctcggaaaatctcaactcagcgtgactcgcaacctcaccactgagcggaagataaatactgagatgcccagaggtgagtcatttttacagggcattccccaaagacaagatgggaggtgcctcccacactcttcacctcctcctctgtgggcagcaggtccctgcctgaagccgacagacaggaagtcggatctgtgtaggtagagttggcaggtttctcagctctcataatagctcatgggcattgcagtaaggacccagcacaaggaggtggtggaatggcacggcccacggcttccttagttgtggaagttgtgaggatttaagtataatttacattatcttttttttttttttttttttgagatggagtctcactctgtcacccaggctggagtgcagtggcacgatctcagctcactgcaacctccacctcctgggttcaggtgattctcttgcctcaccctcctgagtagctgggattacaggtgtgcaccaccacgcccagctaatttttgcatttttagtagagatgggatttcgccatgttgcccaggctagtctcaaactcctgaccycaagtgatccgcccacctcagcctcccgagctgctgggattacaggcatgagccacagtgcctggcacgttaatctattttaaaaatctagttggacttatttttaaacttgtttgtcaaggcaaaattcacatgacataaaaattaaccattttaaagtgaacaattcagtgccatttagtggatggacagtgttgtataaggcaccacctctatctatattctcatcgcccccaaatgaaaaccgcatacctgttaagtagttgctccccatcctccatcccccatgccctttgtaatcatctactttctgtctttaaggayttacctattctggatgctccatacaaatgaaatatrcaaagaggagcgcattaggaaggtggtctgttcatggtggttcagaggcagagctgtggatyctcacagcctggattcaaataccagtcccttcatttttcagctttgtgatcttggctaggttctttgacctcttcatttttccttttcctgttctacaaagggaaaatgctggcagtgcattttcatggggccgttacaagcattaaataaccttcttcaggtaargttcttgctgttgaatctgacrtcaaataagccatcawatgttacaaccactacctcctcttcckggctagcacctatgtgaaatgaatgtacatggcttgactcaggtgatgcctgtcttttgtggccttttgcgattggcccctgtcacttagcacaatgttgtaaggtacgtcatagtgtttactgatccatatgatagcagaggtcagcrcttcttttcatagctgaatagtattccactgtatggataggccacattttgtttgcctatcctttcactgatggacatttgagctgcttctacttcctcactattatgagcaatgctgctatgagcatgcatttgcaaacagttattcttatttaaatgtgaattagcagtgcrtatacacacccaaaattgggtcatcaaagccatgattttattgataatgatcaaggatttcttctttacacaaattcattagagcacaaatgtcaatgtctaggacaattttataggacaatctgaagaaagcaacagctcagctggaatgtggatatggttgaagtcatyagtttaatcatatctgcagagtttcttttgccatataaggtaacactcacaggtcctgggaattattaggatcaggatattgttggggtcctttttcagtctgccatatacactgtggcctgaaggttcattaagagttaactgggagaccagagcataaggggtgctccaggcagagggcacagcatgtgcagaggccctggggcaagaggcagcctggtatgtgcaagaagaaaagagatgcacggctggaaagagacacaggcttttattggccaaattaaggacttgggtcagcatccaaaggacaaagagatgccactaaagaatctcaaaaaaaggagtgataagttgattggcattttagtagatgctgtggccacattgtagatgggcaaagtagagggaaataattgtggattcagaagaagttaggaagctgttgcaatagttctggtgagaggtggccaaggcaaaggttagtgtgtgaccgtgaggaccaaaggaagaggacagtcacaggcatctgtgacttacagctgaccagctctgctttgctacttcattcgttgattccacaagtgcgtattgagatctcaacatggggaaggtgttatgcatggtgctgggaatgaaatgctgagccaactgtgcaatcctggacaggttaattaacatttaggcctcagtttccccaagatatgataatgttcattttttttggagtgtcatgaatattaagtgagtgaatggaaggaaagagcttaggacagtgcttgacacagaggaagtatttggagcagcaagcaagagaaaaagaaggaacgaaggaaaggaaggaagggagggagggagggaaggaaggaaggagagaggaagagaaagagaaacaaagaaaagaaaaggaaaaaaaggaaagaaggaaagaaggaaggaaaggaaggaaggaaggaagaaaagaaaagaaaagaaagaaacccatggacacccacagaaacaaccaccctggctttggccctcctctctctagagtagtcattgaaaaattcacccaggacaacatttgcatgaacacccaggaaatgggtggcatatggcatttggcattatgaggcattgagaaatcctttccgtaatatccactgagtatatactgtgagccaaaactatgatagckgctatgggggaaaaatgagtaaaaaccaacagtcattgtcttcatagagcttacaatgtagttggggggaccaatattagtcaaataagcatartaagaaagatagtacaaggtaagagggggaagaccatgttgcaagagagtctttggtgggctgagttgacctgaccacggtagtcatggaaggtctccttgtggacgtgatccttggggtgaatcaagaggatgaggtggtgttaactgagcaagaatgggtagaaagaacatcacagggagagagaaaagggtgagcaaaggtcctgtggccagtgggaatgcagtgagtgtgggtgtagataaggctggagaggccaccaagagctgaacacccatggaaccttgtagaacaggctgatgggttttgtctttatactaatggaaatgggaaatccttaaagtatattaagttatatggagatatatacagagatgcatctttggaaagatgattctggtttgagtgttaaggggagatggagaaggagataagagaaatgtccactaggggactaccatattggttcaaacaagagacagcaattaggtggtagagatggggagaaggtgccacttcgagggctgtttaggagagaaaatcaacagyagcactagtgataaattgagcagaagaggtaatggagggtcaggtggccaggataacaccagcatttcttgactggtgcaatcgaaattgaaatggggatgttgcggatggaggtaactcatgccacaggtgtttcatcttctcagtaaagcagaagcctggctcatttgctgaaaaagagtgcattgagaactaaggcagaattttaaggacgtacaaacatttttgaatggcagctgtggggattcgagcaacaagaatgacttgcagaagtgatgacttaattgaaatcaaattgaaatacatagaaaccacagatttggagtaggcatttcatttgatatgtctcaaaggcccagcaggatgctctatctacaaagaaggtacagaataagtatttgttgagcaagtagataaaaccaaagagcgattttgcatgactttcctgagccaactgggacaatgaattggctgatctatgcacaaaaatttgtcctgctatatttctttccatggcaatccctgtgtagaactttaggctgcaacctaaaggtgaaatgcacttaatttggcttgaataatttacttggattcttccttatcaacaagacttgaatatataatgtatttgaatttgaatttggtagttatatgattgtttaattcttggggattggaatatgagggagataggaagaaaaggaaaaggaaccatttgctcacactctggcagatctaaagaaggtttcattactgtagggcttctcagaacyttcagtaccctaagacagaagcttcttagacattatttgttctacaggaaaaaaaaagtgttgcaaagaatagctacatatagttmttatctaatatagtggcattctatggaaagaaataaatctatattagattaccttgaatttgagaatatcacattttagccccttggaaggaattgtactctggaattatatctttggaatatctgatcaggccattataccaatcttcccatgtttcctaccatatttctaaaagaatattattttataccataactatattcaacatagtgcctatttctctattgccttcctaggaatttaattttgttgtctaaatgggggaagtctgtttcctttcccagttacggcccaaataataaatgttgatgttaccgtgctataaaaatatgtcctctataaattgctttgcttgtcattaagatgtttcctaaacaagttgaatatgcgctatgtttttgccagacacttgaagcaatcttaaattacctgctgtgtctacacatattcagaaggccataatagaaatgtgccgagtggctcaggagaaaatcatttataaagattagaggaggacttgggaagctctgcctcttgttgcttggattgtgcacaaatacatttatttctgggtatgtttaggttatttcttttcagatttmttttggtttacaccgtttcccaagcattagtcatcactgtcccctgaagcagtcacactatactcatctccgtagatgatcaatcagaatcttgagagtgaaatgaccagttaagacagaccaacaatttgttgatctagtggaggcggaaaaaatgsagtctgaattgaaatgacttttatgagatttcacccaggtggttgtttctaaatttatactcaaaatatagagtgaaacttgagagaacatttgcaagaaggaatgtgatcctaaaataataggatgtccttgttgggtgagttgaggaagtatgatagagccatagaggaaaagggtagattggcrtcgacttagtagcgctgacgatcatttttatcagggatgtggatgtaggcacagaaagaaaggcatagctcttagattagcagaagagacaaggttggaaggaataattgtccagttagaatgcataatctgtttttaaagacatattaaactggaataacccatgtacaagtatttatccagcttrgatacctggaagtggaattcctggttgaaaggtatattaatataaaattttgtaaaaaaatatatgttagataatgcttagtcatccttcgcaaatatcatgccaatctacatttcaactaccagggcacacacttgaacccatataaacagtggtctattctgaggacttttcagaacttttattaaacsaagatwcattgtaaatctttgagggagtcatctggcatacaaagtgttttcgaaactttgattttaaaggaactcatactaacatcttgagaatctagtatccttagaacagtggtccccaacctttcttggcaccagggaccggttttgtggaagacaatttttctgtgggcaagggtgggggatggtttcaggatgaaactattgcacctcagatcatcaggcattagttagattctcataaggaacatgcaacctagatccctcacacgtgcagttcacagtagggttcacgcttctatgagaatctaatgccatggctgatctgacaggaggcggagctcaggtggtcatgctcactcacttgccactcccctcctgctgtgcgactcggttcctaacaggccatggaccagcactggtgtgtagccagggggctggagacccctgccttagaacacaattcaagaaatgctagtccacatgaaagtgaaaggctgaaaacttgcagaaaaggaaaaccgaaacattgaaagagggaaaatctgacaggagaaggcacagagatgagcatgagggccatttgttgaagtgttggtaacagygataatgataattctagctgatattttcagagcattttctacgtgtcactcatggagtcctcacaagaacttcacgaaataggtactgtaattattcccatttcatagatgaagcaattgcagcatagggagatgaagtaccttgtccaaggtcatgcgaataggttagacttattcactctgtgtggccccagaggaggaatggttctagaaagaaatattttagcttaatatttgaagaagggctccagcagtcagaaactgggcatcatctattagggatatctccctgagggagaatttgagcgtgattaattccctgacattccattggtggaactcattctttgactttagataaaattctcttgcttctgaatctctgctaatttaggtggtttgtcctggacaagactgatttttaaaattctttatgttattgtcaataaattttttttttttttttttgagatggagtctcactctgtcaccaggctggagttcagtggatccatctaggctaacttcaatctccgcctcccaggttgaagccactctcctgcttcagcctcccgagtagctggtgttggaggccgaaagattgagggtcgtgatcaactcagtataccactggaggctatatgagtaagcgccaaactggtcttcataaatgcagaatgttggcagaccgacaaactgcgtctgctgcccygaaggagtgctgaagacagtcacccccgatgcgcagtgtttcttgtgattaggtacatctgaagcctgttagtaataatataaacctgtgttcagttaagcagctgaccagtcattaccacctcctccttgctctttctacccaataaatacaaagggctctagaagctcaggggtgcctttgctcactagaagcagggagctctcttcttcttccccagaccsttcctttaaaacagtttcttttgtcttaagtttccatttctacgtttgtccctttgttcagtctcgtaatgacactctcaagtagtaacagtagtaactgtcctaatgacatctcaagtagtaactgttgtcatgatggtctcaagtagtaacagtagtaactgttgtagtgactggtctcaagtagtaattgcggcagtcagccacagctggaattacaggcatgcaccaccacacccagctaatttttgtatttttagtagagatgggttttcaccatgttggccaggatggtcttgatctcccaacctcaaatgatccgcccgcctcagcctcccaaagtgctgggattataggcgtgagccactgcacctggcctattgtcaataaaatatttttatatccatgatgccagtttgtttggtaaatgtgactacagagcccagggtgaaaagatgtagaaattgtcttgggatcatcttgacgtctcctggttggagtattcatgttcactcccrctcaatccccaggtcatatggcagtctaatctcagactctcagcccagctgccacctccagcctctggcctacactagtgcccagtggtgagcaaagatgttgggaagaaatctggatgcatctaaccctgctgcctgttgagtatcaggaagctgcccaacactcttccttagaaaggttttaacatgtcataatattgaggcattgaaaatctaaatgaattcttctgattgttccagagaagctatggaaatatgatcacttcattatcctttaccaaatgttcattgcatgtcttcagtccctcacattcccaccagctcctctcttctttgcctgaccaaccttactcatcctttgaggcatgtggcagagatcgtgtgttcactaaactctgtttgttttcactcttggccatagttagacttaattttccaaagttccttgcagttaggcagggccatgaaacagacaatggaatttggtagaagtcatcaaaccactccttcctctcctcaccttctttccccatccacaagctgaaccaaggactccaaaggtctagaggaaggcacagcccaagatggaaggacctgaatccctgactcccccaagacattgagcaaagtggaagaaattcatggttggtttttaagctctttagaaacagtggtttatttgttgcagcagttaatgttgctctgcctaacataagactctgctctaccacatcaggtttcttcatgggtaaagtaaggtcttctcctatgagaatgyatagagccctagacagagcttgcatcatagctttagaatgcaagccccatgggacagaggctgtgtctttcttatccatcattgtacccattccctagcaagtgtccagcatttggaagmaagtcaataaatactagctattattgctattagtattaatgtgttagcgttgtctgacccttgctccttacagtgtaggccatgggccaccatggcatcaccccagagcttgctagaaatgcagagcctcaggcctcatgctagtcttattgaattagcatctgcattttaacaagactctcaggtgaggccattcctgctgaggtgcacatactaatatttgaaagacatcactctagaccagcagttctgagccttggttgcaccttagagtcaccctatcagaattcctatcagaatctggttttgtttttgttttaaggcttcccagatgaatgtaatgtgcagccaggattgcaaactactgctccatctcagtagttctcaaacactagcctgcggcagaatcccctgggtgttaggtgcgtatcacaacacagattgctggatcacctccccacactgcctgattcagtatgtctggcatagggaccaataacgtgcatttctcccaacttcccaggtgcattcgtttgcaacggctgtsgtaacaaagcatcataaactaagtggcttacaacagcagaaatgtattctcccatggttctggaagccagaactctgaaatcaaggtgttggcaaagccatgctctggcagctagtccaggggagaatccttccttgtgtcttccagcttctgatgtttgccagcaacccttggagctctttggcttgcagaagcatccaccactccagtcctctgtctttacacggctgtctccgtgtgtgtcttcacattgttttcctygtctgaacatctgtctctgtgtcctaatttctcatttttataagaacaccaatcatattggcttagggcccgtgctcatgacctcattttatcttgtttacctctacaaagacttcactttcaaataaagtcacattctgagatattaagggctaagacaatcaacataagctttttgaggggacataattcaacttacaacagcaagtgatactgatgctgctggtctagcaaccccagcttgagaacgactgccttgttgtgagctgcaaaagtgcaaagacaacattcctttctttcagtacatcctacccagagtgtagcttggcgcttggcacatcgtatgttttaagtaactataggttgaattaattaatattctttccacacagcaatttggcctgcataaaagacttcratattttcytgatgttgccagaggcttaatgtgtgacatttcgtatagcaaatgctcaataaatgttgggtgagtgaacatagctgtcactcctcattacatattttaaaaacaaccttagtgggccttcatgcttttattccaccttatggagcccaatgacagaatgctgattaaatgacatggctcctttaatgggaaattaacaatctacaaaatgttgtggattcagtaataggcatttgaggcgctgactatgatgatttgttgcttgccttgccttgattccccagtgagaattcatctctatttagcaagtgctgtgatctactccagtaaaggagatctctttctttgaatcccagcaacctctagcttggtctttagcttcatatatcactgttaattttcacctaagtcagtggttctcaactgggggtgattgtgctcctcaggggacagacattagagacatgttttggttgtctgtcgtgagagcagagtgtattcccattccccagctgggaccagsgggtatgctgctctcatctaatggacagtggccaggggtgctgctgaacatcctacagtacataacacagttctcatcgctacagagaatctctggccccaaacgtcagtagtgccagcgtagataaaccctgacctaagcaaagacaaaatggacatgaagttgcctcaatgggcaagaccaagacttctgagccaccccatcagtgacacttgatgtagccsgtagcaggagtgccagggagaacacagctttgttgttccatatccagctgtttggatcagagggaaatgggatctttcaatcactrctgcagtatgagaaagtgagctgcacccagtggttactaggtggggtgctctgtgcagtgtgcttcgagcacaccctctcactgaatgtgagatgatgctcccactcgcagtgtctctgaggtgagaactattacagtccccacattgcagaagaggagtctccagcactgagactgagtagttcacccaatgtcatatagggtggagtgttaaagtcctaaataaaacccagtctrtaggacgattgagtctgtgattttaatccctgtgtagtctgggtttacatttccattcagattcctgctccaacatttcctatagatgctcctcaacttacgatgggtttatgacccgataaacccatcgtaagttgaaaattatcattaagtcaaaaatgtatttaatacacataacctgctaaacgccatagcttagcctaccctaccttaaacacactgagaacacttccagtacagtattcaataaattacatgagatgtttaacacttcgttataaaataggcattatgtcagatgattcatcccaacatcacaagaggatatggcaccacatgttgctaacccagaaaaagactagaattcaaaatttgaaatacagtttctattgaatgcatatcactttcatactattgtgaagtcaaaaaattatgagtgaaatcatcgtaagtcagggactctctctagctgcattgtgytgggcaagggatttaaccctcaccgtctttgtttcctcatctgcaaaatgaggatttataacagttcaaagggtatctactaggattaaaagatacaaaatacatctaacaatgtctggccacagtataagctcaataaatgttagttcttctccccgttagccgtcattacattcacaggtattaagaaagagaaatgtataggtatgatatgtaattctcttagttaatgagactttccttaaactaactagaagattccattcactggaaacatacttaatgatgaagcttttattctgttcatctccttcagggagtacttaaaaataactcacaagcccattgttagagctcatgttctttacccaaccaggatttaattagtccttcagctccttagcccttcttagaagttgttcgatgttaaatcccacatgacccttgggtgggaaggtgtggaaaccctccaagcaccatctgacatacccagtgactaggaagacttcacagtaagagttaaggatttttaaagattgccgatgttaatgaagaaggaaaaaaaatagtggatgtgctaaattagatatttacaaattatgttcctctctccaggggaagattcattaattttcaccgtaaccagcttcattctattgggacaccagaggaggatttgcagattacagatccagccacatctttctcatgcttaaagaagtctcattgtctgcactgtccagagaggggaaagtccactgcctggacaaggccttcatggctgttcacaacctgccccagcctccagtccattacccttgcctattttgttgcagtgatggaattaaagtmcttctaatgaaaaaggctgtaggtgaattttaatccattagccatctaccagacctcctctgccatcctttagactctccatacagttcctctccctgccgtatcttcttgtgtgtcaatatttatatcaagcaagccctcctcatctgcccaccctttatctgccaggctaagtccaactcctacttcaagaccgcattcaaataatgcctcctgtctgcagctttcctcagcttccccatggagaattgatggctccctttctttgagcrtattcattcattcattcattcattcaatgacaactatctaccaggagctgttctaagcattggggtgtggaggtgaayaagaaagcatagagccattgttctagctggggaaccaatatgaagtaaaacataagctaatacttaagtccagaagttcagaagtgataagtgctctgaggaaaatatggagtgatgaggaagagtgaaattggcagagtgaagagtgatatttgatgaggcaatcagaaagagccattgtgaggtgaggtttgggctaaaacctgcayaatgagagggaagcatccatcctccaagtgtagagcgtgggacgtcttggtagatacctcaccagctcttcccttctcagaggctctgaactcctrgagggtggcactcttggcatccccagactcttggcatccccagtactttgtccggaattcatgcatagcagcagatagccacaggtgatggctcaagtgccttcatttaatttaacttaaaattttattttcggttgtacctgttatgcatttgttagccatactactggttttttttttttttaatcaaagaagaaaatagctattgcttcttttttttttctctgggttcaagacgttctggaaacaaagtttgaaaaatccatttaggaaatgcaatttaagtgccagataacatcttgggattggcgccatgatcgatgaggtctgggtgtaaccaacgtcttatgccatgtctctgatctttactcaaattcacctcctattctgggtagygaagtttggggagacccagtggtgtggagagagggttgtgtttagcttctctttccctgacctcagagtaaacaccagccatctgcataacagcagtgcccttycatagtacttattaggctattgttactcagttgatgtcagttggtgccactagacagagggcactgcagccccatggccatgtctgtctttctgaaagattcaagtgccagtctctttgcatctggcacacagtaggtactctgaaaagacttgcaaaatgcagaaatgaatgaatgaaggcacaacaaaaacacggaccggaagggacacctccggtcctgaacagcctggcttcaacttcaaggaccacagttggcttgaattttaatccatcaggtcatctccatgtgttcactttcttccataaaggtgaatgtgtcaagcactgtgcaagctgccaggagaatggtggagtatgataaccatctagtgggggaggcaaacttgaatcgaatgatggcacaaataagtgtggaattatagagtatggtaaaagctaagaaggaaaggcaaayagggcttcaagagtacacagcagtgagcctggacccagggggatgtgggaagcccaggaacctggataagtggctgttgttgtttaatctattttttagctttcattttagtttcagaggtacatgtgcaaatttgttacataggtaaactcatgccatgggggtttggtgtacagattattttgtcacctgggtactaagtatccaatagttgtttttttctgatcttcttctcccaccatctaccctcaagtaggccctagtgtgtgttgttcccctttgtgtgtccatgctttctcattatttagctcccacttataagcgagtacatgcagtatttggttttctgttcctgggttagtttgctaaggataatggcctccagctccatccatgttcctgcaaaggacatgatctttcttttttatggctgcatagtattccatggtatatacgtaccacattttctttatccagtctacagttgatgggcatttagtttgcttccatgtctttgctatagtgaatagtgctgcagtgaacatatgcgtgcatgggtctttgtggtagaatgaagtcactgttgagccttgacctccaaggctgaaatagataaaggagtgaggagggtgttgtagtgggaagctgtggcctgcagaagctatcctggggcatcaggagctgctgggggagggaaatggtataagacagcagacsaggcagaccaagactgggttctgtaagctctgctaggaatcttccttggtatctgcagagcacaggaaagcttttgagagatttcagtggggagatgatatatgcagagctgagtctggaattatcacctgggctgcttgctgccagatagattggagcaggaagggggggatgggaagctagccaagagcaggtgtccaggtgggagagaatggtcacttaaacctagtgggggtgccagggtggggagaggtagacagattgaggtgatatttaggaggcaaactcaacaggccttggtgatggcttatttagctcagtggtcctaaaccagggacagttgtgtcttccaaggaacacctggaaatatccagatattttttggttgttgcaactggctgggagattggtgggaaggggatgctactagcatttcataggtaaaaactaaggatgtggctaaatatcctacaatgcaaagggcagcccctcccccaacagcaaagctttatctggccccagtgtccrtagcgcagtggttgagaaacctggcttcagatgtagaaacatcagagatgcagtgtcagaggtgatctttgggtcttgtcttgctaacaaggtgaaaggtcatgccattctctgagatattgggaccccggatagccagttcttttacaaggggtatgtggtgtcaatggagaccagaagatgggttcctgaggcatttggagacatccaagtgaggagatggcttgttttcttcctaaattttcaccatcccccacaagrcagcctttttttttctctgttaatgaagtttccagccaccttaccctggattctcaccttccaaccccctgccttccaatattccacccctcttttttctgccctagaagagaaamctatgatccttgcattagaatggttttcctgccatcastattgcaaaatagacaagggtaaaagaaagccttcagtagaatttcatctgagtattttctttgcccccttgtgtgtcattttctccttaagaaaactgaggaagaagtgygatttagtcccctcatctgcataattttcttccctgtgtggctgtgtgcttgtcagtgctctgacagatcaagagtgctctgaaagctcagaggagcaggaagagacccaggtgacctggtgagagccacgctgaatctcggttcacatgtcrttaacggagcttggtccttggagggccttgtggggaaggacgcagacaagctgtgatggagtccttgggtctcacctgggagagcccacgggagcacctgtgagttggttccgagaaaacatcccactctccaggtcacctctctgtgcttcaccccacctctcattcttcttttgtscaaagcacctatttggaagtaaaatatcagctagaaaggaaaggagtttcagaagaaagtaccacatcagcgttttgaacaaattaagttgtgtgcaagctgagcagcctgtatcaaggggaacgtggtagagggatgtgagcctcaggctgcctgctgccggttgcaggctgccatatgcttcacctgcttgtgccctcgagggtccccttctggggtccccagtctggcttatgatcatattccagcatagagcactccctaascscactcccgtagcactgggactatagctttatttcttgcatcatttttctctacgctcaaaaaaaaaaaaaagcaaaaacaaacaaaaaaaatctgctcagcatgagaaatcaagttaatgaaaacgctaccgcattgaatttccaataagagaaaggcaaagcaaaacttgtyaactaaagaaaggggcattcactgtaatcccttcgaggagaggtggaagcaggagtaatacaaaagctcattactgtaatcaaggcatttgtaactgttggtggcaggaggtgaaagagagagagagacagagaggggaagactctgacggaggttttaactgtatgcatgccagtctttcccactcgtcttgctggtacaatctggatcgttcatatagaaaggagacagggtttgccaaacttggctgaccaagccaaaaacactaattagcagcagctgctcaaaattggggatgctcttgccttctagtgcaggggtgatgacttgttctgactcttcaagattcacaaccttagactgcaggatgcactttgccaggggaaatgtattctccaacgtggctgtgtgcattggtgctcaaacattggtgaagccccaagtacttgagagggacaaacaaaacacctgtggaatctcttggtcagctggccagcaggagtttgaagycagggtgaactcaaagcattctcccaaagaagcctttttcaaccagggggcrctgacagaagttgtcaacacgtctggcaaagctttccagcatctgctatgatgtcttaatcctcctgtgaggagtgacagaggtaatgtgtggcatggagccatcagtgacatttggtgattgaatgttgctggtggcagtgtcttaatgatggagacaattsattgataggaggtcaactgccaagcagttaatccgatggcaaattccgctcataatggaagagctggcccatgcatgcaaaccagcatggtgggggattcctgctgatgcagctgtgggcacatgaggagggggaaagatatcaatgcctctgatgaatgtctagcaaagttttccttgtgaaacctcatggaaagttccatgaggycagagatcacatctactttgttcactgttctatcctttgttgctgacacatagtggccattcagtaaacatctgttaaatcgaggaagcagtgaatgagttggaagctgccttccttargctgttttacttccagaattctactttttcactgacagtaagcctaacctctcargttagaaatctaagttgccttgcattcctccctctctcttccccaccaagctctgcatattccatctcargaataaatctctaacatttctcccttgtcttctttctctgaagccaatttgcatctcccaagtagtcttctgatgagtaagcctacccccatctctgttccatggcccccttaagtcatttatctatctatctatctatctatctatctatctatctatctatctatctttgagacagcttctcactccatcatccaggctggtgtacagtggcatgatctcagctccctgcaaactccgcctcccgggttcaagtgattctcgtgtctcagcctcccaagtagctgggattacaggtgtacacmaccacacctggctaatttttgtgtttttagtagagacaaggtttcaccatgttgagcaggtgaccccaagtgatccacctgcctcggcctcccatagtgctgggattacaggcatgagtcaccgcccctggcttaattcttttaacatgtaagtctcatcatgttacaaccctgctttacatagtcaaagtcaacaagtgttatttggccatagatatctcttaggccatgacaacccacctcctagtaccttcccagccttgggttaacttcatgtcagtgctcrcattggtgcttcactgtgtgctgtgtcttacctttcaaacacccattctgcatcttcttgtttcctaatctttgctcatgtattcactcaggctggacatccaagcttctcttttttttcctagcaaaacactgtctttgtttaagatgtgtcatctggggacctttttctgattcttgtcctcccttggagaaataaatgcatctccctttcctttcttccatttttcatcactttgtacttgaattgtcgatttgtctacccatctcacctgctggcctatgaaggtgtcaagtcaggggccataacatctttttcactgttccttccagcaactaatatggttcctggcacataattacttaatgttagttgaaagaaaaaatggatggatgaatggatggatggatggatgggtagataagtggataggtggatggatgggttggttagcgggttaataagtaatgggttagatgcatgacaaaatgaatggaataagtaattgaatggattcataaactgattcattccaggggaatactaagaaaatagcaactccaccacctcccaccttgggataaatgatatggccctgtccagggaaggctgagtgccctttgtcctcagacagtgaattctggagttccaggtacatgagcatcagggtgtgatctagaaagsagcctgtggacctagttgggcgtattctcttggtcctggggattctttgtgccatggagaagagcatagtttgagggaggtcagaatgggaggccagaacccagctgcttatgtctaaagccattatcttaccaggaaatgactaagacatatgggaaaggaaatgccaatctggtaactcctgtaactgtcagttccagtggaggatgcaccaattgctcgtgctcacatgctaaatcctttctccagacatcaccctggcatggcmctccgtctcctagtcaggcattaactaataggggaaatgcaaaatgttgataccgcagaatatagagacagaagagattcacactgaaagtgcaaattactttttytgcagtgaatagaaagtcacattactctaagaagctgcctaattatctgtaattatgcccaaaatagtcaagctagtttgctagccagttgaagaattgcatcttaaatgaatttgtcactaaagaaagaatgttgaaacctggcaaaagagattactgtatttcaggggaaagattagaacatatcatgcctgtgttcagtctttcaaagacgtggttattggctgggcgcagtggctcacacctgtaatccagctctttgggaggccaaggtcggcagatcacaaggtcaggagttcgagaccagcctgaccaatatggtgaaaccctgtctctactaaaatgacaaaaattagccgggagtggtggcacrcacctgtaattccagttattcgggaggctgaggcaggagaatcgcttgaacccaggaggcagaggttgcagtgagccgagatcgcgtcactgcaccctagcctgggcgacagagtgagactccatctcaaaaaaaaaaaaaaagtgactgtggttattgtaaacatttttgcttaggaagcatttattacagctgttcaatgtagcattttacggtattcggtggaaactctaatgtaagttcggagcagtcctaacattccaagagttaaaattatccatgattgggatgtaatatctaaattgaaataaataaactgtttttatatgaaggattttttcctgattsaaataaaggaatctagtttcattgtaggcaacacaggaaatacaaaagttataaaattcacatctgtaatcccatcaaccagagaaaactcttagtaactagtgggtgtttcttgctagctcttttctatgcatatgtttttcttataacactggaattttaatatatacaacattgtttagttacattcttccatgtaactttcatgagcatttttatctgccctgtaggaatcaaagtgatgggttttttttgttgttgttgtatttttttctcagatggagtatcgctctgtcgcccaggctggagtgctgaggcacggtcttggctcactgcaacctctgcctcttgrgttcaagccattttcctgcatcagcctcccaagtagttgggattacaggcacccaccaccacacttggctaatttttgtatttttagtagagatggggtttcataatgttggctaggctggtcttgaactcctgacctcaggtgatccacctgccttggcctcccaaagtgctgggattacaggcgtgagccaccacacccagcccaaagtcatggtttttaaatgccaacataatattcaccatttttacatactgttgtttacttaaccaccaatttattgtagataattttgtgtcttttataggtatttataaacgattctgcagtgaacattcttgtacagatataattgcctgtgtctctgtctgttttcttaataatgcctaggaatggaattactaggtcaaaaggtatgatcattttaggaggttatagattagacctcaatgtagcagtgccatttctgtctgtgaatctttctttctagatctttctaaaccagggtatagaaatagaaggtaaaatcctcttggacagaaaagaaaagaagcagtgaacacttacttaaaaaaaaaataggcaatggaggagagccaaaatttgaactccagcctgaaaatcacaggatccctggagacaggaatatgcactggcaggcaacagaaagccaaacagaaatgagatcgaagaagagrtaggaaaacaaaacatttcaaaggaggcatagaaaggagcatataatggtgatggaggcaacgataagtaggcaatggaaagtagagaagaaaaatagcagcatggctgtgaaggaagggaacacgaacttctgcaaaagctgtcagaatcaaaatgaagccacttatgttaaaattttttttaattaataatcaatttaaaaccctgaaaaatgagctgaggarggttatgaagaggggagtctcacacttggttgcctgataacaaaaactgtcacaaaagactgcaaaaaccacaaccttgcacaaaggccatcacaaccttacacacacacacgcacacacacaaatacttctgcaaggacatctgcccagcaactgcctgtccaagtacagactgatgtcacccttattattgatctttgtagccarcaataactacttcaaagccattatgtaatcttcctcattttttccttcaaaaacatttgtctttctttacctccctgcacacacatacaaagttactgcagcacatgtattcccattgcaatgccctactgctgaatcttttttttttttttttttttagagaacctctccctctttgttatttaggttgatgcttcctgaggccacccctgtgccacacagacagaaccctgcggggccagaggtggagggtaggagccattgagtgaaaaagcaagtcaacatctaccagcttgcagcccctcactgaccatgttgtatacagagagagcgagctactttggtacttcatcaaccagacagttcagcagcttgaaagaggggagatttttccatgttgcagagtgacaagttgatatacaatgtttatggagaccatggtttgtacagtggtaaactcaagcacagaaacaggcataggggtatcttagaaccttgctgctcaaagtacagtccatggaccagcagcattgaaaacacctggaagatttttagactttcagaaaccaagaccctgcctgccccaggcctgtggaatcatagtttgcagtttaactgattccccaggtgattcatatacacattaaaatttgagaagtgctgtcttaaaagacatctttttatatgaatttcagactttgctggtgcttggatttccagtgttcactggaaaagccgaaagatttatgtgagcacttagttgactgaattgcatgtgattttagaagagggatttccagatgtaaagttaaaacatgatgtgtgatacttagcataagtggagaaaaccaattgataagcccaaggctaagtggaaccattctgactttttgagaaacgcaatctgtttgggggatagtttctaaagttcatcagaagaggtgtcattaaatcagattttaagcagaatatagcagtttggctaatgttggatagtctgtctgctcccaattccagaaagtaaaatattttgcaattgaggattgtaaacatcttagacagttgcaaggactgtacatgacatatccatgcaagagtattcygttctgtttctatcagcttcttatgctttttcaatgggaaatagttttggaataatgggctcattagagatagacaaagctatggcctgggggaagtaacactggtacccagagggttttaactgtttcactmcctttcccagtgactcaaactatgcaccagtattaattttaaatgactttacaaaaagacttaatgagataaatcgtgtaggcacagtataaaagttagtctttcatgttgtgtctgcctgcagcagcgttctaactcaaacgttaggagaggcttagagacaatttgggtctagcatcaaatcagataaactatcatttttaattattgttattttgataaggacttcatagtctcttaagtaagccagccctaaaaatccttgctcatgtttttaaatggtaagggagattctgcaaagatagtatgaggaagcaggaggaggaggcaaatactggttaaatgccttgtctaaatccaccacagtcctcagcatcatcatgaacaaattgcagcagttatgcaccaagcaggatgcaaagcaggaaacacacattctcacatgcggtggtcaatcagccaagtaaagccaaagttgttgttgttcccagttcaaagatgaggaaattgaasctcggaggggtcaaataactcatccccaatcacaaagccattaagtggttctgtcaggatttgaatccatagcctaagttcatcaccacattcttctccttgtctcagtttcggtatttctcasaaatcaagggacmtggagagaaacagaaactatttccacaacatcaagaatgtcacttagaatcaatattggcctggcttcgataacttacctaacagagaggtaatcttttcatggggcaccccayacttcacgccacacttaggcaagaagaaatgttcacagtctyagctgatgccagggaactttacagcaaaggaaacgttgaagcgyctcctgggctgtgtccctccatccctgtgcctctgtcatcctgtctacagattctcatgacagcaatgacaactctcaaccgattttctacataaggggtccccgacccccaggcctgtaggaaccaggccccacagcaggagaggtgagcagtgggtgagcgaacraagcttcatctgtgtttacaggcactccccattgctcscattacttcctgagctcctcctcctgtcagatgagtggcagcattagagtctcataggagtatgaaccttattgtcaactgcatgtgagggatctaggttgtacgctagttatgagaatctaatgcctgatagtctgtcacgtctcccatcacccccagatgagaccatctagttgaaggaaaacaagctcaggactcccacagattccacattatggcgagttgtataattatttcattatacattagaatgtaataataatagaaataaagtgcacaataaatgtaatgggcttgactcatcccaaaaccatccccactctggtccgtggaaaaattgccttccacaaaactggtccctcatgctgaaaaggttggggactgatgttctatgtatatgatagaacatgttactgacatgttacattatatgtactattctgtgttgaagcaaacgaagctctctgtaagcctttcggaaatagtacagatacggaaacaggggcatctaaaagtcggccatcaggcactcagggtgasatactctgcttgccctttgttataggaaatgccctggagttgagtctgggaggtactgggaggtgtctcagcaggagataagcagcggggacttgccgtcttcctagatagtactgttacttggttggtacctttcatctcaatgcccatttgtgataccagtttgaccccagtagcacccaatttcagacttccccagccacctgtgacttagagtgagtagagaggcaattagggcacatgcttcgatcattttgagtgacagagtcttccagataaaaacaatataaaagagagactgctaagggtctctggggtgaagggtctatagatccgtcacttccacagggaagattgcttttcttggttgtttgctgagacctggggggcattgagcactgggaaatcaatgattgtacagctttatataaaaagggcacccagcaatgctcacacagtctacagggctcatttcttcctgaggcagaagagttttgctacactgacaagaatccttctggctggacacagtatgtcacctgttgtagaggggctagagtttgagaccatcacatttgctttctgcaagccctgaagatttaagagtgaacctacattgtttattgggatgttcgcaggttgtagtggtaagattggatcagcgcggtaccagttagcagagagggatgatgtttttaaagagtcttccagcagccacaaacatctatgaaagatacttccatcaaaaacaaagcttgaagtcaaaaaaaatggggaatttaagagcatctagatttatctgttatgtgcaacaacttcttacctgactggttgtgccttgggtagtatcactggtgccttatgcatgaataatgtatgtataatgtatgtgtcactgccttagaataagcaacgtggaccacaggtcttgggcaccttaaataatttatatttaaaatctacatctagtcagagatgcatctgcatctacatgtaacatttatgaatgcaagtggaactttttttcccttttttttcaaaagctaaattgcctgtatttgagtgttagtgttccaattaatttagttgacatcatttcaactttgttggaatacctactacttacagtaagttatgtgggcccttgttatgaattaatgagagcaacagagaaataacttcagggaaagggtacatctttaaataatttacccaygtgggtaggtaggaaaactggatctgtggtcatgcgtagtgtgcgggtatccgaagctgggtgtccacagtcacatcgggtcctctgtatctgtggcacragggcagacagagaggtcagtgtccaacaccrtgggaggaccacaggctcacctccctcartggggtcagcatctcataaattagtcatgctggagycctctccaggagttcctggtgggagctaaagggaaggtgaactcctttcttttaaacactgctatcatgtkaagatccactgccaggaactaggagggcagagtgaagacagagaaatgcaaagactgtattcygaaaagttaaggaagcagttctgtgggtraggatagtgaataataatrttgtgagttgttttgatgagccaggcaatgtgttgatcacytcacatgtagtatggtctttaatttttatttgaaaaactgaaggccagacatggtggttcacacctgtaatcccaacactttgggaggccgaggcaggtggatcacctgaggttgtgagttcaagagcagcctgagcaacatggagaaaccctgtctctactaaaaatatgaaattagctgggcatggtggygtgtacctataatcccagctactctggaggctgaggtgggagaatcacttgaacctgggagacagaggttgtggtgagccaagatcatgtcattgcactccagcttgggcaacaagagcgaaactgtataaaaagaragagagagagagagagaaaagaaggaaggaaggaaggaaagaaagagaaagaaaaagagagagagggwgggagggagcgagggaaggaaaaattgaaaaccctgaggtaggcaccttaattctacccatttttcaccttaattctaaccattttccagataacaagcacagagtggccaagcaactttcttactgtcacaaagaacagggattggaagccaagaagccgaaggcactacagcgtctttttgaaacttggtgctttcgtgcctgcccaaattctctgattaagaaagaattagtttcctaattcttttatttttaaaataaaaataaaagattaaatcagatcaaacagttggccaatatacatgttggttattcacacgatggaggcytcattgcctgatacatcccatactgacagtagcagatttggaactcatgaaaccctcatcscttcaacttcctgcaacaccccagctccttctaatagaacccagtgtctccttaattctttatgtgatgaatacgtattgagtagctactctgtgttagtccctggacaagagcagagcaaaggcaagaacgagataggagaggtctccctctcacagagtttggaatatagtagacatattcatagttctgactgggcaaaattcttctctcttacttttatccatagtttccagctctgaaacctaatgctacaaagataaaagttgcatttgatagataatgcaatggaacactactcagcctttaaaaaggagaaaatcctgccatttgcaacatcatggatgaacctggaggatgttatgctaagtgaaataaggcagactcaaaaggacaaatattgcacgttaccacatatgcagtgaatctaaaatggtcaaactcatggaagctgcatgggaaaatggttgcaggggcttgggggaggggattggtgtggtattagacaacagtacaaagtttcatttatacaagatgagcaactcctaaagacctactatttagagtttcacttaacattgtttctctgtaatgttgatgagaaaacaaaaatggtcattggtccctgggcctcccttctgtgtgctctgccgttgatgttacttagcttctttctctgtattgacatctttttgccttgctacctagttactaagtctctccaagtttctattccaaattcccaagagatcacaatgattgacgcaaccttaatcatatgagttggttcccctttggggtatgcccacctctggcccagtaagccatggtgctgtggcaaggacaagtgtaccataaggttggcccccccccccgccccaggggctgagggttgggcagattaacctggaagggaaagggtatgtctagcaaattagaacaagtaagaagtatgatcacctgtaagttcatgctacattttctggaggttttttttaattatttaattctcctctcagaccttctgtgactcccaaaccaataaaccatttttgtttggatgttgttcttttcttcccttgaaaaatactcattcaggttcttctctcattccttcaaaagagacttcaggccgggcgcagtggctcacacatataatcccagcactttgggaggctgaggtgggcagttcacctgaggttgggagtttgagaccagcctgaccaacatggagaaatcccatctctactaaaaaaaaaaaattagccaggtgtggtgacgcatgggaggctgaggcaggagaattatttgaacctgagaggcggaggttgtggtgagctgagattgtgccattgcacttcagcctgagcaacaagagggaaacaccatctcaaaaaaaaaaaaaaaaaacttcaagcaagggaggccatgctatcaaagtatattttcctcctcttctgcaaggggtctacatttaagtcaatagtagcacaatataagaagaaagactattaccagctaacatttattgagtatttactaggctatcagcastggtctaagcactttacaggttaaattcatgtatyttctacaatgatcttaagcagaatttccttcattttcttatttccaaaattatactacctaatatagaaggtgatgatgaattttgagagataatgtacctgaatttcttattgttcatggtatatgcrgaataaattgtgcctgctgattgctgtagtggtatcatcaactacaacattgttccacagctgagtggcatcactgttttgtagttccttaaaagagaccactgctctgaatctgactaaactgaagacagagcaccaaaatcaaatggggattcagatgtccaaaggatgggaggtgaatgataaaaatggttagagtcacaaattggaatccagtggagcgatagtgccgcagagtcaagatcctagagagcagaattctgagaaacccatgtccagagaatgtggtcaggaccttggagagctcatggtgatgtccaagtgtcttccacagtttagatctcagactagtgcaaaagtctgcatggggctccagccttgtaagggtctcatcttgttttatttggaggctctgacatagtggaastctgggtgccaaagggatagttcagaacaggaatcttctgacctggatagggcaatcaaattcttgattgtgttagtgcatcaggatccttgtcagataataagaacttttcatcttcctgtgtcagcagagttcagctctactaccagaatagaaaaaaaaattgcaaagtatatagcaaaaaattagcaaacagcaccaacttcttttcttatgtaacccacagtgaacaagaggcaattgtctcaatcggattcaggaacaacactgggttacatttggattctatgtatttttagatgtttaatttctatttgcctatttcatgaaagattggtaatcacacayaaatctgcatgagtaagaagagacccatgaaaataaatagtcctacagatgtaagatttgagataaaacatatcttaagtgaatagattgtctktgttcttcatgaaccttcaaccttcatgccacataggtttggtgaagaacgtttttgatgtctgttacccacatggagggtttctgcctgtctattttgggtagaagatacttagaacaaaagtmgtcttgaagggaggagaatatcaagaaataaatcatgtctgtgttcctataaaacyaataacaaacttggtaaacatgcatctgaaaaataactagaagtgctattctactgttactataaaggaccctgagtactgtagatttggttaaactgtgggtagccaagagggacgaggacctggattttgtcctgagcttttggcaggctggtagagggacaagtcccctttggataagtccccttttctctctgggtgtgtctcctcatctgtagtagaaggaccattggattagctggtctacaagattcctttcatgatcagaagtacagagtaagtatatgaatgatgcgtgaattaatgaacaaacttctccctgttgcsacattccaggaatagcccatggayttgcaaagagaggcaaaaaatggcawctaccagctgcttcctcttcttaggagtctccaacagagcctaataacatggggaagcattactaaattatgactttgtgcaagattattaactcggagtgaatggctattctttttggagattttaagcagtcatggaaccaggatggactcctgagatggacaactgcatttattcacttcaaacacaacatgataaaaatgtttttgaagctgtaattttacatcctgaaaaaaggttaaatttaaggcaatgtacaaagacaaagaatgactttgagcaaatgcattaattwggtttgagatgttcagartttaatgttgactaaattggttaatctgaagtcttttgggagtggtgacagttatcctgtccttactgtaatcaatgtgcttgatttggtggaaattttacatatagccttacgaatccttttgactgaagtgcaagtttcctctagaaacgaccagttttaggagggcgtgtgtgtatgtgtgtgtttgtgtaagaacacatactggacaagacttcttgaaaaacagactcagtagtgtcaagcagcatataactctccccaaaccaaagcctcctgccctattttctgcctttcctctgctccctggcagagctgacctaccatctctctcggtaacttggcaccactactatccagaaactgaagtgggatgggtcgttttgtttattccgtgaagttactgtgagtgcacatcctggaatctgagagatccagatctgaatctcagtctcttgtgtcttcacagcctgcctgtatgactgggataaacaaccttaaccattagtttcttcatctgcaaaatggggatgtagtaccttcctcacagagcagttatgagactaaatgaggtcaaatacgtgaaatgattagcaccttgcctggtgttttgcaagtaagtgttcaacatctgagaggcactactagtatcagtagtactgttggtatttatcaggtgccttctgtgtaccaggtaccaggtgaatccccagagatgaaaattggaccgagtctgtattttcaagtagctcaaaatctagcaagaaaaaatggcaggcaagcaagtaatcagggaacaattgggtaagtgaggtgacaataaggcattaacataaacccagacaaggggcagtaaggaggggaggggctgcttcttgaaaaaggtgacatatgggatgactctttttttttttttttttttttgttttgagatggagtctcactctgtcacccaggctggagtgcaatggcacaatctcagctcactgcaacctctgcctcctgggttcaagtgattctcctgcctcagtctgctgagtagctggtattacaggcatctgccaccacacccagctaatttttctatttttagtagagatggggtttcaccatgttggccaggctggtctcaaactcctgacctcaggtgatccacctccctcggcctcccaaagtgctgagattataggcatgagccattgcgcccagcagggatgaatcttaaaccaagtgacaaaaaggtaagaataatgactgatacattcagggatcagggatagtctgtgcagaggccagagagaagagtatggaggttggagaaaggcagccctcctctgccctggctccagagaccccatgtctgccacagcacaattgtctgagtcctgcagtaaatgctgtaaactgttgttgttggttttgttgttgttgttgttgttttgtttgtttgtttgttgttttcagttagaagcagtgtcattcatacaaatgaaataccaaacaggacccccatggcagaggcaacttctyattttatctcttgctcctcagcgcttttgagtctctccctgcatcacttccctgccctacacctgccaggtctgtgggtcctctttcatgtttgtagttctccmatactcttcaggcccagtgatccttttcagactcttgtcctctagaaaagcaattcagatctcgcccaaggcttacttctcggtttctggctataattgccctcatagtaccctgaycccagactcctactggatgccrtccgaaagagttctcgaagccctcatctgcgctataggcacagaccactctccccagccctgacaaccctgacctcacatgcccttggsatttccgttcctcttccactgttcttttttttttttttttttcttagttgcagagtttttcggaaggactgattaccgagtctcttctttccccaagagtacttctttgtcacaaatgattccactccttgaggacatttggtgacatttaattcatctcctgttctctgcttggatgaattctgggaactccctgagaggaaggacaaggcagtggaacatctgagcaatgcgatctttatgtggtgggtgaaggtgatggattttcatctccttcttcacgttttttcctgctgcatggggacctctgggcattctcctttctcttccttgcttttaactgatttattcttttcaggcttatgacttttcttttgtgataactgatttattattttctgataagttattcttttgtgataactgatttattcttttctggcttctgacttttcttttgtgataactgatttattattttctgataacttattcttttgtgataactgatttattcttttctggcttatgacttttcttttgtgataccagtttgtaaatgtgtaacttgtctgatctttcttctttcagcacccacctctcatgctatagcgtttgcactccattgcatattgtttaagactgggactcatttgagttgtaacgcaggtgtgagaagctttgcaaggctacagaactgtgttcatccgtctcttgacttggactatggaagttgccacctgctcagatgccctgaatggtatgttgggctctaaattggcctgacagtaccacagtcctcttccratttcttggggatgtccaggcattggataatggcagcccagttgcttctgcttgcagtggaaggaagggttggcatcgttccccagcacccaccrtttgctgggaaggaaggactgttcttccctttctttaacttgcacctcaatgcataaagaatatctgccctttccccaacatggggcaggggtggcctgctggaatgggagttccagcttctttctcaatcccttattcactcctgtcataggaagacaagttgctaaatgactgtgggaaaccgaaacacccttccagccacatatactgttagataaggttcctggctctcaaaggcagagccccacctccattctccattctccattctccctcttccactctctccatccaggtgcagcaagccrttttgtgcttcctgttccctggacccgcccaagccctgagcaggcatgggtttaccctccttgtaccatctaatgaggccgggcagagcatcagatgggaggttctggtcactctcaggcaaagccctgctctccagctcactttatgacagcactctgccttcagggttgtcatcacctgttcagataataatctagctcatcatttttcatctgcctggtgttctttgcrtgttgcttccagaggcagaatcccagagaagagagggaactgtcagctcctaagaatcactcctccagaaaagctcagcaaccaagaggaaaaaaaagaagaaacacagtgaaagaggaatgctttccttattcccaccctcatccctcacctattctttctctacttcctcacgttccctccatccctgggagatttaccatctgccattccctgtgtgtcatacagttctaggctctgtgcttctgtcctgcctgtgcctgaaattccttacaattttccccatttgccatccagccaacccctgcttattcaaaactcagattcagcctcccttcttccaggagatccttgactccccagccaggcttagctgccactcttctgggctttcccagtgcccagtcatggctctcatcagtgtattctctaaaaccattgacttcttcgccttccctagcaatctgtgagtctgtagaagaaaakgccatatcaatctaactttgtattcctggttcttggcacatagtgggtgaactcacacagactagagataaatcagagatgaatgagtgcccccttgagtccagggcgtacctgtaaaattgcaaatatctgcatgtacgagttgcaggcagggaaactgagtcacaagaagagttgcttgcataagacttcgctagtaaatggcagagctggtgcatgtgaaaatttctaaggcagaaatatgtacttatttaaaaattttttaaaaagcaagaaattgtctagacaagttttttctttgttcgtctgttgttttttgtttttgtttttgttttgagacagagtctcactctgttgcccaggctggagtgcagtggtgcgatctgggctcgctgcaagctctgcctcctgggttcacgctattctcctgtctcagcctcctgaatagctggcactacaggcgcccgccaccacgcccggctaattttttgtatttttagtagagatggggtttcactgtgttagccaggatggtctcaatctcctgacctcgtgatccacctgcctcggcctcccaaagtgctgggattacaggcatgagccaccacgcccggcctagacacaagttttaaccctgtaaattctgttgcctctaactgcaaccaaagccccaattcatcgcattctgcagagtgctgcccacattcacttggggaatcagcagcatgtacacctcattacttcacctccaaacccagctcacaagcaggcaggatgcgcaccaactgtccggttagcagagcttcccatttaaatcaaattctcttctcctcccaagctcatttcaaaggcattcattggtctgaatacatgtgctggtggaacgaaatgacactcaccccaaaacaaaaggaaaaaaaaaagctgatctgatgtaaaatctgtctgcatttcagagctgtcgagatgaaaaatgaagccacgagtttggcctttaaaaatattaatttcttataaagatgaactggagagtggtaactagaaaattcccttatctcctaggaagaaaacacaggatgaaattctggtccttcttcttgagtcttgtatgtcatttccaaattcaacgattacttgttcacggttcatttatgaggtttctgagcataatgaatgtccgcacatgtcactgagttattgatgaatcattgtttctattctgagctcagttcacgtagttcaatgtgctttggcttggctgtcactttaggrgatgatagttaacccaacggagtaaatctggccarttcccgagtgggggcagggggttgggctcaactaagggcaccaacaataaatgcctccttgctggtagatgggaaggactgagaagacagaggrgaaattgcttgcattctgctaacatctgcaacgtctgtaacagtgtctyttccagcagttgtaaaggatcctcactctccctttcctccctcagtcccagttcctcctccagagctcctcgtgatcatctcccaaagccactcacttgctgttctgtcctttgaggcctctgtccacttccagctcctgcctctctttcctggaccattgcagagtctcagaactgcctctctgctcccacttccatccattctctcactgcctccagaacattctccttttctgaaacactctcctctgcttgaaagtactgaaggcttcatcttgcctagtgcagcaattccamattccttataatctagtcccaaaccactgtctggcctcctctcctttccctccttctgaacaccctagattcctgccaaatataatgttattccacaaacctatgaggaccttgmctgccctctgtsctttgcacatgctcttcctycagcctttgcactctttccttccctcgtccacctgggagactcctgctgatcttttcagactcagcttaaatgtccccaccaaacctcccctccctctccccaytggaaccagctccacactgcactccaccatgttggcatgtacagtacatgtggctaccagttgattgacagattgtccctgtaagccagtctgctcagggctatctctgacaaaatagtgtgttccccttccttggggagtaactttagacaatttgcagtggatactgggctgcagccttgatgctgttttttctctggaaactatgcttgaaatatatttgaatgaataaaataatacatctagtaaaaatacattttyctatttttttctaaaagtatcttacacattttccatcaggctcaattgwgaaatccctccagattcctaattatcttcttcccaagataacaagatttctgtcctctcttcacaaagacataggacatgggctcagagacgtccaggcatctaactctctgcctgtctgtctctctggggaagccaatggtttttttgtttttgttttgttttgtttgagatggagtctcactctgtctcccaggctggagtgcagtggtacaatctccgctcactgcaacctctgcctcccgggttcaagtgattctcctgcctcagccttccgagtagctgggamtacaggtgcacgccaccatgccaggctaatttttgtatttttaatagagacagggtttcaccatattggccaggttggtctcgaactcctgacctcgtgatcttcctgccttggcctcccaaagtgcttggattacaggagtgagccaccgtgcccagccaggagccagtggttttaaactgatcatcatccattccctttctcagacttaggtccctggtcctgtgtagcccctgttttcttacaaaacaggaagaagctctattgttggccagaaagcaaagcaaaggaacctgagcacacaggattctaactcatgctgttgatttcattagtataggtcttgcatcgtagatgccaaacagagtatccacttaccttggtggccacaaaaccaccttgaggactagcaaaagagccatatggggtcttttctgtctgttcaccccaccttctaaaatccccacctctcacacctggtstctgatgacacttgtctcggatgtgactctgtgtctgccccacaagatgatgtcttcatctgccatttaacccaaccctttctgagttctgatcatgttcctgcaccagggagtgagaatggcaaagccaaggaaaaacgtactgctgccctcaccgtactcatggtctagcgtggaacagcctcgctgctttactgggctgctgtgggaaggaactagcacagtgtatgcaatcactggaaaagacggctggggagctcaacagcaggagacaaagtccatcctagtattcccagagattctttctcatccttttatatatataaaaaaaaatttaaatttattatttatatatttatataaattattatatattttctatatattttataaaaattatatatttatatatatgaataaaatatattttatattttatatttataaatatatatatttataaatataaataaaaatttatatttwtatatawaaatataaatatatttatatatttatatttataaatgaaactrtataatttttatataaattaatattatacattcatatatttataactcatccatatatatatatatatatataaaaaccttctggcgccacccaagggccagcacctccagctaaacattcaaaagcagaggagctgcattcctctccagcgtgagggaaccacactcaccaaagaaagccaaaacagaccccgttgacatgcacatatttccacaaacatcataaaagtccttttcactttatttcattaccagactatcagggagaatttcccagtggaaatcttcacccaatttgctccatatggattttctaccttattttactactgagaaagcagtctacatgttttatttgcaagagaatcaaaagatggaaaattgtcacatgagggacagtgagaacaggtagctgatagaaatacaattgacagttgcatcctggaagaagctctaacggtcttcatttctctcagcttgatgttgggccaagtttttacttctttaaaagaaaaaaaaactggcccttaaagcaataagatattgatcccttaaattatctgtgtattgaattaggctaacagaatctaagtttaagcaaatttgaaagaatgatcttgaacacgagataacaggccccgagtttgtactcccaggtaatggtgaccatacacttttaccataccagataatcaagaaatattgggtctgccactccttaatgtaacgctggcatgtgccttgagaatccagcacaggcartttgctcctgaggaggaccaggggtaaagtttattctccctttttccttctcaactgtaattcacccctcaattactccctctcttgtattcccaaactgcattttcttttcgctcatatcctgtggtttgtctcaattctatgcagctaggtgcctgagctagaaactacctaccaaactggtgcctcattcccctggctcctcacatgaaacgtgcactccggccacagaacttagcagtcgctctgcatggggacagatcctggctctgtcatttcctctggactaactaggggaagtcatttaacattctgagcctcagttttgtcatctatgaagtgtgtcagatggtgaggaccatgtcacaggttgcggtgagagtcaaatagggataacttccagaaaactcacaaaggctgacatgtgttaagtgatcagtagatgttatttatttttacagtcatcatcaaaaccctaattgataagtaggtattttttattccactttcctgtggtgtgtgtgtgtgtgtgtgtgtgtgtgtgtgtgtgtgtgtgtgtgtgagtttcactattgttgcccaggttggagtgcaatggcgtgatcttagctcattgcaatctctgcctcctgggttcaggcgattctcatgcctcagcctcccgagtagctgggaagagacagggtttcatcatgttggtcaggctggtctcgaactcctgacctcaggtgatctacccatctcggcctcacaaaatgttgggattacaggcacaagccacagacctggccttttgttccactttctaaaactcgctttcattcctctgctactctccctcctggaccatctcgtctcacctggatggatatactgtcagtgtcaggttcgcctcttaagtcctcagtactgagcacagtgcctggcaacatatggccccaaaataaatccctgatccattgaattgaatattctagccctcgctcaccagttaattgatgttattcctggccacttccgggacatgggcagaggaaaagctattgaacatgtataatagccaaacatggcattcgtgatttagaagaattcggaacagacccaaaatatgctttggaaactcaaatcatccatcatttctcctataaatttcagtaatcatttctgtttggtttgttttaaggatttgatgcatttaaaatttaaatgtgggaaagttacgccttttgttttatttcctagtagtatgaccaatgaggcaaagaatccaaactcattaagtttcacacataaaggattgaaatgtgtacagtacttacagcgagcacaggctgagtgatgaagctctctttttaggccttgaacacgttgacatacgcaatatttttcatccacagaatatagtaagaacatcatctcacaccatgaaacattaatattggttttatgactgtgcacaatgcagtaacacattgctgagctgccaagaaatttaaagaataaaaaagatttagacactgaaagaaccttgaatcattgaatttggggaggtagggaggaaggttggagtatgcctaggagctgattatgtggcttccaacaagtgaactagagccaaactatgtgtattttaaatgatttggatccttaggtttagtactggtgggtgtggctcagttctgcctagtcaccattcagtggtgggtcaggaagccaatgggttcagcaaaaaaaccggaatgacagtctgtcagcatggaggtgaccactgaacctgtggaaggtaaggaaactactagaggaaggacagtgaccagcacttgtgacacatgctatctcttcccttttttgtacccatagtagacatcactaatcaatggcggcacctttgccctttgagtccagatataaccttgggatcctacttaacaaaggggcctatgcacagttgccataattgatacaatttgccatataaactgaaatgtaacattcctaaaatttttaaaaataaaaaacaaaggtagaaggaagcccaagttttgtcaatgaggctgcatttttaaaatgtaggtaactcttttcttatcacccagtagattctttaatggcaaaaaggccaggcttgcttaactactgtagttctctgtcaaatcactacactcatttatttggtaactattgaacacctgctttgtgacagcaacatacatgctaattggtagctgtcccattattttggcagttctcagttctgagccttgggacagggaagcctggaccatcttgctccagatttcagtaaattgggtccccgggatttaaagaggagatgaggatccccggatacgcttggaggtataaaggtatctccaagccacagttttcccgagacagtccttaagcgccgtgcccctcaattttcccagctgcgaaatgggcagctgctgaaaaagagaccctgcagcattgtcatgaggttcagatgagagagataagtgcctgggtcatagaagatgctctggaaatggcagcagatattgtcattatgctgatgttgctattgtcgtcattattttttgtctcagtgtacacccctgatgcatcggatgggagcaccttgctctccattcttagaaactgtgctcatgcacttgagcttgcctccaaagtctagagcctcaaggtcggcctgattattgacacgtttgactacctagctccaagcagggagagccctccaggccctcagtggtggtgttcttcttgaagcctgtgcnnnnnnnnnnnnnnnnnnnntgctcagtgtcctcatttgcatcacagggatggcattccgtgcctgcgattcactatgggtcttaacaaatctattccttctcttcccctcccacttcagtggtagcttcgcgaattacgaccaagtcataccaggccctgttaagattcccatgtaacaacaactttctatgaaacaagaatttcacatacaacttctggggccaacagggctccagaatttactccctgcaatatccatgaactccagttttaaaactccaacccatgaaaagtaatttctaaagggaacaatgtgaaatacccaagagaaatgaaaacacacatccacagagaaaccatgaacatgaatattaatagcaacattacgataatagctaaaaagtgggaacaacccgaacgcccatccactaatgaattcataaacaaaatgggcctgtccatacaatagaatattatttggccataaaaatgaacgaagcactgtgagatgacgtatttttgttgctgaagccacstggcttgtggaactttgttccggcagccatggaaaatgaakgcagatggtgactgctgatggatatggaatttttctttggggtgatgaaaatgttctaaaatcaattatggtgatggtgatggttggacaactctgtaaatatgctaaaaacaattgaattgtacactttaaataggtggattgtgcactatgtgaattatatytcagaaagctgttacaaaaacaaaaacaaaaacaaaaagtgtcccacactatagccagaataatcttatcaagtcaaccgcctggttaaatcaccaccgcagggatccttttcctctcaggagaccaatctgagcctgtccatagatctgtaagacaagtaccatctgacccatctccatccagcccctgctcacaccacgtgtccctctgtctcggccctccagcccgggggtttccatcttcacccatgcccatcccagggcctttgcacatgctattcatgacctggagtattttttcaccttgctccatcctattgtcctcattacctcttaacctcccgtcagattttagctcaaccatcagtctcttgagaagcttcctggtctctgagagacggtcaagtccttcatggaggtgctttcattgcacccgaacctcttcagctatcatttcaccattagaatttagcataaacttatatgattaatatctgcctcccacactgggctatagtttgtgtaagagcaaggtccaggactatttcactcacctttgtacccccagaaactagcacatagtactctttattgtatttttttaattgatgtaaaattcacataacataaaattaaccacgttaaagtgaacaattcagtggcgtttagtacgttaattgatgtraaattcacataacacgaaactaaccatgttaaagtgacaagttgagtggcatttagtactttcacgatgttgtgcatccaccacctccagctggtcttaaaatatctttatcatcccaaaaggaaactccagagccattaagtagcctctcccacttcttcctccctgaccccagtccctggcwaaaaacaacctcctttctgtctctrtggatttatccattctggaccttccatataaatgaactcattcaatctgtgacattttcgtgtctggagtttttcacttagcataatgttttcaaggttcttccatgttgtagcatgcatcagtatttcatccctttttatggctgaataatattttcttgtatgggtrgagcacattttgtttatccattcgtctgtttatggacatttggcactgtttctaccttctggctaatgtgctgttctatgaasgtgtgcatacatgtatttctttgagtgcctgtttctaattctttggggtatatatctagaagtagtagctctatgtttaactttttgaggaaccatcatactagcaccatatgtggtattacacatagcagtgataccattttatattctaaccaacagtacacaagaattccagtttctccacatccctcccagcccttgctattttctgttgttgctgttttttatgctagccattctagtgtctatgaggtgccatctcatagttttgacttacatttatstcatgattagtgatactgaacattttttcatgygttcattggccatttgtatatcttctttggagaaatgttgattcaagtattttgcctacattttaactatgttgtrgagttataaatgttgcctacatsttctggatagtagacccttatcagatgtatgatttgctgaatatttttattccattctgtaagttgtcttttcactttctttataatgtccacttcattgtatttttaaccaactaaataactaataagtccagtgacaggcatttagatgacatttgtgggcaaaacaatcaaggactcccatatgcaattactaatttatagctccctggatacctgggggtcaggaatcagtctgttgattggctgcgggctttcacttccatccaagcatcaggtcacatggtgccgtcatagctgcagactcacttgtgaataatggatgtcttcatataggaagggttaaacagcccctgtcctactgtgtccactgaccaagtccccttcatgatttatggatgatcacattraaggaagaagagaggaataggaraagatgaggtttcccagcacgtccttttcaggacctccatgtcacgcctcastgccaattaacatttacttgaattcttggttccctccccagcagctgttgggtccagctctctggggatgtctgagatataaatgctcagacctgcacactgacatttaaagagccagtgaggggtctgcaytctttatttaacaccttctttctgttgcaatatgaggtcctcccagatgcccctatgggaattactaatggccatcacatcttggttcagggaatggttgtctgcttttaagcaaagcctgagactcatgggtttgtactgcttcccagagggctgaggaggagaaaggggtaggaaggccacatccgtcaccctgtgatggatgcaccttgtgatacatccccctcgaaatcacgtagatgcatccaaaagcccttaaccattatattttgctctgataataaagcttagtcttttatgaccactaaataatacgtgtttactgtaaggaaaggacacaaaggataaaatgaacattgcataactacatcacccagagataattgctgttaatatcttgctgtatataattctcctgctctatttatatattgtaatacataaataccttttycacaaaaatgagagttcactattcatacagttkcataacctgcctttgcttctcaacartataatagaaacattttccatgtcattaaatattcccctactaagcatttatttttaatgtgggtgcctctggcttaaacagcagcaatcttcagtgctgcaaagagctatgcttggtggatttgaatacattcttctgctcagagtattatgagtttgtttaaatggtacccgggtgaaaatatatcgctggctagccattcctggagcaggaagagtgtctagtcattcttgacttgctcaaatcctgtaaaattaaccatttctcacagccgcgggctacttttctggatgggaaaatttgctgggacttaaggttccagggcacagacygggcggtcaatccctggcagatctgtagctctgttaaaggagacagggctggttaaaatttaaataaccctggaaggtcccaggctgaaatatgctacagggagacacaaataagagagacgcacaaatgtcatgagtgttcaaaagcagaagaggtcacattccacaggaagcaaaaggggaggagaagcctkwgctgacccttcaagggcaggtccagtttggagaggtwctaagggcagtaaatattcattcaggcattgrctscactgatgtttaatgagcatctattaatactgcatgcccagcagtgcccttgctgtcaaggatatgacaatgaacatacatagatggtctccaacttcaaacaccttacagattggcacaattcagagcaatagttagcacaataggagagactactggatacagtaatattaataactgctcaataaatgtccactattcggtgtcctatgtgtatcatttcattagtgctcacaacaatgcggtgaggcagattctattattctccctatttgcaaactgaggcttagtgaggttaacgtacctaaagtcctatgtgcaggtagttagtagcggagtcaatctttgaacactttccgcctactgagtgtctgttcctgttatgaaaagcattttgcacatttcctcttatttaatccttctgacaaccttgcaaaggcaatgataaaattcccatgtttaaagacagtgttataaacacagagaaagttgtcatttgtccaggcccacagtaagaagtggagcagggctgtacctactgtggcctgaggaccactccatgcccactctacctcactgttaccacctcagtgaggcagagatcctggctggactaggggagagtgaatcaccccagggagagccatcctaaggctgacttcctacactgtcattgtgttagttctcatattcctataaagaaatacctgagactgggcaatatataaagaaaagaggtttaattggctcacagttccacaggctgtacgggaagcatggctagggaggcctcaggaaacttacaattatggcagaaggtgaaggggaagtaggtatgtcttacattgctggagaaggaggaagagagagaagggggaggcactacacacttttaaacaaccagatctcacaagaactcactatcatgagaccagcaagggggaaatccacccccttgatccagtcacctcccaccaggttcctcctcccacattggggattacaattcagcatgagatttgggcggtgacccaaatccaaaccrtatcaatcatttatttcattcacaagtgcgtattcagcacctgtcatccctgsagctgtactgatgtgaatggagtcacagcccttgataggctcacaggacacaggaagccaaatgtgccattgtgataagtcagatattatgttaaatgtaggcatgggtataacacagtgtgggggcagaaaactggactcccagttagacagggacaaattagggcaggcttcacaggggagtaacatttgagctgacacttaaactatgagcatgtgcttacctgggagacacctggacggaggctgtcccaggcaaagggaatggcgttttcaaaggctcagaagtagagagagcatggcatgtttggctaactacggccaggaattaagtactgctgatagataatggatgaggggaggagtgggaggaaatgcaggcagagggggacagatctccaagggcctatggtgctgtccacagagtttaaatgttatcctggtagcaacagggagtcatgcaaggttgtagagaagtgtagcagagtgattggcattgagtgtcagcaagatcattttaataaatatgtgcgtgaggtgatgctatggaaccactggggctattttttgtggcctgacttacaggagaggtagtgagaatagaaagaagacaggtgtgagcaaattaaggaggtagaattgatcaacttagtaattgattaaattggtccaggaaggtccaaaatctaagactctaagatcaaggtaactcagcacccagttttcatttctgttcatttctctctctctctctctctctctctctctctctctctctctctctctctctctctctctctaagtcaggtcagggtctccatctgccacccaggctatagtgcagtggtatgatctgagtttactgcagcctcaaactcctgagctcaagcaatcctcccaccttagccttccaagtagctgagactacaggcatgcgctaccatgccctggcttatttttatatttctttgtagagacagggttttgctgtgttgcctaggttggtcttgaactcctgagctcaggtgattctgcccgcctcccaaagtgctggtattacaggcctgcaccaccacacccagcctgttcatttctagtaagtccattattttacttcttttatttgttcttattaaagtttccatgctgttggagttaaytgtaagtagaaagttgagaacggccaaatgtttggttggttgctgagcagaagagcaatacttagcatctttgttacataacagatctctatttgtgggagttaatatttataaaagaaagaaagatgcattacccatagatggtgccatttattctgtttatttttaaaatgcttttatgttgttaaaatcctagcctttggttttgcatctataatgaaagttgggcagattgtatttcagctggcatggaaggagaagatcttttctcttttacaaaaatcattactgcatttgttcattgatccaacaaatgcacgtgggcatttggaaagcaggtatggtctctgcccttccgaagctgacagttgagtcatttatccctgagtacagcctcagtatttacccctgttttaaacagctactcttccttaaacattgatagaatgtcagaaattagtcatcaagaaccaagggtgactttcagtggttatttaatatttcagacttaaatattcttcccacatgctcctgcctcaagacttttgcacttgctacctcctttttctgaaagtttctcctccaaaatatccacatctcctccttattcctttcatgactttattccagtgaagtcttctcaggccaccctatttaaaacagagccttggccaggcacagtggctcacacykgtaatcccagcactttgggaggccaaggcagtgggttgtttgagtccasgagtttgagaccagcctagtcaacgtggtgaaatcccgtctctacaacaaaatgcaaaaattatccaggcgtaggggtatgcccttgtagtcccagctgctagggagrctgaggtgggaggatcacttgagcccaggagttcaaggctgcaatgagccaaaatcatgctattgcactccagcctgggtaacagagcaagaccctgtctcaataaataaataaataaataataaaagaaaactgagtctccaccctagaactttctccctttttatttcatctcctcattagcacataccactgttgatcttctttacaatcattctgctcatccagaatgcaggctctaggatgagggcatctttgtgaccttgtctatggctctgtccacactggctaaaagattgcctggtcctgggtgggtgaatgtttgtggaattaatggatgacccctctctgagccttgagtttctctcctgaacacagggttgtcaggggggtggttagtagggtgtaagggaaaaagagtagcagggtcccaggatccttggctctgtgagggctgctcmcagcattttaggctgatcagactacttctgcagggcaatgctgggctggagttggtcttgctttacgcagatrtttctgggttacacaacacttggcttaatmcwtttttttttccatcaggcccataagacaatttaaaggaatgaaaaaatatgtatgttttaagggtctagacctaatgctagcagcatccctttggagaggttttttttgtttgttttgaggggtcttttgtttgttgagacactgtgcctttcaaaatttaaggtactgccttgttatgcaaatcacacatgtttctagtagaaaaaaaagtaaaagatgtagagaaagcaaagcaggcttcccatggagggataaatggatccttcccagcccacccactgttctgaggctgctgcccataagggttgttaggacacacrggagcctgagtggccaggtctctcaggagtggagacattcacttcccagccgtgggacatttacccaaaccactgcaaagagccacaaatagcataagacygtgtgctgacggccagtggaaatggagctcagcgttgacagagcttcctgaagactgagctctcttgaaaatgtaaaattgctgaggaccttaagcagagtccgatcaaccgtgttggcccagttggactttcagcctgaactctaagaagcatggtccatccactgagcagaatggccattggtggagtttgcacttaaccatgtttgttaacttcctagggatcctgaaacaaatcaccaccaactagagggcaaacaacaactgaaatttattcagttyattgacaatcctagagccctgaagtccaaaatcaaagtgttggtaggccttgctgtctctcgtggtcccagggaggatcccatctgcttctgccagcatctagaggccccagttccttagtttccagctgcaaagctccagtctctgcttccaccttcaggggcccttctccctgtgtcttctcatcttctgtctcctataaggatacttgtagatttagggcacacccagctaatccaaaatcatctcgtctccagatctttaacttaattacatctgcagagacccatttttccaaataagatcacattcgcaggtactgggggttaggagttggatgtatattttgggcgaccaccattcaacacatacaagcccgtggagatagcactcacttcactttgaggagctatcattcttagttcctttgattttaaagctcatatctctgtccaggatttattgcacatctattctgtagttttaactgtaatagcttccacttgctgattttgttctgtgcaccaggtcacatsgtcaacgatgtatagggattatcccattttatcctcataatagtgatggagggaaggtaagattgctttattttgcagaaccaggatgtgtgggcatcaaagagtgtgatttggtggctcacgcctataatcccagcactttgggaggccaaggtgggcagatcacctgaggtcaggagtttsagaccagcctcgtcaacatggtgaaactccatctctactaaaaatacwaaaaagaaaaaaaaaagccgggcatggtggcatgagcctctagacctagctactccagargctgaggcagaagaatcacttgagcccrcgagggagaggttgcagtgagctgagatcgcaccacagcactccagcctggatgacagagcaagactctgtctcaaagaaataaataaataaacaaaaatttaaaaaagcagagctgagatttgtatcctkattttggcttaaagtccttgctgttttcactatgccataagtgagcaaaagcagagagttaaagcatggtttctggctgggcgcggtggctcacgcctgtaatcccagcactttgggaggccaagatgggcggatcacgaggtcaggagatcaagaccatcytggctaacatggtgaaaccccatctctactaaaaatacaaaaaaaattagccgggcatagtgacaggtgcctgtagtcccaaactaaggaggctgaggcaggagaatggcgtgaacccrggaggcggagcttgcagtgagctgagatcgtgccactgcactccagcccgggcaatagagcaagactgcatctcaaaaatttttaaaaaatgcatggtttttgcttccaagcacctcataagcagagaggaagggacagagaactatctatggtttattgggacacgatgtaatatatgctacaagggaactgtgtcaagagctctgcagtctttctaccctggaaattttagtaaaggcttcaaagagaaagtgacccctgaggcggtcatttgggaacagcaggacttggctgcgtctgaatgtagagaattgcattctgggcaaagggaacagcatctgtgaagaaaggcaaaagtgagtggaccacccacatgatccctcgatagtgtccaggagcttctgtaggatgtagtgttatgatgctgagacactgtattaggctattcttgcattactacaaagaaatacctgagactgggtaatttataaagaaaacaggtttaattggcccatggttctgcaggttgtacaggaagcatggtgccaggcatctgcattgcttctgatgaggcctcagaaagcttacaatcacggcagagggcaaagcgggagtgggcacstcacatggcaaaaacagaagcaagagatagggggaggtgccaaatttaaacaaccaggtcttaggagaactcactcactactgtgggggtggcaccaatgaaagctctgccccaagatccaaacacctcccaccaggccccacctccaacactgggggttacaattcaacatgagatttggtggggmcacatatccaaaccgtatcagatgctccygagccatgacttagatttgaattgctgcagacacgtgtctctggtggcttcctgtgtgccataccctaagctggcgtgggtggccttcccttcctgaacagcgtgatgctggtaacctgggacctccttccaccttcctgcactctataactacttcccagatcactccgaatttatatttgccatctcaggatatggcaaagtaagacacaacagtaacccaaactaaggcaagggcagtggggatgaggaggttggagtcgtgtgagagtctgtttggagaaggaaatcagtgatactctgttcagtgggtgtgggagaggaggcttgacacgagggggccccagttttgatgcatctaccagaacagggaaggactgtgcttggctggggagctgctgagcttgctttgggccatgctgtgtttgcagtgctcgtgacacattcagctggaaatgttgaacaagcagttagaagtgtagatctgggaattaggagacagttggtaatggaagctgtcagagtccacaggggtgggtggaaccaaagctggaggaataagcaggatatccaagaagaaggctgaccattagagactcggtggagattgcttaaagagctgccaggagtggcaacctaccaaaaaaaaaacttatcattctcccagcccaacccatacagggctcgtggaaagagctgggaaatgggctcccacgtggaatctttggactagtaccaacaggggttttggctactggggaggtgaagaatagtactgtgtatgccccagggtgtagcagttgagagtataaggtacagacccaagaggttgggtttctatcccagtgccaccacataggagctatgtgtcccaggacaaaagaatcctcaactgcacaatgaacacagcaaccacagcaacttcacaggggtatgttgaagaccaactaaggtaacccacctaaagggttgaatactatttccaacatgtagtaagtgctctgtgcacgtagccatgattattataatgacagcgtgtctgagtggagcccggatgaactggcaagcgatgaccacctgtggactgcagcgggaaggtccgcagcytggggctagaaccacaagggagcgtgatgcacacaggtgtgcttgcacccacggctgaggtttttcttcccaccggcacagggcgmtgaggcagggatttcctcccagagagagggcggttgagttcagttcccctccactttgaaaatggctctggaggaggggcggaggaaaggcagagactccgtttattgttatttttaaaaataaaatgaaaaggagccctccaagggcttgtttatgggttttattattggcgaagaagagcacacttgtctttatcaacatcctgtctgtctgggagtmtgagccgagaagggcaagaccaaatgttaagtcgtaacatctgacttgttgttccttgctctgctaacgatccaggctgttaagaggcttagcccttgtcagcagagccaatacaatttcaagaacaaaatgactgctggagcccagatcagaaaagggctgcctcgtgggagcaggtcagggcagtctattaggcatcttgtgcaaataatgctgaagaaaggtggtcagagaagctgactgtaccaggcataaaatcacggggggagccttccagaataatctgtggccgggttattctcactgctttttctccctggtccacgaattagcttttggacaacagctgtggtgtaaytggaatccatcttgtgtgattttttttccctcagatgatttagaattagttcaatttattttcaaaaagtataacccaatgacagcagaaaggccatgtctcaaattgctttcctgtccatggctagagtgggtgggtgtcatttgctgatttattactctctcmgtgggctcctttcgtttctaaagccacctggaattatggccagcaatagaactctaaaccaaagtcagctttgcacgaaaatgcatttgacttaagagaccacggaaaatgctgattaaaagtaaccctgcatggcaaaatttgattaggagatcacatctgaatgggaacaggttcgagggaacggaggatgaatcaggctcagcaaagccaactttgattgcrcttttctaaggggaggatgtggtgctgattaaacgtctgaaattagtgggcagggaccattaacatgcaaaggactgatattaggcaaaggttgtaaagctggaatggctgcaagtcrtagacatttaaaacctagttttagaaacatccaccgacccctcggtgagctcctgtgcttctgtcactgggagtcagtaattgaattttctggacattttgaccagtatgtaactktgtggagccgattacacagcagaacgcaatttttagcctgaccttaaaagcattaccttctgctgcgtgattagaaaacatacagagagtgccgcccttctaactgcacttgatttggggaagaagaaagaaaaagaatcaccttgctattttatgaaacctggtaagattcatttagattccacacagatcatttaataacagattttgtaaaatcttaacatacggagccaccataaaacgtattatcttttattacccatacagagaatgacattttagatggtaataaattgaaacccmaggaaagctatttgctttcggagagtgcttggcgaatgacaggaatagcagtttcccaattttacacggtggcaaatatggccccccagggtcattggagacagcccccagctggctttgttgagatttatctgagcaacattctcttatacctcttttttttttttttgaaagatcatttccgtccaaacctcaccacatgaggacccagttgtcataccataacatccctccttccatcccgtacacctggagatgtgtggctggcctagggctgagcctggggctgggaccagccagtggggcatctgcctcaaggtggaaaagagcccagccyatcagctccaaagcagccacagcctccctctgcatagacacctctccaaaggagaaggaccttccctgcacactcttggacagccaaagcctcatcaccctgccacgccccgcaaaaccaggctttctagagactgattcagcctgtctaacattgcccatgcctgcctttggacctgtaacatctgcagaccatgagagcaacctgaggccaaatttgctgtgtggtgatcamcataaccgtttcttgatttactcattcattgaacatttactgagagtgactgagagtgaactagtttgtgtgatttttcccccaggagatttagaatragttcaacttgttttcaaagactataacccgatgaccacatacaggcagtgtcttgggacctcagtgtctcaaggggcaaggcactggggctatggcaggaataagttaaagacagaatccttgccctcaccaagggctgtaataaatacttagaaagtgactgacacattggaaaccacaggcaccaaagggaagcttctccggtacttgatatttaccactttgtagatggcaggacattcatcttcccactagacagattttgaaggaaaaggtctggttgacatcacacttcaaaggattgaaatggaaatattttccagagaaatgacagaggatgtcatcctgggaaggcaggccccctgggaagctggcaggtgggcgaggaatgaggtgcggctggtgaggccacgcaccacgtggagccaggaggctgctgggcgtctcagtgttccaggaaactcagcggtcaccccccagagaaggtgtactcgtttcctgtggcttccataacaaatgaccacaaaatccgtggcagacagcagcacaatatattatcctacagagctagaagtcagaagtccaaaataagtctcactgggccaaaaccgaggtgtcagcaggtctggattatttgtgagggctccaagggagaatccattttcttgctttttctatcttctaaaggcccctggaattccttggctcatggcctcttcctccatcttaaggccaacagtgtaatgtctctcctcgtctccctgtctccccatccccctccctcttctctctctttccccttattctttctccctttcccccccccggacccctctccctcccttcttcccctctccccctccctctttctctctgtctccctccctcctccctcccttgccctctccctctcccccaacaccatcttctctgcttccatcacccatctactcccgctgacactgatgtttctgcctccctctcatgaggactctcgtgatcacattgggcccattcagttttccagggtggtctccccatttcaagatccttaacaaagcctcttgtgccacctaaggtaaaatattcacagattccaggaattagaacatggccatctttgatagatgtttttctgtgtgccatagaagatacgagagcttctagatccaaaagcctgrtggcatttagagctcacttccactgtgctcgatacatgaacctgacattgagcatctcacagcataatcacaggacggacgtgtgaagggaaaattgctatacagtgtcattatctcaaccaagagagaaacactcaccgtgccatacagccagggctaatgcagggaaggcaggagtgactctgggaagacaaaccttcatgatggaggcaaccttcaagcaagtgattgtttgattatcacttgcttgaagtgattatcytccaaaggataagtgattgtttcctggggcttaggaggtgggggcgggaaatgtgcagggagggcagagggtacagcataagccaagctgcagagatgcggaggagtgaaaaagcctaagaaggtatgaattacaaatagctcagctttacagaatataacactgagtraggagaacaaacagatgaggccatgaagagtttgtctttcatgcttgaaaaactcagacattatcctgtagccactgaagggttttaaggagagtccttggtcagatggtagctggacagttcgctctggctggctttggggtggagaggrgcatagaagaaggcagggggaccaacctggaagctgttgcataagtcaaggaagaagagatggggacttgacatcatgtgcacacagaggtggtggagaaaagaggacagactcgagaggaaggggaggtaaaatcaggagcactggatgagcagttgtttgaggtaagagagagggaattgctacagagactcccaggggccggctggagatgatccctccgggaagaacggccaggttgtggggaagatgggttctgatattggcccatggaggataagggagagcatctagtggagacatccataacaagattgaaagcaggcgagatgctgtttggtgtcttagagagagtctgttttttctcgaaatggacgtaaaaaaaaagaaagtttcaaagagaacttttggaaaactatgattttcatttttcatttaaattgcatcataaatgggtgagttttaaagtaaaacatctaagggtacatcttgacctgcattgagtcatacattcattcagaacaatgctaaccgaagtgtgcccctaaatcgacgacatcagcgtctccaagaaacttgtgagaaattcagatgctttggccctgccctgaaccttctgaatcataaatgctgcaggtgggctgtcaatctgtgttttagtacacccaccaggggattcttttttttttttttttttttttttgagagggagtttcgctctcgttgcccaggctggagtgcagtggcgtgatcttagcacaccgcartctccaccttctggtttcaagtgatcctcctgcctcagcctcccgagtarttgggattacaggcacctgccaccacacccagctaatttttgtatgtttagtagagatgggggttcaccaggttggccatgctggtcttgaactcctgacttcatgatccacctgcctcttcctcccaaagtgctgggattacaggcatgagccaccgcacccagctggacaagcactttcaagaagcagtgactctgactctatgtcttacgtacctgctatgtaccaggcataatgttgctatgtcagggcccaggtctagaaaacaaaagctaatgtggcaaatagtacttgagcatctcaattactttttattttacttcagtgttacaatctgtacttccttgtctgaatctaacagattagcctgttctgttctgctcctaagcagccatgtgctcctgggattcactctgtttcctctcactgtgagttccttgaaggtagggcaggacgagaaggcctcgaaggtacttttgagaacttgtgtctcttcacctcacaaaccttgactccaggcacgctggtggccctgtygcagcctgatgtctccactcttattcccaggcccttcttccttctctgaattctctcccctcacacccatccttcaaagctcagctgcagtcttacattaacctgaagccactgaaaagccaccgaagcactcccagttagtagacagctaacttagcacaggctgcctgctgccctggggagccacttatatatcttttatcttcacccaagccgtggcttccttgaaggtcgagagcgtactttttcttgtccctttggtgtcctgaacagaaccagaatcagccttccyttcttattcaatgactacwtttaatagagtttagggattaaaggtctcccaccttcttccatakaatttgactttcagtccaagacmccatctctaatcctatggtagggtatgcccttctgcaggaatcactgcttaatctcttccggcctccacctctccacctataatgtctaagtcaactgkcccctcctttgtaattccacagaactctgtgcttaccccatctcattgtgctgagctcatcagggtgttggtctctcccacgggacttgattcctgttacttcttcgcaccatcccgcacaatgcctagcacacagtaagtgctcaatcaatgtctsatgaattaaataagctccatatagctttcctgagcaccccacattctgacccccttcatgtaaaccttaattgktattaataccattctgataacacttatctcatctgaccttacgtacttgccttttgttcatctctctggaccagaaatgcaccaaaagcagagtctgtatcatttatcacatcctagcagttatttgagcctaatagacactaaataaatgtttcagtgaactcacactgaatgtcaagtatttgccaccttgagcctacaggagatgctttttccaggggttctaggaacgccattggcagtttatttactgtaactcatcagtggcagcagaagatgcacacattgcctggaaatgttttatttgattttggtgtccctcaaccgcaaatctatcatttaggctattccagccacatatgtctaagagacagtgtttatttcccctgctgcttctccaccctgccagctttgtcgcagccagtaaatctggagaaatgagcgctgccttctccttgcccaccagcccccagccacgaatgcaaaaataaataaataaaaaataaaaaacagcaggtgacagccaagaatgtgaatgttcacattcgtaccaagaggtaaggtgaaaagaggcctaaagacaaacacaagtcaaaccaggctcaccctgctgcctgggaagatggaagaacatcgctcgacctctgcagtgggaataaggcacattttatgaggatgtgtaagcggttcctgctggatttatggactacctattcccagtrttatgtggccagagtggttaaatcaaactccagacagacaacaactcgttctgcttcagatagtgttttcaccaatcttttgcaatatttatagactaggtgtcaggtgcagccagcccggggaagaatgtggtccctgtttaggcttcatattgcaaggacgcttgtgatgcccagctgatcgggacaaagctaaagaggaaaygaatgaatgaattccattacatctttgctatgtagctcatgttaakgtttctcattaacgataccttaaatgttagactagaaagggatttgytaacaaaaatgccttcttacagccttccttgactcctagagcagcatgtgtgtgctggagcccattctcactggctcacaatagccaactggtgtctctgtttccaactaagtgcttttggagtggaatcatctgggtagcttgaaatcagctatggtaggagtagttaaaccaccaaaattgacaacagtacaaatcaggagaatctgttcttaaacagctacaggtataccactctattcattattttttatatattatatataattgtatatttatrtaatagtgtataaacatacagtatataaaacatgttatttgtcctgtaataattgtaatcaatattatgcaataatatgtaatcatatttatgtaatagtgggctaattgtgttataatatgactaattgttacatagctmtgatgtcccaggcagtgaattttatctcccaggcagagacataaagcctctaaacaagaaaaggcccctgatctcaagaagctcggattgtcatagccacgatagccactaaacaagtaatcagtaaacaagcacattayagactgtggtagtggtaggtgctggggaaaacggtactcattatctattgctgcatgaaaaattgtctcaaaacttagtgacttgagacaagaagcactgattatctcacagtttccctgctcaggaatctgggcatttcttagctatactctgtgcttaatgggcactcacagagctacaagcaatgtgttcagaatctgctgtcttgctggaagatttgtctaaggaaggctccacttccaagttcactcagtggctgttggcagcatggttggcaattgcttttggctcttcctgaaggccaccctcagtttcttgttacatcttcgaaagacttcccaaaaattctactaaataatagcagtagcatctctccagcatttacatatgccaagctctgtattcagcactttacctcttttaattctcacgtatcctataaggaktattctcccccactttacagatgaggaaatggaggcagtgagaacataagcaacttggctgggatcactcagctactaagtcatggagccagggtgataataattgatcacatattgattgactccttcttaaatgtcaaccatcctattgtgcaccaaggtccctgccttcgtggagcctctgtgctgtgaataatgaccatcagcaaaggagcaggaattcacctggagcaagaactagaggtgaaacattcgatatggaaaaagtggggtaccatggaaagaaattcggtctagacaaactgtaaagagagatgtagagtgcagttcaagaccaggcgagagagagatggggtactgtgtgggttaatgggaaaacctttttccacatcacatctatttgttgattttccccccacagctaccactatgcttgttattagtgataaatgttctgttaaatgcatacctgtgtggaagtsattgtagctgtgcaaaacgtcgagggtctggtgatggattaagtgccagatttaatgacatggcttgattcttttttcaagatgagatgtttgcttttcaaatcagtgtgatcagtgaacctggcctgtgtctgtggagattcactcgaggcttyttcttgcagacataccatcttkcttttgtttctagaatatatattagctggtagctagtygacacccaggaggagacagcaaatgcaatagaaatgcatgactgcagaactcaaaccaggagagcagcttgactctcttagatatgtcttacaaatcagatagcttcaaataaaatcagaggagccaatttaagttttccagttttgacacagtgcatttcttcctccaaataaaattctatctccttgagctgcagttccgcaaagtataagtcattccctgagaataaatgactttgctttggaaatgccactgatatgctcagacctttgagacataatttagttcagggaaacagtaatatatcatcattatcaataatgaaagtaaatcgcccaccttgtgtgctgactactggctaggtgttgcagccaaaggcatggtccttgcccttgaaaactttgtcatscacttagggagatagtaaatgggcattcaaaataaagcaaaatgggacacatagccttcatattaaacaaggtaagctaagcacagtcataagcagcccttaaacctaaaaaatggcttatgtcttgctcacatcacagtctaaagcaggtcaccaaaggggctttgagctatatagtcatttggagatccaggtttcttccttttgaggaaatagaaagtgtgagaggttacatgggaggtttaagaaccacaccaagtacataacttctgctcacgttccwctgaccgcaatcagccacacaagtccatttgactgcaaggacgcctgagctgtacagtctagccctatgcccctggaacccaaggaaatagratccagtgaacatacaacattgttttcaccacaagttcctttgcttgcaagtaactgaaactcattcaggctggttttggtacctaaaaggagctcttgagtatacagtggaatgagttacagaatcaacgaaagcgttgaagtcaggggccatcaaagctccagtccttggcagccaagctgcttcttcccggcagagcagcaccttttgcaaaattcagctcaaaagctgtttggagttgcagttgattacattcgtctttcctctgagccttgaaccaaagaaacacagaatcaggtgaggcccagggagaatacaacttgatcttgagaatggggttgaccttgataatggggcccccttctcactgatgagttcactcacctagtgacagggcagctggacaagtgaaagtgaacctggacaagtgaagaggcaggttgccttcctcatgggcagagagaagcacaagggtggtgagtttcctcccaaaacattcaaggcaaaaatccctctattggtcctaggagttcggggtttaccctacattcctgttttcctgactctcagtcccacatttcctcttttcagaatccagttgtcccagcttgaattagggagttacctgtgaatttagtcaattcttggcaagagagacaaacatgacaagtggccactgggatctctttctctgcatcaaaatttcctcctggagaaagggcatctgtgggctggacacctaaagagcatctcttccagcagagtaacaaatgcagagtggccagcgagggatacagaattaaaaatacatgtgtatatttcaagtaagagtgactccgagagctaggaaattaggggrtgactttctggaaaaggctctgaggatcgggaagtaggtcagaggcaagtggaaggtattctgatcatgtatgagcaagggagttcatgtggcattttctctaattttcaagtgcaaactgggtgttgtacattccaaaggaggttactttcattatcggttttggggattttgttactgwtctccttgtgaaagcaataatgttcattacagaaaaatccccaaatcataacaggccaataaactttttatattagaattgcttttaaaagtgaaaacttgggcagggcacggtgtctcatgcctataatctcagcacttggggagcctgtggtgggaggatcacttgagcccaggagttcaagaccagcctgggcaatacagggagaccctgtctctacaaaaaatacaaaaattagccaggtgtggtggcacatgcctgtggtcttagctacttggggtgctaagttgggaggatctcttgagcctgggaggtcgaggctgcagtgagctgtgatcatgccactgcactccagcctgggtgacagagcaagaccctgactcacacacacacacacacaaaaagtagaaacttrgaagcaacccaaatgttcatccagtagggattgactaaataaattatagtggatctgtacattggactattagacagctgttaaaatgaacagctctgtaaacactgagataaaagtgatatggtaaaacaaattgtgtcgctatgtaaacagtattactttgatgaaatgtgtgtgtatataaatgtgtatattaaatatgtgggtatttaaaatgtacctccgtgtgtgtccacttgtataggaaaaaggagataactatcaatatttacctctcacaggtggggttgggcaagggtggaggagagttctttgaaatgactgttttatttttatgttgcttacaataattggatattacttcagtactaaaaatatttttaaggtcagccttaagtttgccagaaaatttagacttttgaaacctcatcrcaaactttgcartttatctacataacagtctaattgattctctactaggttaatcagtctatttctcattataggtgcaaagttttatttacttcaggagatagaaattggttcattttctaaaattatttataaaatttgttgaactacgagagttatgccaatgtatccttcccttgtgctaccgtaagaatttgtacataccyctgctaagctttgatttattttattgcactcatatgtgaatatgactgtcctcaacgctaaactttgacctctttggagaaagagacttgttttttgatcactgtatctctagtatccaacacgayatttagacaagaagttcattaactgccaattaaatagatgcataaactagttaaagaaagaattagaccaggtgcagtggctcatgcctataatcacagcactttgggaggccaaggtgggcaaattgcttgagctaaggagttcaggaccagcctgggcaacatggagagaccctgtctctacaaaattacaaaaattagctgggtgtggtggcgtgtgattatagtcccagctactcaggaggctggagtgagaggattgtttgagccaggaaaatagaggctgcagtgaaccatgaccacatcactgcactccagcctgaacgacagagtgagaccctgtctcaaaataaataaatatttttaaatagataattacagtaactttccctggstacaaaaaattttctgtttaagggaaagtattaaaagagaaaacgatgtattcataaaatgataggaatactgttttgaagaacctattttgatgctattgtatggtgtgatagctcctatgctttcttgctaatcagagaattgatcatagtgttattgcaatagttgcaatattagtcaaaactgccttattcctacctacggaacatctgaatcaagtgtcttgaggaaagccaaaatgtattagctcatagaattcacaaaatctaaggaataaattctggcttcaaggatgacaactcatccttgaatgatgattaacaacaacaacaacaaactccatctctacctcttagtctgtgtttccttcattctcaggttgactttctttgtgtggttacaggtggccaytactagctccagatggatgccctaaccacctccaagtttaacagaaagataacttcytttccctaagcgttctgaaagaactaaaggacaatgtcctggaattgaatttcactcccaggrtggactcacttaggttatgtcctcatcgcatgatgataggaatggaaagccctgattggccaggcctgaaccatatgaccatccctagatcaggagtggggtcagccccacccacctgaactgtacctgtacygagggtgaggaaggggtgatgcccgagggaattataahataggtaccagaagaagagggagtgggtatcaggacagttaagcagcatactcctgctatagttagtgcttgaggcagtcctgtagcacatccccacagcaatctgtactgsaagttgaagaatgaatgctatgagaactttatctccttcttatgccaccatcatagagtcaccctagtctcccaatttgcttcaccgcgcaatgtcaggagctgtcctttagagaccagccctgtctgagatcaaaagctaaacattctcgtaggactggtataaaagttagtaacatcctcttggataaaaacattgaaatatgaataaaaagcctgaaaacattcatactctttatcctagtaattccacatcttgggatctatcagtcaaaaacaaaccaaaaaaatttttaaaaagcagccaaaatgtatataagccttcatgaataaagatgttaattgcactgttatttaaaattgtcaacattttgaaaaccacaaataaccaaaaggcctaataatagaagacaagtaaattataaaatatacatatgattatattgtaggcaacccttaaaataacatctaggaattatattggtaaatattatatgtgaaaaataatatgatatttaccataatctcttcaatattgggggagaatccacataattttttgtcagtaattgtgtgctttcaaaaataagtaacaatgttttatgacaaaagtgaaagcgttatgcaagaaattagacctgtgctgtccagggtagtggttcacatgttcagagacactcgggaaagattttaaaggtagccaatttactggtttcatatggtccagctgcagaaattatagccaatagtacatgcagtccagctcgtcagtgatgacaagcagaaagccacttccattaggctcaagttttccagcttcagcctgagaatagatgggatttcaagcatctataccgagagatgccaacgaaaccagccaggagcaaaattaccagaattcttgaaccaggcagaaccagggcagatggcatctsaagcaccttcgcagaccagcgccggctgacccagccagaactggaactgggtacggtgtcaattccacttgtactcagcagtcagagaacygtgtgaccttcgatcctggcggagctggaattgaaaccgaaacatgaggcgtagagccatcacaggagcacactaacttcccactcatcaccgtgaattgaagtggagggccttaacaaaccacccagcagaaccaggactccttaaaatagtagctcagaaaccactcagaagttaaaggaacagcaatgaatggtgtccctatgagcagacagccagttgcacttcaaaatacttaaaagtttttgagagagctagcgttgagctattgaaatttaccatgtaaacttaggacttcagaagaaaattggacatcctccattgcttttttgttccttgcttcctgtggtatttcttaattattggttggtataaccagctgtttttgaagctgtcatactggtaggactatttatgtgattgtaaacacctattatttttgttactaaaggtagttcaactcggactctctgtgtgatgattaagaaatctgtccaacgtgagttaagcaaataagggaaattattgccttcattagctgaaaagttcacaggcgggtctggcttcaggagtggcatgatgaagcggctccagtacaaccactaagaaccatttcttttctgagattccagtataattaattctcttaggatattgcctttgttcttggatgcagggtcttcttctgcattacccctcctgtggtcatgagatgactcctctagctccccctgccaaatgcttccaggtccacaccacagggaaacagaacttccttcacctaactgtcaaacacagggcctggacttaacattatatcactggaataagatgcrctgactgacttcttctaattaggactcattccaaaagttcaatcggtaggagatagagaaaggcaatcctaacccaaaccacatgagcagagaagaagtaaaggataggtccccaaaggaaatgcggggtgctgccttaccagatgaatggtatgattgtggaccaattcaagcagaaacctactaccaaagataatttaaatataggggctgttatttaccaatgactgcactcttcttcatcttaggatcagggctatttggctagttgttttgagtatataaacatgatagccaaatctttgtcaaatattgagatgaaaaacacttatgtgaagagagagaatagtgcaatattgcttgtgttaagtttatcaaatcattattggattaaatgcgtcttccacatgtgacagcctgtgcgacaaaaaagacatgaaagaagtgtggtataagtgactctaaacttcagtggggtttcttccccatctgtaaaatgggaacaatgattgcaagttgagctgcttgttgaaaagattaacaaggatttctataaagtgaggtaatgcaatgcctgcctcatcagattttcagtaaatgtgagttcctaaagctgccatctttgtcctaagctcatcatcaaaggtaacctcattttcagatcagcttcctgaggtctctgaaatagcagatatggatgtaaacattaaaggacaacgtaggggccgggcgtggtggctcacacctgtaatcccagcactttgggaggctgaggcaggcagatcacgaggtcaggagttcaagaccagcctgaccagcatggtgataccctgtccctactaaaagtacaaatattagccrggcatggtgatgggcgcctgtaatcccagctactcaggaggctgaggcaggagartcgctggaacccrggaggcggaggttgcagtgagccgagattgcgccactgtactctagagagtgagactctgtctcaaaaaaaaaaaaaaagaacaacaacaaaaaaaaaaaaaaaaaaaaaaaaaaaaaaaaaaaacccaaaggacaatgtatacccaagcccaggaaatggaacattctgtgatatatcaaatgtctccctaaaaaagaacagtaaatatattgtccccatggcaaactccagtctttgaatagtgactgtcttatattgaagagattccaaaggcacatttatacacaataggtaaaaatgttatcactctttaaagatgcctaccctagatggaggagggggagagacagctccagcaacacgcctgccacctttccaaagcagtaacccaaatctaaatgtcatattatttctttgtgcttgtgctttgtagactctggaaaatcccaagtatgaactgatcatcgaggctcaagatatggctggactggatgttggattaacaggcacggccacagccacgatcatgatcgatgacaaaaatgatcactcaccaaaattcaccaagaaagaggtaaacccctgtgccaaacaccaaccaccactgtggtcacagctrcaattactgattgatgttaattcacgtaccacagcacctgctggcccccctttcaaaatcaaaatactcctttgtgggagagacgatggtgttttgctggaattctttctcacatttttattttgtgtttgtgtgtgaggctaaaatactagagcacggtgagaacaagagcactgaatcttgttaaagtccataagaaaataacttttaatgcccaagtgccattttcatagttttattgctgttatttagcagtgagttatgagagtcccactgtgattttagcataacaataactatttttttccagcaagtgcagattgagaggccagacggaacagtagcaaggaggtaaagcagatttcctagtccataacaatgtggcccaggagcttataaataacaacaaagttagctcatccaggagagccattattcattctcagtccctgtgcttttatgattatggatcatggttgttgtttcccatttattccaagggagcgatgtttggggaagggctgagtacasaagatcacattcagttgctaaatttktacccaaaccaggaagccatttgcactaagcacattctgatggaaatgtgctaagattgtggcttctttaggggcctgggccagggcatggatttgatgcccttcttactgaccaagtgaagaatatggaataggtacgatggcccctgacttttgcagagtctttactgtatctaccatggtgtctccccctgrgatctgttgcctgatttgactgtgtgagcctggctttaccattttacaaatgagcttactgtgatgctcagagaatccagagaacaagctccaaggtcatggacagaaaaagtggcagaaacaggaagtgamccaggttcctgtgattcaaaagctgcagtcctaactgtgatgctgtgctttcctcatctgccatcaatgcttccaacctccagggtgtttggagaaaaaaacctatatagggacctgcagttgccccactgctctctggaggaatctcaaggctacccagggtggcttgagacagatggatcctctcaacccccgagttccccaatggcctctgtattagttcattctcacactgctataaagaactacctaagactgggtaatttacaaagaaaagaggtttaattggctcatgattctgcaagctgtacagggatcctggctggggagacctcaggaaacattcagtcatggcagaaggcaaaagaggaagccagcacatcttcacatggaagagtaggagagagagagcaaaggggaaggtgccacacacttttaagcaaccagatctcatgagaattttatcatgagacagcactaggggggtgggtgctaaacyattagaaagcactcccgtgatccagtcacctcccaccaggccccaactacaacactgggaattataattcaacatgagatttgggtggggatgcagaaccaagccacatcagcctcttcacctcggcatccccctgcatggctcactcaggaggtagacgtccccctttctccctgtggtgtcttgggcactcaggattccaacctcaaaacagcaaagtccacgggagcttgatttgctccattctctgacttcccatgrcagggttcctctagctgctaatacagactgctcactcttgccatggttccaaactggcatttcaagaacaccagttctaattagttccaaacaattctaattcacttccaagaaattagtcacaaaaattacaccaccggggtggggataggaatgaaaaaaatatacttcagggtcaagtagatgtgggaaacactgaattgattacttttaaatggtttatttaactgcaggatttctgattaactttaaaatgctttgtgtttctctaacagggttaggtatggtctgtggggtttctcattcttctttggcctgggggcttttttttctaggcyaccttatatggcttatggagctggtgtttcatggaatgttcactgggggatttttgtttatctttataatttcttttcaacctatttcaaaataaaaactcagagcacattgtaatattcaatataaacktaacratgggaacaaaaataggataaccccaacccaaaatatgaagatggatctgtgttaccagctgtgtgagattaattagttacttcaatgccactgtgaatttgggtcctgtgacttaggaaaaaaagaaatctttgctcagttgtggactaaacactgtgaatgacagactattgtttttaatgtcattgaatccaaggaataatttaacatggactctaaaggttagctaccattccacaatatcatattgatttcaaaatatcatattgtaaacactaaaagcatacaatgttatctgtcaatcttaaaaaataaattttgaaaaaagagacactgagtagcataaggaaaatgtatctgcctgtaaataccagcaaaagcacacacattttcttcaaatggagattagacaatgagtttgagattcccaaaaggcagagctgatacctaaactcataaagagagataagtaatcagatgaaaggaagtgataacaagtacactagactctcatttggatattaaatgtcccaaaggagtctttgcccaatgtttgataatttaaattcatgattaaactttctgtcgtgttcctgaaaggctgatgttctttgttgaargggattcatacactttggatagtaacactgctgggggtaatgtgattgagaagtaaggagggggcgctggagccggaattgggttcacatcccactgaccagccatgtggtgggagcatgttaagtgctctacatcccagtctcttcacctgttaacgggctgatcgcagagcccacctcattaggtcattgtgaatgagctaatgactaaaagaamctagatagtgcctgtcgcccagtattttctaaagtatagagatgaggacagtggtgatgacaccgctgatgaggatggtgggaggaaggccatgatgaagaagaagattgtratgagaaagatattattatgacartgatgtttccaaaatgtcagaggccaaattgacattcttatcgaaagggccacctcccctccaggttaaaaggctactcttttcctttaaagtgacatatgaatctgctcaagcacttcaaaatacatggttaggaccctagagttctaggggagaagcarttctgcaggagaggtggcagaatctgtaaaatgcatcactatgagatcaggcctcgggacaaaagcgagagagaccaagagaaacctgctggggagaggagagctcctaatgaggactggctcagatgcagtggcctctaggatatggaagaggtaggaaaacaggatgccctagaaacagagaggaaagatggggcttatgatcttgaagttgaaacaaattttagagatgaaaatcaaggtttagtcattccaaaatagaaatggtgatcatttggagttgaggatgtccagaaagctctctaaggagatgttgtcctaagtaaattttttcatatcttaggacatttcgaagttgataagaatacatggtttttgggaatatatgaggtttttaaattctatcttacatgactttccctctccggagagatgtatccttttatctgtttttgaaatctatataaaagakgagttatgattgatcacaaataatagagactagaaataacactgttgaacaaaatagaggtagtttctctcacttaaaagtttggaagtgaaggctgggcgtggtggctcgtgtctgtaatcccaacactttgggtggcggaagtgggaggattgcttgagcccaggagttcaagaccagtctgggaaacatggtgaaactctgtcgctacaaaaaaaaatacaaaaattatccaggcatgtagtcccagctacctgggaggctgcggtaggaggatcatttgagcctggaaggtcaagacagcagtgagtcatgatcacaccactgcactccagcctgggtgacagaatgagacccagtttcaaaaaaaaaaaaaaaagtttgcaggtagacagacccaggccagtttggtaatgacatgatatcaatttcccaggttccccttagctttctgctccgccgccctcacggctgccttgtggtacaatagggtcactgcagcaccaggtataacagccagtaacaggaagtaagaagcagggaatgagaagaacaaaggagaaccggccacctgagtaaatgtcacttgaaaacttccccagaagactaagtgacttctgcttgcatctctgtagcctcccttacctgtaagggaggctgagaaataactacagttgtcttcagttggtatgttgcatttatagtgtttgtttaaggaaggagatactttaaaggttacttttaaaagtaaattcttattgcaaagtaagctcatccaggcacggtggctcacrcctgtaatcccagcactccgggaggccgaggtgggtggatcccctgaggtcaggagttcgagaccaacctgaccaatatggtgaaaccctgtctctactaaaaatacagaaagattagctgggcatggtggcacatgcctgtaatcctagctacttgggaggcttaggcaggagaattgcttgaaccagggagtcagaggttgcagtgagctgagatcacaccagtgcactccagcctggtgacagagcaagactcggtctcaaaaaaaaaagaaaaacatgtaagctcaattctttagtcctctcgtgttcatttacaatgactatacacttgctgagaagcaacagccacatctctcctatcctctgttgtatcccggcaggcactcaataacagagcatttgctgaacgcttcctgaagataattttaacttcagaacagcttcactgcatacgatgaacgaagattgtacttaaaattgccgctgatacatgaaatcaattttcagtcattgatgttcatgcaaatttaggttggaaacgctagtttttctctgtggagagttttctataagttttcctaatagcttgtacgtatgacttcaactaactgttagttttgaacttcttacataaggtattttgaaatgatctgagaaaatctagttaaactcttcaaatacagactttgaaatatacatgaaaacttcagcagccccatttgtggctttttcattcttgtctcttaggttattttattaaaaaaaagatttctgatttgtagctagaacatggttgatgcccaacaaatackgattgaataagtcatattttcacataaatctcaggtcatggggattaataaactcgctattaattaaagaatgtgtttgcaagtgattataaaatttaaaaaaaacagaaaatttcaaatttcattttccagttstaccttaaaatggcaattggtcatttagatttaataatttaggactttttggcaattcaatgagttctttctaaggtaaatgttttggtgtttaarctataacattatcatacctataataaaaacgacataaaacttrtaagatcctgtcctccagctggaaaatgagagatgggcaaatgctccagttttcacaaagggacaaaggtaaatggtaggagttaggagctgtcaagctgcaagtgagccataggcagaaattcacatcaggttatcaaatgaatgctggagtccaggctccaatttctaaaagtcagtgtggagtcctgaagaatacatggtgcctcaagtatcttcttttcctgtggggtattagcattttttgttttttgagacaggttctcattctgtcacccaggctggagtgcagtagcacaatcatagtttcggctcactgcaacctcaagctcctgggctcagtcagtcctcctgcctcagcctcctgagtagctgggacttcaggcatacaccaccatgtctggctaatttttgtatttttttttttttttttttggtatttttgtagaggcgaggttctgccatgttcctcgggctggtcttgaactattgggcccaagcaatccacccacctaagcttcccaaagtgctgggattaaaggcatgagccactgtgcccagccagtattcgcatttttaattaaaatattgtgttaattaactgcctaatacaacctctaatagtttttctcttccatgtctggctgcaaactctatggtcacttcttcatataacaattacataagatcattgtctatagaaatataagaacaaaaggtataggctttcttctagcagggttgatagaaattttctctgtgtcatcaagagtttagaaactttttttttgtttttgctttcacaacacattttattattggaaaacttgtgcacattttgaggaatatcatcaaatttaaggacgtttctgtcatatatatgagctatgccaagcttgttcaacttgcggcctgtgagctggcagcatgcagctgaggatggctttgaatgcggcccaacacaaattcgtaaactttcttaagacattatgagattttttttttagctcatcagctatcatattagtgtattttatatgtggcccaagacaattcttcttccagtatggcccagggaagccaaaagattgggcaacccagaactatgcaatttccagtcttcttgtgtaaaaactaatctttaaatcaatgacacatattagctaagttgtcatccacatcctcgtatgaggcatattatgagttttatgttatctttattggagtgagcatggaagatcaaatcggcaagaatttaaatctttttccaatgtgtttattatgattcattcttcttcattagtggctttattaaacaatcaagaagctattttatttcttgtgttagaaatttaccttttcctcttaataaattatttgaggcagaatgatgtcaggatacctgtttatttcattttttaactttatcacttttgattataggccattcaagttttttactaacagctttattgagatataactcacatgccataaaattcacacttttaaaatgtacaattcattggttttcattatattcacagagttgtmgaattatcattactgtctaattttagaacattttcatcgtcccaaaaagaaacccgaacccatgagcagttactccccattgcccattcccccacgctggccaccactgatctactgtcagcctctatggattagtttattctggacatttcatatgaatggaatcatacaatacgtggtcctttgtgactggcttctttcacttagcattatgtcttcatggtctgcccatgttttagtgtgtcttagtacttcatttctttgtgtggctgaataatactccattccatggttataccacattttatgcattcatccactaagggacatttaggcagtttcagtttttggctattgtgagtaacgctgctgtgaacattcatgtamaagtcattaagtctttatctgcgttttctctcacatcctaaacagctagaataaaaaaaaaaagtacccataatatcactccaaattagtaatctgtaattcctcagttgttttattgaaacatttcaaaatgcgtttctaaattgcagttaatatgacttattcaagacttatcaacttctttttgtcatgtaacttccatatgaaaaaagtacacaaatcctgagtgatttaattctcaacagatcaaacacaaaacccaaatcaagacacagaatatgatcagcaactcaaaagcttcctagggttcctgctagtcccaccacctgctcggtaaaacagctcctctcctgacgtctttcactataaactaatttttttcctatttttaccttatttatataaataatcatagtgtggacccttgggactaacttttgtgagacttatctatgttgttgcacatagccgtaatctattcatgttcgttaccatgcaaatatatttcagtttactccttcatcctactacatgtgggcatttgggttatttccagtttggggataatttaggtaatagtggaataagtattcttgaatgtgtcttttggtgcatatttgaagcttatatgtgtttctgtttggggtatatctacaggtgaaattgctaattcaacttcggttgattccaccagagtagttaactccagtttacagtggaacactcactgagaatcttgactgctatatattttccccaacatttggttttatcagttttttggtttgttattatttttagcctttccaatgtgtatgtagtgacatttccctgaggctttaatttgtatttctctggtggctgatgaagttgaccatcttccatccactggctgttgggattctacttttgggtaataccttttcaagtctttcaaccattttttaagttgggttattagtctttctcttatcgacgtgtttatctttattctggatgtgagtcctttgagttatatacatgttgcaattttttttttacactctggctttcctcttctctctctgaatgaaggtagagtcccaattttaatgaattccaatgttggttgatggttaatgtcatctgtgctctatttttgcctaccccaaaggtttaatttcattgatggatatgaaactatgtatatttcaatttgccaatttgtgtttttccaggaatttgtccatttcattttttttctctatttttcttggttggtcctgccatggagtcattctatccactttattaatcttttcaaagaaactactttttgttttgtggatttttctctattgggtgtttctttgtttttttccttctatctctttgggtatctttcaccatttatttttcaaacccctccctagaaatgatactttaatcattgattttcaatctttctttttttctaatgtatggatttaagactatataaattttcccttaagcatgactatagttgcattacataatatgtgctatgatgtattttcattatcattcagatcaaaaatatttttgaattttcttgggtcccttttgtgacttgtggttttctagaagtatattgctaaatgtgacatatttgggagtgttttttattcttttccattaatttctatcttaattctacagtggttagaaagcatccactatatgattacagtcctttgacatttgctgagacttgctttacaagctcacatgtaatcaattttgatagatggcccatgaatgctttaaaataatgttaattctgtagttgtttagtatcgtgatctatatacatcagttaggccaaggtttacaattttgttgttcaaaccttctatatatgttttattaatctgcttattgtatcagttactgaaagagtgatatgatatctataattacagatctatctatttctcctgttggtactattaaatttttaaaaacttaatttgaggctgtcttattagatgtatacaaatttaaaattgttatatcttcctaatgcattgactctttaccatcatgaaatgtacctctctatctctgcaaatgctttctgctttaacatttatctcatctcgtattagaataattatcttacctttcttttggtcagtgtcatcatggtatatttctttctgtcatttttttctttctgactttctgtaatcttatatttagtctgtgtctcttttaagtggtgtatgtatgggctttgattttttaaaatcaattccaataatgttattgttactggaattattttgcccatttacatttaatgcaagtacaacatattcgggtttcaatctaccagtctaagtatttgttttctatttgttgctcctttttgataaatttcttttcctcttatctcttatctttttcacatttacttgggtttttttataatttcatattcagctctaataacttattagttatacttcattttcatattcttgtagtgggttctgagaaattgcaatatatattctcaacttttggactctaacatcaagtagaatttttaggacttactggataatccaaggactttagaaaatttgagctccttttatcatcctcctaccttctgagatattgttgttatgttttaattctgtatcagtttatgtttttctacttatttaccctttgtattattatttatttatccctgtttttgtgcttccacatggaagaattttcccctctgattaaaaaattccttttattttaaaaatactgcaagtctgctggtaataagttctctcatatattatctaaaaaatgtcttttttgccagaatttttgaagaatattttcactggaggtaaaatcttggttgccagttattttcttagagaacttcaaagataacatttcattgtcttctgacatctatcatgtttgtcaaaaggtcagctgtcagtgttacttttatttccattgaaagaaacgtgtctcttttctctggctgctttcaaaaacattctttgtctttacttttcagcagcttaactgtgacatgctgaactgtggtttaattcgtattaattatacttgttccttaaatatctcaattcataaacccatctcttcaaatatttcttctgactcattttatcttcactgggaccctaattttatatatgaatgtgtttgtgtttgtatgcacacatacatatacaaacatacatatacacacacacataaatatatatatagactttctatgcttctgttgagctatttttaagctcaccaatcctctcttctgtctaatctactatacccatttattgatttaattacactcaggccaggcacggtggctcacrcctgtaataccagcactttgggagaccsgtgggcagatcacttgaggtcaggagttcaacaccagcctggccaacatggtgaaaccctgtctctactaaataaatacaaaaattagtcaggcgtggtggcgcccacctgtagtctcagctgccttggaggctgaggcacgagaatcacttgaaccccagagttggaggttgcattgagctgagatcatgccaccgcactccagcctccatgacagaatgagagtctgcctcaaaaaaaattttttttaattaataaataataattacactcatattttaaattatgtaatttcaaattcttttttgaataaaattatcagctgaaattctacattttacctattttcatgaatattttagtcaaattatttacaattcaatgtctgctaactccagcatccattaatagatacttctgagtctatttctattatcagtccttttctcctggtttttggtcattggttatagtcgcctggcatacctaggaattttttaatttaattttggacaacatatatgaaaatgtttagagattagtagaggctctggctgatgattcccccagagaggattcccttttgctttctgtaaacagataagagtaggacaggatgactttaagtcagtctgagatggagttggtttgtggtgggactcaggctttttcaagggtgggtctacttcccagtgttcccttctcctcggatgcagctttcctggggtcctaactgaaagtctggtatgtttccagggctcctccactttggccgaccttgcatttcacttctcagtcccttgtctctgctgaaagctctccttggccctctggcctcttagacagcaccttctgctcagatgcttagcctgctcttcctctgccctcacaatctgggaaatgccttcaagggtaaaagttctatggaatattggcctcgcttcagtgaattttccttctctccaggatcctggactctcaagtattggctgccttaccagctcttcggcactttcaaataagtggggggttttatattaaatccatatcctggttgttctagatttgagggttggtcaggaagaagctttccccaatcatcataaagagagaaaaaatctggattagctttttaatctggagtatcaggaaaatatcagtagacatggtgcggatataattcctgtggcagaaagcataatwttttcatttaaaatgtggagaaatataattaaatggcttcacagtacccactccatctcataccatttgcttcaaaatcaacttatttcartaaaagtttaaaatgtttgaagtgtctcctacttgatgatatcgataagcaagaagggaactctaaatccaagaaagctaaactttkctttctgattcttcacttgatttgacatgaatatctacagttcccttaactctttgggatcttttcctctgtttttgatagtttggtgacyccagctatgaagttagaagacacacctttgtgcttccaccctttgccagaagtctaattgaagtaaatatatttatccagtcctccaggattccgtgcaatatatttgagtgcttcaaagaaaagcctcctacttggataagcgtttacttcctttaggagaagagctctttaacatcagatgcacttgtgtctaaaccccgaccacgtaattacacattctgcttgctccaaagagattaatccagaaagccaaccacatatttcttagaagatggaacacatttcaattatctgactcaagtgacttttctggagggtggagtccaagacattttaagtaccagataaatctttgaagccgattaaatgtttttccaaatagtctagactccctcttcctatgaggctttttatagctattatagtgatatatgtgaggcttttttttcctgatactgtaaaatcacatatctgacagttttcagtgtggctgaggttttaaatcaacccaactatatgctactgggatctctatctcatattttgtacagaatggtggggaatatcaatatttaaagaaatggtatttttggagagaagagaacagtgtgatttcagtgcatgggtactagcagtttccaactctgtaaacagtgccatcactcatgattacatcatttcctgttctttcttgtcctggccaacactttgtccaaggactctaagagatcatctactgcaaattgcattcccaacttcccatcacataatcgaagagaggtttgctgcaaaaccgccaacaccttcatttcacatttatcttcacttgaaaggggtgagttcatcacttttttctcctgcaccaagaccataggaagacacraaatcatcaactawatcttccagcgttcaaatatcggaggccctggaaacagcaggtatgccgctgaatgtttttgaataaaagagagtgaagggaaacgtttgtacaaatataagcaacgatctacaaatagaagccatcatccaagcagtacagttccaactaaggaaaagggtggtatgtgcattcctggatttaattgttcatacacacaaggatgagctgtcttgcgttgttggaaatgcccacgctgattataaactctgtgtggaatgtcaaaacatctggatttttaagtgaaaaaatatataatctaccatgtggctgtttcttcaagtcactcctaaaggtagacaaggcagccagatgatttattgcattaatcactctttcataattatattcgtgatgtgttgatccccatcatccctgtgtgaacctctatgcgaattccgtgcctttgctaaacctctggttatgctcaagggtcagtggcaactcagtgacaataaaagcaatttttcactatagctggcagagtcttaccaccgagccactccatagcacagtggcctctgaagacttcatccacctccttctattcaaagataatatcctcatactaagagcaacaaccacaaagccataaaacatctacttttttaactctaagaatatgacatgactacacctccataatgcagtgtgcagaatgagaacacaggakttcagaaatagaaagccaagagcagcataaatggagcctgttggaagatgaaacgtccaggtccacactgcacctggaagccattttgtactgaacaattttagaagtaagatcatgggtctgatgcatacatggtttcaaacactgtccacctggctacagcctgccttcgtcttaggccacacgggagctctgtttacccctacgtgccaagctttggcrtgtctttgtgccactacacactctgttcccttcttcccggaatgccttttccttcctttgtgcctgaaaaattccaatttatccttcaccacccaacttataaatcccccaggcactttgttacttcctcttccttgtcccaaaacatgttagcccccttcctagcctagagttaccacattgcctttcgcttgtggactcacaacccctctccctaatccgcttggaatgctttgctctttaagcccatctccttttcatctccgcctctagggccaagcacaggggcaacatcaagtgtttaattagagatgagtttattattcatgcagcaaatacttattacagaactgtgttttggcttctgatgtactattaactatcctttcattcactattatatacaatgttacctgtataccattatatgctgcgtataagtaatactctattatgtatgctattctattctaatatgcacataccctaatatgcacatattctagtctaatatataaatctattgtaatatgcacatatcctaataagcacattttctattctaatatataatatctattgtaatawgcacatatcctaatatgcacatattctaatatataatatctattcttttctcatatgaacatatctcartatgcacatattcaattctaatatatatctattctaatatgtacatatcttaatatgcacatattctaatatatatttctaatatgcacatatcctaatttgcacataatatctattgtaatatgcacaaatcttaatatcacatattctattctaatatataatatctattctaatatgcacatatcctaatatgcatatatctattctattctaatatgcacatatcttaatatgcatgtattctgttctaatatataatwtttattctattctaatatgcacatgtcctaatacgtacatattctgttctaataatatatgacataaaatattaaatatgcaatattcaacttctggtgtgctatataattatttaattgcttattgccactctcactaaattagaatgtaagctcctcaaggaaagaaactatctgttttgtcatctgctgtggtcccgcacccagcctgccgtgtagtgcatgaycaaataactgatgaatgaatgaataaatggtcgatgcttgacaacaaagacaatcagaatctctgagtcatgttgttgcaaagcacttgcggccaggcatggtggctcatgcctgtaataccagcattttgggaggccgaggtgggctgatcgcctaagctcaggagttcaagaccagcctgggcaacatagtgaaaccttgtctctactaaaatacaaaaaattagccaggcatggtggcatgtgcctgtagtcccagctacttagggggctgaggcaggagaattgcttgaacccaggggttggaggttgcagtgagccaagattgtgccactgagctttagcctggagaacagagmgagactccaaaaaaaaaaaaaaagaaaaagaaaagcactaggaaggcatctcattcaatacatagttttatagatgaggggtcctgctcaaggtagaaaacagatcccagaccaacctcactgtggcacaaaatgctgctgccgatgagaaacccaggctccagccctgcactaacatagcaagtcacaggatcatccccaagatttatcattgcactgtagtctgccaagagccgagacagttggagttaaattccatctcagaagtgaataaatgaatctacataaactgcagagatccctgaatctacttccctatcggtcaagtaaaaagaaaaaaaaatcaagaaaactcaatgttaataaataatacataaaggaatcgttagagtggagacaggttcaacttatcctgtgagttaaaaaaaaaaatgaaagcaagaaaatattccacagttccagtgtgctgagctcattcttgtgagattaaacaaaataattcaggattaatatattcatttctttgcaaactactatctatttcagttacagactgagtatcagtttttccagtgttggcactttatttttgctgttgaccggctcagatctgaaagacaggattttatgagaagcgtcaccttcagcctgctttgcctgtgtgtgcctgcgtttgtgtatcacacgtgataacgttatgctgtcgctttccaaagtacattcattcattcattcatccacctgcttgcccatcagacatgtatgtgcgctatgcctcctcttttccaggctctgtgataagctagagygcagggcagtgagtgaagtgaacagggtccctgacctcacgaagcatggctggggacaaccagccaaccagcacatcgatcctgaatgacccctcatgatgagatggaagagggtaaagtcataacagagggggactgcgagggcacttggcatggagctcagggagggcttctcagaggaggtgactgtattcatttcctgggctgccataacaaggtattaccagccatgtggcttcaacaacagatgtttattacctcacagctctggaggcagaagtccaagagcaaggcactggcagggttggttcctttggaggctgggagagagaattggtttgatgcctgtccccacacttctggtggccgccggcaacctttgtgctcctgggcttgtgcatgagcacgagcatccccccagttcctgcctccatctacacctggcttctccccgtgcccatgcctgtgtccacatttcctctttgcagaaggacaccagtcatatttgactagggcctaccatagtagcctcactgtaacttgattctctctgtcaaggtcctctttccaaataaggttacagtctgaggtcctgagggttcagatttcagtgtatccttagggggagacacaattcaaagtctagcagtgacacagaagtggaggatgcagatggaagcgtccgtgggaagaccccggcctgggaagggcatgtctggcaggaggaactgaaagccacccagggtgaccagagcaacatgaaagagtcagggagggtgtgaggctggagagggcgggaggggccagatctcacccacaagacgaggaggctggatttattccaagtgcatggggaagacattggcagatgttaaaagagatagggaggggggccgggctcagtggctcacgcctgtaatcccagcactttcagaggccaaggtgggtggatcacgaggtcaagagatggagaccggcctggccaacatggtgaaaccccgtctctactgaaaatacaaaaattagccgggcgtggtggcatgtgcatgtagccccagctacttgggaggctgaggcaggagaattgtttgaacccaggaggcggaggttgcaatgagccgagatcgcaccactgcactacaacctgtcgacagagcgagactccgtctcaaaaaaaaaaaaaaaaaaaaagatatagggaggaacattccaagactcagagcccccatgctgcttaggaatactgttagtccacaagagtgagtcaatggctaggagattgctggggatgccaacagcatgagacccaacacctatgtccttcacccaagtgggaataacgccaaccacaggcagccaacatgagtagacgtttatgtagtaagtttcaagcttaggaagcccttccacacgccacatgctctctctcacctaatacttgcaccgtccagcaaagagggtcttgttgtccctccacgtagatgaggaaactgaggttaagtggcaccgattccttccctgaggtcactgggagctacatggtaagagtctggcctctgcatctgcttttcccttgcaaactcaaagagacgtctctccttcaagttgcaagtgtcctatcaagaacggcaattgtgtcgtgagtttctgtgaaaagcaagactggtcattccatcacttctgtctgtccaacatgccccagacttgctmttttggggccccatgctgttaagtaaacatcccccagccagtgtgaatatctgaaagcacctgctttgtacgcagcagggtcagagacctttatatgcacgccctcragccctcctcctgccagcactgagacaggtaccatgatcgtaatacccctttcgtgggtatggagatgaaggctccgacagctgaagaacttacccaggctccagaccccaactctcaaccctctgctaagctgcttctgtcccgtgaaaggattagcaatttaycagtccagtgccagtagagcccactattcaggcatttctgccggattcagtggcagccattatatgactctccagtggtctagcccttggggtcagctctgtaggattccttgccagggctattcctcggggaatacctatcctgtttttcttgttacacttgtgcaccaagggtttgctgaagcagcccaggtctattaccaccgttttccactctgcttgaacttgcaaacttcaacttactgctggccctcttgctctcacctcacctgccttttttttttttttttttttttttttttttttgagatggagtttcactctgtcacccaggctggagtgcagtggcatgatctcggctcaccgcaaactcctcctcttaggttcaagcgattctccttcctcagcctcctgagtagctggaattacaggcatgtgccaccatacccggctaatttttgtatttttagtagagacgaggtttcaccatgttggccaggctggtctggagctcttaacctgaagtgatccacccgcctcggcctcccaaagtgccggtattacaggtgtgagccaccgcacgcagccacctcacctgcctttctgttcaaatcaggacaatgttttgtgcaaggcctggatataactacagcacacaaaagatttctctcctgggttcattaggataagttcaagttaccctctgtccctccgtcatttcttctcattataaaagggttggagggcttctttcaatagccagtgaagttgattagcaaccttgtatctttattttgataggtccaatgggaaaatatactaatcatttcttatgagcaaagaatagataaaaaaattcatccatataaataacttttcgaaagctaattattatcaagtgcttatctgtgtgaggcactgttcgagatgctttgggaactgtagctcatttaattctcacaacagccctatgacgtaggtactcttattgtgcccatttcacagatgaggaaactgaggcacagagaggtttaggacgatacctgagacttcagcgtggtggggcaggaatgtgaggtgtgagtcagagcacctggttccagaggcagctttcaaacacagcactgcactcccctgagcttctacacactcttccggccccatgggattccgaaatgagagaaatcaggcccccaaaagaccagccttcatcaggagactcggacgagaaagtcaaaaaacctatgttgaayacagcaccattcttgcagcagtattaacttttccacacttcagtatattcatgtgcgtatctactttaaaatcttcctgcatcaccatcaatagcttataattgatactccaataattakatatcataattgaaatccaggttttactcactggagaatttgggcaaagtcctgcaaagcaagagaaactttagttcattawtgaggctcatttttacattagcccgctctcgctacataacaatttttaaatctttttacatttatgatagtcgttactgcagtttcagaatcattartgagataatgtgcttcttcaagttcaccagtctctgtgaatttgatatacttgttctgagttagcagggttgcagcggcctcagctttttggttcatgcagtcaccgcatgcctaccaaacacaggctgcgggctgaaggctggagattgaaataaggcagcaaattcttgctttcatgaggcttagcagggaggacaggtataaaaatagtacaagggtgartcttacaaataaattcagagtgctttgggaacatgacctaagggaaatggacccgaagtctgggaagktcagctcatgaagtgacatcttgtcctttaagacttggctctgctaggtagagtaagaaggggtggtacaaggttagcacaatccaggaagagcaaacattgtgtgcagatgccctgaggcatacaagagcccggttgaggggctgagaggtggggccagggckggktgggagaggtggcacacacccagggactcwgtcccctattacagactccaggaagccatgcatttccctcgagttcccccaaatcactccccagtcacgattaacgggctctcttttctttcacttgggccctttcagcgccttgtttctccctggatctcagcatccttcccagcatgcactatcggctttattgcaatcggtttctgcgtcttctgggcagcccctcttctggggctccttgagggcagacagagcttcactcatcatggtcgtccccttcggcctcggagcggtgtgcacagagggagcacaaagaatgtccgttgcattaaatcaaatctaacaaacagcactttttcccggcagctctacaaataggaacagrtgtctttgctaatcgcccctgaatgcacggttcaattcagggctgtaaatccatatatcagagccagaaccagttagctrtctggtctataataaccaygcactggcctctcacatcatgggcactggaccctgtggctgaaaagaaagtctcaacaaacccaaacaaactgaattgtccacttgtaccagcctcacacaggaatggtcaaaatacctcttttccttcagctctgggaaattgaaaagacaaatcasttagcggaagcctaagactagaggctcacccttcgacaaggaaattcacttgtattttctccggagtcaaggatcccctgtttgcactcatttcgttgttaggaacagaaatccactttcaaccagcagaaacgaatttcctggaaggcattggtactcatcactgggggaggttccggggctttccagcttcaggtgcagctgcgtctaagccckcagacaatgtggacgggatgctccttgtctgcagctccagctgtcagctctgcctgtctctctatgttggctttattctctgctaggctctctccttgtggcaagaaaggtgacttctgacagccctgatgccttatacacaaaggcaggaacacccacatcctctctcccagatccaaatgctactctcatagaaagacttttggtctctctgggtcacagtaccccctcagaccgggcattgattcccaggaaatgatgagataacgcccccacccctgccccaggtcagcagtccccagcctttttggcaccagggaccggtttcgtagaacacaattttttcacagatggcaggggtggtgggggatggtttcgggatgacactgttycaccttagatcatcaggcatcagttagattctcttaagaaacgtgcagcctggatccctctcattcccagttcacartaaggtttccgttcctatgagaatctaatgccaccactgatctgacaggaggcggtgctcaggcggtcatgctcactcacaggatgctcacctcctgctgtgctgcctggttcctaataggccatggatcagtacaggtccgcagccccaggggttggggacccttgccctagatcacctgcccacctctgggaaacaagatggggagaaaatgaggcctgtggttgactgcaccaacgtgacctcaaggagcaggttgtggtggttccctgaagaaagcaatgcccccagatcaaagctacatttcccatctactscagatcctattcaaacagaaccagttcccttgagcctggccatgatttgcatgtgaaaagctggtgtgttgcagccagtctgcaccagctttgggagagctgattgccgcatgtcttgccggttctgcatgtgtgcggtgatatcgagtacatagcttgaaattggccatggggggaatatttaagcasaaaaatggacacaagctacaaatcagggcttttccccctgaattgccattaaacatttaccagcacaatactgtgggttagttatggtgtttgcccacctaaagaaactctgtgtgtgtgtgtgctcatgtgtgtgtgtgtgctcatgtgtgtgtgtgcatgtgtgtgtgcacacgtgtgtctatgtgtgtgtgtgtgtaatttaagccaaaatgacggaccctgtgttatctttgsagatccgtggtctcaggccatgcttaattcttccacgctggtttattggttcctgtgttccaaagctccgcatgtaccctgtttaaaggacggtccacttccaccctatacagttggagggtcacccattcatttgatttcttcaggtccattttcttcatcctccttccacatgctactgaccatcgctaacaggactgcgtgctgagagccgagcctgttacctgctttccccatgacagggctgtctgcttcctctccctgtcccaagatttgttctttacctctcagaactgcagaaaacaagttattttctcttggcatttgtgccgctctttttcctccctcttttggcttcgaaaaagtggtgggtctcatgcacttgtaattagctggagcacatctgacccatcgtcccctgrgggagggcagcttggtggtccctagctcaagaaggggcagcccccaccccctgmamttagggaggggaggtctacagctttttccaggaggtacctcagcccaaagtctgtgaatccacaaaagcaaggtcggcctacccttttacgtaagccacgcggtagccagagacaaatgcaagcaatagtgtgatgtgagatagggcagaaacactgcaccccaaagtcaggtgtattggggtctttccctgggagtccgatgcagcaagcaacactgtcacaggtaaaacgtgaggaaacaagcttgcttcttttttttttttttttcaaagcagggtctcactctgttgcccaggctggagtgcagkggaacaatcacagttcactgcagcctccacctccaaggctccaatggtcctcctatgtcagcctcctgcgtagctggggctacacaagtttgcttcttattcctgagctttttaaatttcttcagctgattttgccgtaccgcgtgtgccggtttcatcttcctcctcgttgtaattgtttcatgaccggagtcaatgctagaggccccgaggaatgcaggaaagcaccagccatcaggacgtgttgatgagacacacactgtctgggaccttctgtgaataacatgattggcgttgtcaccgggataactgcaggagagatgtgaaagtgcttaggatgtagttggcgctcaggtcattctgcaggcgttaatgaagcacgtgctatgagccagggtctttgctggggacctaaagatgagtaggtcagtggacaatatttgaatgcaagtcacaaatgtgtggtttccaaacctggactgggtggggctgacagggatttcttccattttttctgtttatctctgaatggttcctttagctgctsacttggcaactgaactcaacgttgtcctctgcccccaaggctctcttttgtccattctctctttctcggaggatgactttgcctcctacttccaattcaaaataaatcctgctggaagaagcaacggagccatgaccaaaagcagactttgggtcgagactgccgagtctctacttttactgaatttagtcctgaatcccacacagactccctgtacccgctctscctaggacgcctcrgaatggtcctccgtgatgccgctgcgcctgtgctgtctggaccaccttctgccttggtgttctgacaacatcctagagcatctcacctctctcggctctttcccagttctcatgctccctgatggtccttaaaaagattcctattcagccaggcgttgtggctcatgcctgtaatcatagcattttgggaggccaaggccgatggattacctaagctcaggagttcaagaccagcctcggcaatatgaggaaaccccatctccactaaaayacaaaaaaaaaaaaatgagctgagtgtggcagcctgcacctgtagtctcagctactggaggggctgaggcaggagaattgcttgaacccrggaggcagaggttgcagtgagccgagattgtgcgcctgcactccagcctgggcaacagagtgagactccgtctccggggaagaaaaaaaaagattcctattcatggacctaataccccacttctaggagtggagtgggataaactagacagagatgaacatacatacagcgaagcagaattcctgagaggcctctgatctgaatagtgccaactccaggcattagctacaaaagaccttaattgcaaaactttctggggacttttatctttcctcatctggagtatccacaccattgtcctgcctgcgaggaatttggatagtttattttgtttttcattttgttttgttttttagacagggtctcactctgtcacccaggctggagtgcagtggtgcaatctcaactcactgcagtctcggcctctcaggctcaagcaatcctctcacctcagccccccaagtagctgggrttataggtacacgccactgttaccggaaagaggtcccaatcyagaccccaagagagggttcttggatcttacacaagaaagaattcgaggcaagtccgtaaagtgaaagcaagttttttgggaaaatcaatgaatacaagtawggstacaccatagacagagcagccccaaggrccaaaggactatttcttgactgtgtgttaaacaaggagcagattattcaagacttttccaggaaatggatgggcaattcccagggctttttagaccgtatagggtaacttcctgacgttaccatggcatttgtaaactgtcatagcgctggtgggagtgtagcagtgaggacgactggaggtcactctcatcgccatcttggttttggtgtttttccggcttctttactgcaacctattttatcagcaaggtcttcatgacctgtatcctgtgccaacctcccatcttrtcctgtttatgtctaaccgcctgggaacgcagcccagtaagtctcagccttatttcagtcagcccctgttcaagatggtgttgatctggttcaaacgcctctgacactrccatgccaggctaattttgcatattttttggagaagcagggtttccccttgttgcccaggctggtctcaaactcctgagctcaagtggtctgcccacctcagcctcctaaaatgctgggattacagatgtgagccccggggctctgcctggatagtttattttttatgtttgtcacatcgctcttctctgtctccactgataagtcacattccagacccttttatccatgtgatttcttgagatatcaagattcctacagacctgggaggaagtgtcgtacatctttgggcaaaagctgacctgagacaataggcaattgcccttgatgctaagactaaccacaagctcttcccagtctgtagtttttatttgcacatttgcaggctggagtgtgtcctctctatctagtcggtatttyaataggaggcgaagatctctgtgaggcaatctggggtttttctagctgggcccgtgttattcatggccagccagctctcctggtttgtttatacctttttcccacctgaaaccttgatggttgatttgtgaaataaaaccaaaattgctcaatctgtctaaaagctttctgtgggttttaaacttacctattttttaaaagaaattttaataatgcttctggcttttagaatcagcaggaaacctacaatcaggattgttgtatttgcaccaatatcaaacataaggagcataagtaataaggaacccagtgccctttgttgaatacgtaaattttcatggtaactggtaattgctggcctataaaagctctcttccttatgttcctgctactgagtaaaaatgatttttgtatttgtaacagactagattcatttcaaatggaaatattaatctgtaattgttcttatacgagaaacaccaagttcaaggcaaaaataacaaagccagttaagcatatgtttcatacctgcacaatttacctaaatagagattgcccaaagaagttttgctggcttctgaaaactttctcataagattttaawaatatattttatggtcaagaggttgtagcatcctcccaggactaattcatatctagccaagaaaaattacattttcccatttacattccaaagtctgaactgttattttataaatgaattttccctccaattcagaaagcactggctacattacaaattttaatgctactattmtaggatcataattttaaaaacccagggttctccaagggcttcagcagcatgccatctctccactttattaaaatgaatgaacagatgtacaatttatttctgccragccatcatctaaattcataagctatttctcatgtgtctgaaatccacgttggtttcccattttctttgccttagaaaaaaaattacactccctcatttatcactctggggacataaacgagaagtctactctccacttcattcactttggactaatatcctcgacacaatttaaatcccatctcttcmagactattcaatgagagcaaggcagtggaacacccagcatccaattggaaaactccttggccatcaatgtagaagattgacaagctcagtcacatgagcttacaccttggcagatgcaggggaagagagcttacaacagcgttgaatccattcaggtagatgggacagtctagaaccatcacacttaaaagtcaacgtcagtaacagaaatgtattttagctgccgtatttcatagagccctgataccacccttacttcccacatgacctgtcatctgacagcaggctggcagacagscatttaacagattcatctcgggttggcaaacatctagcctagctttgaaaacccacgtgttgatctcagacctgcctttacatccctgcaccaccattttctgatggtgtgagatcaggcatagtttttaacctctctgagatctgggttatttttcagtatgatggagataagtggacctgctttgtaataaaggttaaataaagtgcaacattttgatgctatgaacctaaaagtatctgggacaggtctcagtcaatttagaacgtttattttgccaaggttaaggacatacccataacgcagcctcaggaggtcctgatgacacgtgcccgaggtgctcagggtataacctggttttatgcattttagggacacatgagatatcagtcaatgtgtgtaagatgtatattggttcagtctggagagtgggcgatcagggagcttacaggtcataagtaggtaacagacaaatggttgcattcttttgagtccttgatcaaagacggcggtagaggaatagtcacttatgtcttagtctagctcagtgaatctgcatttttacgtaaacartcagactgaggaagcaattagatatgcatttgtctcaggtgagcagagggatgactttgagttctgtctgtcctktgacctgcacctgtgaagatgagcgatcagtttaygttgcccaggtgaaattcaacagaagtttttagagtaaagatcttgaggcccacaaggaatttccttgcaggcaaattgtgagggagatattttctatatttgtagctatcttattaaaaataaaatgggagcaggtttgcctcccataggtcccagctagacttttccctttagcttagtaatygggggtcccaagatttattttcctttcacaatgccaaggtcaataatatatggcaagcacagtgcctgacatgtggttcagtaagggggccattgtgatgaagatggcatcccggagatacatctctgccgcagaacagctgggctaaaagagctstcctcttcctcagttctgcatttgctggcatggttctagtgaatgtaagaaaggcattttgcagccagcagatgcagtcaacgagcgcaasttgtaaaggctgcagaatgaagccctcaggttatctggcagaattctgctcctggaagaattctatttatgagatgctgctggaattgagcaataaaacttgccggagtctctagtttcacatggaaaactgccctgtgtccataaatgcttcttgggtttggggctttaatcagattttgagtgtttggtttgttgttgtttgttctttcggtggccctgttgcttggagaagaaacatcatgttaacttcatttgcttgaactctgtgaccatcctgtgatttcaaacacagcttgtctttttctcatgtaatgtttttgggaggggaaggtgggttctcctgatctcgggaagatccacagcaaaatgatggagttctttcatttagcagagttacagcttgaggtggacagtgtcaaaatggcaagctccccaaagaggaaaggaaagagggatgtcactcyaggatgcgccaacgagatgctccttaggaaccacrgaagtgacacttgtcagcatccacacaacaaaatgttgatgaggggagccagccttggtgactcctagcagctcccggcagcagtctgtctgcctgtgttgtcaacagtccctgaattaaatcagtcactgctgccgccaatgaacttgtaggttgttgtgggataaggggccctmggcagtttcttcatctctgcttgaccaaaccacgcatcaaggtcatggatcccaggtgcccctgaagacattcaagaagtctcgttcgccagctgagcaaagtcatgagacaaactgtccatatgacaagcctgcttttaggctttgacattccagcaaggaagcaggtgctgctgacagaaatgtggtagtttgagagaacaggattttaaagaagaacgaacccaattatttkgatccacagagtcttagaagatagaatgcagggaggaggcaagcagggaggaaagagaaggagcttttatgtttcctcattgttactccatcacactgtcagtttgactagaagggctgtttttatttccctgaatcccagttctgtttctgagttcttattcacagggcaggatgggctgacactgtagagacgtgtcctacagtgarrtwmgagatgactcctaatttcagtcacatctccatcagtcagcccctcttaggtattgcacaagttccttagatgctttgggcctcagtgtcctcacttacagaatagggattttggtaatgaaggccascagctccgtgcatgacaaggtgctgaatgctttctgtttattatcacgccgaatccttatgatttctttgtgaggtgcattctactagaccctccagttctcagatmaggaagctgarggttagagagctaaggtaatgcacccaggttacagcaggttatcctcaagttccccacggagtagtgacattttgtcaccattgatgctatattactgataatgatcaatagataggttactggaaaggggtccagatccagatcccaagagagtgttcttggatctcatrcaagaaagaattcagggcgagtccatagagtaaagtgaaagcaagtttattaagaaagtaaaggaggccgggcgcggtggytcacgcctgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaataaataaaaaaaaaaaaaaaagaaagtaaaggaataaaagaatggctgctctataggcagagcaacagcatgagctgctagttggccatttttatggttatctcttgattatatgctaaacaaaaggtggattattcttgggttttccgggaaaggggtgggcagttcccagaactgagagtttctcccccttttagaccatataggtaacttcctgatgttaccatggcatttgtaaactgtcatggcactggtgggagtgtcttttgacatgctaatgtattataattagcatataatgagcagtgaaaatgaccagaggtcactcttgttgccgtcttggttttggtaggttttggccagcttctttactgcaacctgttttatcagcaaggtcttcctgatctaaatcttgtgctgacctcctatctcatcctgtgattaagaatgcctcaacctcctgacaatgcaacccagtaggtctcagccttattttacccagctcctattcaagatggagttgctctggttcaaagcctctgacagatactgcatccatgaggtgaataaaggtggcaccggtgttcattttattggctaagaaccccgaaattgtcacattgcgtgcagtggttccggaggtttgacctcaccgtagaagagcacatctgaagttagttttgaacatattgacatcagtgttttgaaactcctcaccgctttctaacagtctttccagttagctgagtcagcacaaaaggccttagccaggtctgaaaggagtttgttttcatgttgcagggagtgttttctaataagggtttttttctccattgaaaacatctcttactttgcgtctatcattatgatcttactcggagagaaaatggtatcttcctgggctgattgctcattggtggaggcttggcttccaggaagaygcacactggctttccgtagcactttctctcgtttttgtttccaaaatcactatttattgcccttcaaaacaggttgcgtttgaattagggttctgggcctgtacagtctgtgggagcscaartgcaaagtagattccatcataaacaaggtatcccccctccaaattaacagtaaaataggccatgtgatcccagaatgcatcatttcaggcttataaagaaaagcaacttartttccttatttttccattkttccatgatcacaggctcacagaagttgcaaaaatagtgccagaagcaccttgaacccttctctcagcttcctccrtagtaacatcgcctataactgtagtgcaacaataccaagagcaggaagttcatgtgggcacaatactattaaccagacctcacgaagtctccacccatttttgtgtgttttstgtgtgtgtgtgtgtgtrtgtgtgtgtgtgtgtgtgtgtgtgtggtcctacgcatttgatcacacgtacagatttgtatgaccaccaccaccatcatgatacaggacagctgcatggtcacagaagggctacctgtcttgctactccttattagttgtattaaccttccccttactcttgggcttctcccctggcaattattaacctgttctccacctgtagttttgtcacttcaaggatggtacataatggaatcatacaatatgtaactctttgatattaactctttttttttttttttgagacggagtctttcccagccacccaggctggagtacagtggcacaatctcggctcattgcgacctccgcctcccaggtttaagccattctcctgcgtcagcctcctgaatagctgggactacagatgcctgccaccatgcccagctaatttttgtatttttagtagagacagggtttcaccatgttggccaggttggtcttgaactcctgacctcaggtgatccacctgcctcggcctcccaaagtgctgggattacaggtgtgagctaccacacctggctgagatgagctcttttcactaagcatgatgcccctgagattcatccaagtactcacatcarccgatagctggttccttttgattgctgagtgatattcsatggtatggtatgccagagttcgttgaaccattcacccactgaaggacatttgactttgttgctagattgaagctactgcagwtagagccaccctgaatatttgtgtaaggcttttgtgtgaacatacatttccatttttctgggtaccagctgctggatcatatattaagtgcatgttagttttataagaaactgcctgttttccagagtggctaaaccattttcatccttatcagcaatagaggagaaatccagttcttccacattctcaccagcatttggtgttatcactctttttcattataaccattctgttcagcatatagtaatagctgctctctggtttggtgtatagcaatatgatgttaatttgcatctccctaataactaatgatatgaaacatctttgcatgtgcttatttgccgtcagtgttctctttggtgaaatgtctaactatgtcttttgcctattttttgttttgttttgttttacaggccattttcaggactttaacttttgcccattttcyttcytttttttttttttttttttttttttttgagacagagtctcactctgttgcccaggctggagtccagtggtgtgacctcggctcaccacaacctccgcttcctggggtcaagtgattctcctgcctcagcctcccgagtagctaggattgcaggcacatgccaccatgcccagctaatttttgtatttttagtagagatgcggtttcaccatgctggccaggctgatctcgaactcctgacctcgtgatctgcctgcctcggcatcccaaagtgctgggattacaggtgtgagccaccacgcccggccccattttctaacagaatcttttaatgtttgagwgttgagagtcttttatgtagtctatatgcacatcctttgtcggagatgtggcttgcaaatatttatctcaatctgtggcttgtctgttckttmtcttaatagaatctttcacagaacaaaagtttttaatttcatgcaagtccaatttatacttttttcttctatagattgtgcttttggtgtcaactctaggaattctttgcctagccctaggtgttaaagattttatcctctgttttcttctacaaatttttatagttgtatttttacatctaagtccatgatcctttcggaactgatttttttatgtaaagtgtaaggtttaggttgagttcatttatctgccagtggacacacagytgctccagtagccttttagaaatagctatccttcttccattgaattgctattgtccccttgattaaaaaaaaaaaaatcatgtgggtgcaggtgtatttgtgcaggtctattccgtgtcctccgttctgtcccattgatctatgtctctgtctcaccagtactgtactgtcttattaccggagctgtagagtaaggcttcacatcaagtagaatgagtcctctgctttattcttctttttcaaaagtatttcagaaaacattttttttcctttttcgacttttactttagattgcaggaatacatgtgcaggtttgttacgaaggtatattacatgatgctagggtttggagcatgatgaaccctagcacccaaattggtagtttttcaacctttgctccttccctccccacttttggagcccccagtatctattgttgccatgtttatgtccatttgcacccaatgtttaactctcacttcggactgagaacctgcagtgtttagttttctgcttctgttcattaagacaaaagcctccagctccattcatggtgctgcaaaggacatgatttcattattttctatggttacatagtattccayggtgttttctaacccaccattgatgggcacctgggtttgttgcatgtctttgctgttgtgtatagtgctgcaatggatatatgggtgcatgtgtcttttcagtagagtgacctattttcctttgagtatctactcagtgatgggattgctgggccaaatggtgcttcaagtcttaggtctttgagaaatgtccagactgctctccgcaatggctgaactaatctacattcccaccagcagcatatatgtgttcccttttctcctagttctaccaacatctgtaattttttgacttttgaacaaaagccattccaactggtgtgagatggtaactcattatggttttgatttgcatttctctgctgattagtgatgatgagcattttttcatttgtgaattggccattcatatgtcttctcttgagacatgtctgttcatgtcctttgccctctttttaatggttatttgtagaaaaccattttaaatacagtttgaactcaacagctttttatcccctctaaaattatttttctgattaaaacataactcatttccattgtaaacaacattaaaatatcataaacgtctaatagaaaaatttaacagatctcgggaggagccaagatggccgaataggaacagctccggtctacagctcccagcgtgagcgctcccagcgtgagctacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggatgcacctggaaaatsgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacccccgagcagcctaactgggaggcaccccccagcaggggcacactgatacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggttggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatmaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaagcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgccggagaggatgcggagaaataggaacacttttacactgttggtgggactgtaaactacttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctataacttagagtataataaaaaaaaaaaaaaaaaagaaaaaaaaaatttaacagatctctccacacacctgagagaggactatgttctttcccttcgtatatatcaagttctacttttttatttacaaacgtgtgatcacactctcttcagtatattgccatctgtctcacgatttgtatctttttccttgtctgtaaaaagggagaactattaataatactctatttctttagtctttggtgaggatcaaatgataaaacacatgcagagagtttaacccagcacctgctacatagtaatgtctttgttgatgttatttttattgttcccccttcagcttatgctacctgctttgggtgatcttggcctttcttggtggcaataaagggcagagaaactccataatgtttagtaatccaagtcagtttgcagaagcagtcaggagaatgggttcttccatcactcagtccaggtttcctaccaaatagaatgaatgagacaggtagtactgcaaattcatagtttacttacgttaatsataatgtcmaacatgtcaacagcatcctgkagagccccccaagtttcctgtccacttgtccactgtacagccacctacccacrctttacgtactacccagctcttcctctaagtgggatcctcccagaaagccagagctccgctcctagagagcgtttgaggaacctgcatgtggtttgtcttatcttcakatctttaacataagctgtaacgagggcagctagaagcagagcctatcagatcagcccccgccagctccaactagtgaaacccaacagagtccttggaccctgcagcctaagaacataaaaattctgtaatctccttctctttatctcwsctctgccttcagatgtgtcccttgaatggcccacattctcccaatttcattaacttagcacattttatttccactaagtaaacccaaggtgcttccatggtccaatataacggatttcccttctgatccataatgccaaacaatatgctacttcattccctttaatggctttgtattgtgttctgttttatagatgtcccaccatttgaccaacttcacataaatggacattttgatggtggttcctggttttcccttttataaacattacagcaataaaaatgcttgaatgtacatcttcacgtacatatatgaaagtctttgtaggataaactcccaaaagcaaaatgcctggcccaaaagtatgagcactttacattgcagtttatagctctttttctaatatgattaaagtatttttaaattaccttcacttttgtcatccctcagttacgctggtttctgtattgcatagattcctagcctgctccactgcaaatgggctgccatacagaggatgaggttcatggtccagaaacgcatctggtactcragcgcagagcagaggtggaattctaggcctgtgaatggttcacatcagcagtgggggtccccagtgaagtaggatcccaaaggccacagcaattggacggatactaatatccttcatgcttccaygggcatgaacttgaacttgcagtggaagcctctaaggcacagcaaggcaggagcagatatgaagtatgctttgcagctgtagcttctctagaatccaggggctaatgatcaggagggaggtgctaaatattctgggctcctcgcttggacttcaaacctacaagctccccactcttgaacctaaccccattcctgagtttycttctatgctcacatccactcccaaatcctctaaccaccctgagctacattatattaaaagggctactcctcatatgttcaccacagcactattcacaatagcaaggtcatggaaccaacctaagtgtacatcaacgrttgactggttaaagaaaaggtggtgtatacacaggtgaaatactatgcagccataraaaagaatgaaatcctgtcctttgcagcaacatgggtggagctggaggctattatcctatgtgaattaactcagaagcagaaaatcaactactgcatgttctcacttgtaagtgaagggtaagcaatgggtacacatgaacataaacgtggaaacaatagacagtgaggactccaaatgcagggagagagagagatgttggggatgagggctgaaaaaccacctatcaggtacagtgtttgctgtttgggtaataggtgtgctagaagcccaatcttcaccaagagacaatatacccatataacaaacatgcacacatgcccccccaatctaaaataaaataatttttttaaaggtactccatcagaacacccccmacctcccgcaccctcaggtgtggcattacagaaacctcagcagcaaagccccttccccatccttctccaatcaccagagcactatgctgactcccagaaaggccacatgagaagaacttgctagcccctgcaggtggcccgttcttggtggtagagcataagggaaggggcagggaaaacaggaggagaggaggcatcatttcctgtaaatctagcacaggcttggtttgcttagacagtggaaatactaaaaaagtcaaaaagatccttcatcatacacaagaaaaagggagacgaaaattgaggtgaaaaatcattctgccattacttagaaaaccaattgtgaatcctttcctggttttaaaccatagctacataaactgggggaaatgtctgctgtaggtttgctccacatccagcctcgccccgttgggagaagccttggagctgtatgggttggagcagtgtctgtgtagagtactgatgctctcccactgggccctagtgtgggaccatacgtgaaagccaccaggtagggttgcacatagactctagactcagaccaaccggggtctgaatcccatctctccactccctaactctgctaccctaggcaagtgcttgtacttctctgtgcctcagtttcctcacctgtaatttggagctcatgacggtaacctaccccactgggtgagtagcgtacccgggtcatgacatgaaggatgtatgtaatcgttagctgtgattatcaccattccactaataagctttctgttgctgccgttctgcagggctcaactttctttagaaaatagttgtgttggccggacccagtggttcacacctgtaatcccagcactttgggaggccgaggtgggtggatcacctgaggtcaggagttcaagaccagtctggccaaaatggtgaaaccccatctttactaaaaatgtaaaacactagctgggcgtggtggcgcatccctgtagtcccagctactcagaggctgaggcaggagaattgcttgaacccgggaagcagtgagctgagatcacgcgattgcactccagcctgggtgacaagagcaagactccgtctcaaaaaaaaaaaaaaaaaaaaaaaacacacacacacacacacacacacacacmgttgtgtttgcatcctgttatttgagttagctcaattctaccaaattcccatcctacagcctgttccagtaaccgcagagccatgagacctggtctgatggcttcttctctagctgcttgtatcaaaagaaggcaactcccccctttccccttcacctgctaatgaggcctggaacttgcagtccacatcacagcatcatttacgttttgtcctttcctggaggtctacaccaggcacctgggactgcaggctttctctctcccctgggtcttaaattacagtaacatcggccaggcgcggtggctcacgcctgtaatcscagcactttgggaggccgaggagggcggatcacgaggtcaggagatcgagaccatcctgtataacacggtgaaatcccgtctctactaaaaacacaaaaaattagccaggcgtggtggcrggcgcctgtagtcccagctactcrggaggctgaggcaggagaatggcatgaacccgggaggcggagcttgcagtgaaccgagatcatgccactactgcactccagcctgggtgacagagtgagactcwgtctcaaaaaaaaaaaaaaaaaaaattacactagcatccactcttaccctacctgtaggaagtaccgtgttgctcacgggtgaccccaggaggcttacctttctgttttstttgtgaaagtttctcccccattttgcttgtgcttccakagcaatgatgctagaygttggctcactttggaaacactcccttcctacaacataaatgtgtgtatgtgtgtgcatgcatgcgtgtgtgtgttgaactgagttacttatgagctgggcttctgcaaaacctgataatcaagggactctgtttccattcagaaatagctgtttttgacagagaaggaaaattsacagatttttccatattcggrgattatctagaatatgattcccctcaaatggcccatctttttatcctcaacaatcataggatctgtgacacgtgaagaataagtgttatctggttggtgggtaccagcagtggtgctggtaggaccaaaggggaagagattctgtccaggagtctccttgactggtcagtcctacctgggtccagaaagttgatagccacgatccccattatgatccctgttaaaatccccatgccatggggatgtgttataagcacacatgcaagatgcattacaaacctgatcctaaagccccacaactgcctgataaggtaacagcattatcccagttcttcgcctaaggaaactggagtctagtgaccacacctttttttggttccctgacttagaacctcttaaatrttccstcaaggtgtgtttgaatttgttgctttgtaaaggcaacaaagcaggagttaagggaaaccaaagccataccttggaaggaccaaggtatggggttaataaaacacggatgtttcatcatccaggcrtgtaaattacacatgtctggccgtgtgttctcagagtcacatgtgtattttacatgcaagaacaagccagtgggtggtctcgaggcagaacaactcccaggagaactttccatatggactgttttggagacttaagggtcactttgattcaacgcaagtttgtgtgatgcagtgattttagaaactgtagcaagaaggtaaggcttcatggtagttaatgcagaggcatcaccgtgacttgccagaatccttcctgggtggtgtccatggttcctgccacccctcctccctcccagaagtcccaggcttagtctgaatgctcagtctttctgcagctgcccagagtggtcagtgagttacactggaggcttcaaccactgggtttccatagacatggaaatttccattcatggtttctactgacaccgaccccctgggaatgctgaaaacactagaacacagctcttgattcgctcagattttcttatttaagacaaagaaaatttcttgtgcaaaaatcgagtcagtatcattctatctttattctctattctctctctccctctccccatctctgtctcctgtctttattttcttccttatctatccccctttttctctttccctcgctgtttctttcttcttcctttstttgtctcttttcctaacttttttgcatatgtagctgtgtcttttcctgccttctttttctgcactstatccccagctctctagcttccccgcaacacacatacaccacctactatgctatctggcaattcccactggggaactgtggcaagacatcttatcactggggaaggaaattcaagctgaaagaattcacctttttacttaaaatttcttaactctgtgactattcctgttttctacttatgaagtccagcctcctcgccccccattcccctcaggtgtggcagtgaggttaaagtggccacasgctgctgttggagtgagccttcctgctccatgtgggttctataaaatgtgcccttggcacctgttcaatcagacccaatgaggattttggaacagtatgttttctactgtaattacatctcaacagtgaccatttatattattccttgattgcaaataaatttacagtgcttatttttgtgctccctaccttcattgcatttttcaatatatttaatacactttaatcacacaatgggaggtgaggaaatacgggcccctcttgtgaagggaacgagagggtggttgggctcagagctgctttttctttgttacrcatgttgtggttgttttctaattggagagtcatgaacatgtttatggacctgcaaggagaaataagttgatgtgcagggaaggagggcaggaaggggtaaggcactgaggagtacatagcgggtgggagccagggactggagttcactttgagcagcaaggaagatagcctcctgcagccaggggaaggaggcaagaaagaggcaaagggagggggcctgtgggtttccaggttggggatgctgaacacggagagcacctgccttctcgcactcttcccctgtgggtcaagcagcaaggtctgctgctgagagaagcaggggtctagagcccactttgcagctttgctgaagcacccagccacctgaggacctgattcaaaaggtgggcccaggttgtacctttctaaccagctcacagctaagctggtccaaagcccacactttgcatagggaggggaaaatggacgacatgccattttttcttcattgtcaagtaagctggagtctgaacacgttctaattggacaaaatggaaaatgccgtgttttaattttctgaggcccattgagacagccccaagggtgacacagctgcctcctttcaagcctctgctcctttgtaggttgatggaacttgaccctggctgtaggaccagaatcaatttgttgcacctgcatccacttggcacccacaggtataaaatgtatttattgaaaagcagcaggaagtacagaaagcaggaaaaaaaatacctttcttcttttataaaagggattatcagctgctaattcaaaaattgtagggtaatgaaaactacatcaataattttcataataattatagtctttggttttacccttgmatgtttttctggcaacatctgattcaattaccccagaaaatgttactatgctcttccagcattttcctatgaggtttgaatctatgaccaaataagtgataactcttgtcctaggggagcttgtgggctgccgtacacaggcaactgtcatgtagggagacctgacacacacatcttagctggattagtggttctcaaccccagagggttttccacaccccgctgggacacccaacaatgtctgaacacattttttattgtcacagcttggatggtgctaccagcatctagtaggtaagaactaaggatgctgctcagcatctcccaatgcacagggcagcccccacccaatgaacaattatccagcccagaatgtcattagtggcgaggtcgaaagactctaagtgagattaggattacgattagattacaattcgaaaggaaaaagcagggtggattcggtggctaatgcctgttatcttaacattttaggcggctgaggctggaggattgcctaaggccaggagttcaagaccagcctgggcaacatagtgagaccctgtctctataaaaattataaatatataaaatatattttaaaaatttaaatatatatatagtgtggtgtcacatgcctgcagtcccagctactctgggggctgaggcagaaggctccattgagcccgggaggtcaaggctgcagtgagccatcatcacgcaagtgtattccagcctgggcaacaaagcaagagcctgtctcaaaaaataataaaataaaaatagttgatcagaacacttctggttataagagacccctagctctaagtagtttagataacaaggggactttctattggtaggaatattaggtagtgagagactagggtactgtaacaaaaagttcccaaaagaacaacgtgtatttctttgctcatgaaattccttaaaatgatgttcagtgcaacaaacatcgtttctttatgtattttatttatccattttcattataacaatgtgcattttattgcttatgtgctgggcattcatgtaagcattttataaattatttaatccatcataatcctgtaagggtaggtattattattattaattattcccattttgcagatgagaaaatggagacacggagaggttaaatgacctgccaaaagtcacaaagataacaagatgcagcttcctgtggctttcaacatgaatcactttcctcattggtcttttattttcctctttttttttttttttttttttttttgagatggaatcttgctctgtcacccaggctggagtgcagtagcacaatcttggctcactacaacctctgcctcccaggttcaagaaattctcctgcctcagcctcccaagtagctgggattacaggcgcccactaccatgcctggctaatttttgtatttttagtagagacagggtttcaccatgctggccagctggtctcagactcctgacctcaggtgatctgcctgcttcagcctcccaaagtgctggaattacaggcgtgagccaccacacccatcccataggtcttttttaatgtgacagagtgccactggagtgcgtctctcctcacgcagattttcattatgttactccaccctgtgatgagagcccaggagggacagagaatgctttttaatcctccttatctcattgagcctgattcccaagggaacgattctcatccatttattctccctctgggactcagaaactccatcagccacctctggaaggaatatgcgacgtgctcatgggaattacagtcgggcccaaggggtctatttgaaatgggaatcagtggtgcaaacacagagaatggatttagagcagtttcttctgactaagacatttggaatttaaatgcaaattagaagctgtaagtcaattccgtgtatgaatttatacaaatcccttgtaatgaaagcagaaggtttctcttgtccttgtttgtgctgtggtgttagcatcacgagcctaaccaagtgtgtcaatctccctacagctctggagattagacmtgtgctttctccasttagagacggctgtgagtgccatgctgggggtgggattctccatgggctgcaggggtctgtgtagtttctccattaacttcagcaacaccccatggaaattgggaagaaggagggtcctcgtggtttagccaaaggttttgaaagagacaaggctctcattgtaccccctctttactggcccctcatgccattcacaaagcaagccctcattctcaaatattgcctttcctcactcaggagctggaggctgggctctgggaagctgacaggccacggtctcttgtatttgaaaggagcaacccaagggctacatatgggttaacaaatgacttgaatccccagcgcctgcagcctggagtccccatatgacccagcagctccactcctaggtgtaaaccgaagagaatgaaggcataagtcctcccaaaacttgcagatgtgaacattcacagcagcattattccccatagccactaagtggaaacagttccaggtccatcaactgataaatggagaaacaaaacatggtccatccacatgacggaatgctttcagccacacaaaggactgaagtactgatccacgctacagtgtggatgaaccgtgaaaacacgatgttcagtgaaaaaagtcagacagaaatggccatatattgcgcaattccatttctatgaaatgtccagaacagggagatctccggggacagaaagccaattagtggttgccaggggccgggagtgggtgaagaatggggagtggctgctcctgggggtggggtttctgttcgaggtgttaaaaaaattctaaaattgattgtggtggtggttgcacaactctgtgaatgtactggaatccattcatatgtacaatttaaattgatgaattttttggtatgtgaatcatagcgcaataaaactgttagcaaagaaaaaactgcatagcaccatgtctaaagactataggggatgtcacccaaagggtcacctttttaggcagaacttgagctcttgttaaggtttgaaaaatcacaagctgtttttttttttcctccatagctcagaaatcaaaccagattgaggaaaatctttctagggaaaaaaaactcacaaaagctgagaaaattaaaatatatagagctcctagaatcaggaattgtagcttacttttaatatcatcagcactctagcatagttctggtacttaggtgttgaagagttgacaggaaacagaacccaggaggtaaatgaagaatcaatctgttgggaagaggtttagaaaggaagaaatcacttaggaattctcttaccctgctttatttttcttcaaataatccaacaagctgggtatttkattatttatgtatctatgtagcatctcactcccacatagggacaacactcatgacagaaggggcctcctatggtttgtccgctgctgtgtccggcattaagaamggcgctcagcacggcgtcatcagccataaatatttgtggaatgtacagacaggggattgaaggcttggataggggaatatgtccttggagagtgaaatgaacgagtggctaggaacacacacatgggtgggggaattaacatactgacagggaatgaacaaatgggtggggtaatraatgcacaaatcagagacttaatacatagtatagacagggatgggcatgtggctaggggatgatggatggaggataaaagtgtggatagaggatgaatgaatcattccagcagagacttgtaggcagccagcatgactgaatttgttccggttctttctatcaggctggtgcaaaagtaattgcagtttttgcaattaaaaatggcaaaaaattgcaattacttttgcaccaacctgatacatctataagcatgtctgggggaagggtccctcctgcaccctcacgtggtggggtttatctgaacattagggtataggccatagttaggaacagcccctgaatttaacagagaaagaccctgaagcaagtaaggcaggtcaggagaccaggatgggcagaggtcctgtataggacaatgtgcaagaaaggacccaacaaggcagctttgcaagatgtcgggatcaggggccaagaggagaagaagcacaagaggtcagacgaagaatcctgcagattgttagccccaggatgaggaaacaggcctgagagtctcatctgtttcatcagagagcaataaaagaaaattaaaatataataatgccaggatgttccaaacagctctttattgctacagaactaccatgcctgtactttcgtctccaggcaaatatactcaaaatagtttcctattgctccactcaccccatcattcgtcccctttctgcattaggcctacgggttaatggatgctgccacctgatccctgcatgatttcccaccaaccctatgactctgggttctggagaggtgaaagagcatctccaggtggctcaaaactgtggctccaggtactactcctccaggcgggctgctccctggggcacgtgttctcagtccaccagtgggccatgccgcatcagcccacctgcttcctggcacatgggatgcacagcccatgaccttggacccagcagtaggcagcatgctttccagttttgaaggcaaggacggaggcatacaaggcactacttgagatcctgtctgatttagaattttgtaggacggattcctgttgttgaacacactgagtgatgagaaacttggcaaatcttgttggcaaatctctcaccttgattccstttggcatcctttgtgtctgtctgatccttccagcctggcctttggatagcaggtacccacttcttaggatgtgccagacaccacggtaagagtttgatctgcacttgttcatttattcaccagaatcacctatggagttagcagtgaccctatccccattttacagataaggaagtaccgaggcttacagaggtgaagttgcttgtgtcagggcacccagctgttgagtgacaaagccagaccctctgaggtggggcactgagcagaggcccgaatggcaagatggtgccagtacatgaagacaagagtctgtcagagagaacgacacaggtagagtcctgcagcttgagcaactgyttacaaacccatggcagagcccatgtgaatgagggagaaaaggcagagatgggcagatcccagaaggcctgggaacccatggaaaaggctctggattttgtaaagtagaagctgttgcagggctgcgaagacagaggaatgtcagctccatgagggcaggaatgtgtgtcttctttgttcagtgaagactcccaaacacccagaatcgagcctggcatgtagcaggtgttcagtggcttcattgaatcaaygaatcatgtttaaatttgtaacaaaatgactctggctgctactatgcagaggacaggttgtagagagaaagtggcaggggggaaaacagaggaggagtcaaacacccctgtaggagataatcaaattacctgagcggagcttctgatggctccaccaaggttggtaggggtgggacacagagaaataggcctattcagcacatattctgcatgcatgcaaccattaccactatctaaggctggaactttttcatcacccgaggggaaactttacacccattaagtggtcattctccattcccacccctcacacccagcccctggcaaccataagtctgttttctgtctgtctgagtttgcctcacagatatttcgtagaaatggaatcatatagtttttaagagttgttgctgatggactggatgtgagaaatgagaaaagagaggaatcaaaagatgactcctgcattttcagccttcacaacatgaataaatggtggtgctctttgccaagaaaagggagaagggggaaagatgagatttgttttggtggagtcgggaggtggaaaggcctctgtttcgatcatgttaagtttgaggtgcctgttagacacccagaagcagatgctggctgtgacttggcacttacaatcctggatacagggcagagtccagggttgggggtgtgagtgtgtgattcctcagtagagaggcagggcatggaagttctcatccaggtgctgactgatgaagagctgccattgcccaagctgggaccagaacccctgagccatgttaagaaaaagtcaaccagatccaggcattgttacccttgaatggtaaaggtgatttagtgraatcttgatcaaggctcctgagccatttcctgtgggaaagtagacatctttgaatgactgcacagagaatcgtggtctttgccactctcccctacagttttggcaatatcacagccaattttagggcacaaacacaaaccattcccagttatcctttgcctgtaataggaataagacagcatggtgtaaggaattacttgattttagaaggcatttcatctctccaagtcaatctttagggatcgacactrctggtggcttatgaatttcagatgtggtacattctgggaatgccagctcttgggctccaggaaaggtgattaaaggacaggctgatgccaacatttatggagaataaaacttgcacttcaggtacagtaaactcagggcactcagttgggcttcactcttccatattcttaggaaagactaaagtcacatgaataagatctcagccctgcatatgtaatggcaaaatgaatgatgtaggctcttcctttgagaaactaacagactgtggatscagctcattgtaaagaaacagccatatgagtgatgtaaagggtattaatccctcaatacaggatcatttatctgtagtaccactccattgctacattgttcctgagccaagtgtcctggccaccatgtctctgggacagtgagtgacattatgaggtcaaacaaggtgtcccccatagaccgtcaagaagacaggctgctgcttttcagggatctctactctgatccccttgggatagcttctaggttcatgagtaggcagaatcccactgagttcctagttcctctttgacccccagagcagcactttagacataaagttcatctatgctcaggatgacagccaaccagtagctccaaagtgttccttgacaatcattttctactttactgaacagcccaccttcctctgcarcagaccgcttctttgctggagaggctgtgggctggggatatggagaacaaactgatgagtgagggatgtgtctgcagaatcagtcagtggaagagatgacctccaggagactgtgatttccttggcaaaggtactgcatttgcttgcttagcaatatytgtgaactscttgccatagaacagcaagaattcgcaacattccctgccagtggcatccttcagcactgccagccacatgtcctcaccagcaaggtcccatgtcctcaccagcaggtcccatatcctcaccagcaaggtcccatatcatcaccaccaggtcccatatcctcaccagcaaggtcccatgtccccaccaccaggtcccatatcctcaccagcaaggtctcatgtcctcaccaccaggtcccatatcctcaccagcaaggtcccatatcctcaccaccaggtcccatgtcctcaccagcaaggtcccatatcctcaccaccaggtgccatgtcctcaccagcaaggtcccatatcctcaccaccaggtgccatatcctcaccagcaaggtctcatgtcctcaccaccaggtcccatgtcctcaccagcaaggtcccatatcctcaccagcaaggtctcatgtcctcaccaccaggtcccatatcctcaccagcaaggttccatgtcctcaccaccaggtcccgtatcctcaccagcaaggtctcatgtcctcaccaccaggtcccatatcctcaccaccaggtcccatgtcctcaccagcaaggtcccatgtcctcaccaccaggtcccatatcctcaccaggaaggtcccatatcctcaccaccaggtcccatatcctcaccagcaaggtcccatgtcctcaccaccaggtcccatgtcctcaccagcaagttctcatgtcctcaccaccaggtcccgtatcctcaccagcaaggtctcatgtcctcaccaccaggtcccatgtcctcaccagcaaggtcccatgtcctcaccaccaggtcccatgtcctcaacaccaggtcccatgtcctcaccagcaaggtcccaacacaagttagaatgtgccatcaggtttcttttatcatttgatcttagaactaaaagggacctcagtggttacctcaagctgttgttctcagcccttggctgttcattagaatcacaggggggtgttttcagaaatacgtatgcctgggccccatccaagaacgatctctgaaagcaggaccccatatcattagtgggtttgttttaaggctttcaggtgttttaatgtgtagtcagggttaagaatgacagctttagtctgatacccttttctcagataagtgaactgggactcagagatcttgcagaatttaccagaaaggtacccatgagttagagcagcagtccacaacctttttttttttttttttttgagatggagtctcactctgtcgcccaggctggagtgcagtggcaygatcttggctcactgcaacctccacctcccgggttcaagcaattctcctgtctcagcctcccaagtagcggggactacaggcacccgccaccacacccagctaatttttgtattttttgtagagacgggatttcgccatattagtcaggctggcctcgaactcctgacctcaggtgatcctcctgcctcggcctcccaaagtgctgagattacactcagaagccaccacgcccagccaatccacaacctttttggcaccaggaactggttttgtggaagacagtttttccacggaccaggattgcggggatggtcttgggaggattcaagcacattacatttattgtgtgtttcatttctattattattacattgtaatatacaatgacataattatacaactaccataatgtagaaccagtgggatccctgagcttgttttcctgcaactagacggttccatctgggggtgatagtagacaatgatagatcatcaagtattagattctcatgaggaatacacaacctaggtccctcgtgtgtgcagttcactatagggtttgtgctcctatgagaatctaatgccaccactgatctgacaggaggtggagctcaggtggtaatatgagcaatggggagcagccgtaaatacagatgaagtttcactggctctcccacagctcacctccttctgtgtggcccggttactaacaggctacagaccagtagtggtggttgggaaccactgagttagaggccaactagaatttgccccacttcattgaattccctactcctttaaatatgcagaattgcataagccaaactccagtgtctttagaaagcagactatgttaytgtttcttgaaaagccattcttcctccagattcagatgttggtggtcaaatgartatctctacagaaaatctctctgcttctccgaattaaactattttcaattatcttgtcagatgaacaaatgtgttttgcattttctttcattttttaaagagagaaactcaagtgaaggagagctactaacgtccaatgaaataaagtatccaagcctgaaattsaagaaaaaaaaatgtaggcatatttgctctttggtttttatttttctgtcaccatctaatgtaatatttatttmatcattcccctaaggcaatgattttcaaactctctttagcagcaaaacttttttttttttttcaaacaaaatcccaggcaggaattctaatatacaaaacagataaaatataattaacagattcctcaggcagtttaaattcttattatttgaaggaaaatgtttgatgccttggtaggactcctgtaccatctcaaacattcttgctggactcagtggctcacacctataattgcagcactttgcgggaccaagacaggaggatcacttgagcccaggcattcgaggccagcctgagcagtatagtgaaaccctgtctctacacaaaatgtaaaaattagcttggcgtggtggcacatacacacccagctactagggatgctgaggcacaaggatcacttgcacttaggaggtcaaggctgcaatgagacgcagtcacaccactgcactccagcctgggtgacagagcgagaccctgtctcaaaaaaaaaaaaaaaaaatcttgttctcaggaacacagtttaagaaccaccgttccactgcatcgttttcctgtcagtcttcagtggccatgtcttttcattttgttttgtagggcaaagacctgctttgttatgcaagcctcttctccgtgaaaatgcatttcatttttagttttgcatatgtgcagttctgtatttggtgtagacagggtcatgtagaggaagagtacagtcactggaaggtggactgtsccaggtgggcatcttcctcaaaagccatggactcagcaccttctgtgtatctgcagccaacacatggaaayatctcataggaaatgaatcagagaagtgtgccctgaggggaagagggagcaattcctgccagggcatgcagtgaatgtttccctttcttgccctttggttcattccccagcacctgtagagccaggaggttgagggatgcttcattttctctctcagtggaatgggacccacagacagctgctgcctaggaacatcattttcctttcaacccaggatcaccctgggtgggtgggtcacatggggcaggacatcagtgagggggacattagtatcagtccaggatcargaaccacactaccwgggatgccaatgggttttggagaggactcttcactcaggacgtttctttcttgttgagatgctattccttattatttttgaactatttccacattcgagttttgcattttctcacctgtttagtaatggtggatggcttcagacatttaactgggaagactctggatgtttagtagacctttctgtcactgtccattaccatagctagtaggtactctctctttgcatgatggagataacatgcaaatccttttagcaaagcatctggcacaaaagagaaacacaaaattgtccgtagaagaaattaatgttagttggaccaagaaaggactttgattatgttttcttaaaaagaatctctgtgttttagactgaaatctttacagatgcaatggcatgtctgggatttgctccaaacagtgcagaatcggggcggggtggctgcggagatgaaccaccaggagcagggagttgaggatctctaaagcctgaagacaggcatgtggggggtattatcctattgtacatgcttttatacatgtttaatatttttcataacaagatgtgaaaaagaaaaaatacttgagaaaacatctatgaaacccaaagcaccatcaaagggaccactcacctgatgagatcagtagacatcttcagagttgttttccccagggcgccattattgcaaggaatagaaacctgctcaaggcagctggagtgaaaatgaggttgttgatgggaacagaggttccaacagacaagaacacagggaacctcggaggattgagagcaggactgggaaaccagtcagcgactgagagcacttcctatttgtcttttgtctttgagtcccagaaaaaaatctcttttgtaaatttttctctcaatttctccattcttttgcttctccatgcatattggatttctctgataatttatccttatccaaatgacaaaaaatggycaccccttgcacaaatgctgggaaacctatatttctcttagttcaaatttatcaaagaaataatcccatttttcatgaatcaactgatggagtggttaccccggagtcaggtaatcagctctgggtccaatcagctatggccaaggaagctaggatcacatgatacaaaatgactccctagtaccactgttttcagcagggactgggggtaggtttaggtccctcaaatgttttatggattatgcaggcaccctgagctatatctactcaaaaccgctaagattttcaggaaagaaatattctaatttgccatttagaaattatataatctctgtcatttggactacagttgagtccactttcctttttcttaggagaaatagagaagaactggttactattctcattgggagactctcaaacacatgtacgttgttttctttctaccttgtgtttttattcttgagacaaaataacccgaaaagttagtgtctacttacagtgctcttactttatgaaagatgtgacattcagcattttggggaatcagagacatgactccgactcttcaggagctcaacaatgggagaggcatgccccaggttgtctgtgtttgagaggcagggaagtctgtgccaagttctttctgttcatggttactggaattctcacctctagcatctgatttctttctttcctgtgtgagctacctcccatgggcattaaaaatcaagtctctgacaccactccrcatcttcaaagaaaacaaatcatttacagaattttaatcagataaagagaggagaaggctgggcacagtggctcatgcctgtaatgccagcracttgggaggccaaggcaggaagatcacttgagcctaagagtttgagaccagcctgggcaacttagtaggactcccatctctacaaaaaaaaaaaaaaaatttaaattagccagtcatggtggtttaggcctgtggtcccagctaaggcagaaggatcacttgagcctaagaagtcaaggctgcagtgagccgtgatcataacactgcattccagtctaggcaacagagcaagatctgcttcaaaaaaaaaaggagaagaaaaagatgctcaccaatgactaggactatgatgatctggtgggttcctgaatattctttcatctggctcctgtagtcacttcagggcctgactatgccttttctactgtgacgtagctagggaaggacttagtaggttccaatcatcttgaagacttgccagtgaacagaccatagttcttaggcaagcaaccacaggtcccttgagtggctctgttattaatctcttctgagacatcgggctttcttaaaacattgaatgagctttatgtagaactctgtactgtatactgtttaaaatttttatgtaaatatatatcttatgtatattttatataattagtttttatttttatattatatttcatattatatatgtgtgtgtatatatatatatagtgcacacaaacatgatgtggaggctgaatgaaaatgttctcatacgttttcttctaagaactttactgtttacatttcacattttgtgtatggtgtgaggtaggggtcaggattcattgttttctgcagatggatatccaattgatctagcaccatttactgaaatgaccgttacctggaaattaaatcatgtcaaaacataaaagcatccataattggccacaggtacagccttggatgtatgacagtgaaggaaatggttttagaagtggtagaaagcaaattgtcagatatgttgtagatgtacagtacctacaaagaaaggggacacccagagggaatactagccctctcacttactgatgtatttttgtgcctagtggagtctccagcatgcaacagacacaacaaatatttattaaaatgaattgttgtatctttccgccatgagataaatcctaatcatagaagaaaaccagatatctaatgccgctttcccttccaaatgtggacatgataggattgmcatcatttgcctcatgtctgttgttggagcataacaagaatgagcaagtgtgtgagtgccaggcatacataactgaaaaaaaaaagcttcttccacaccactcgaggaaaataaaatacatatatacataactacattatatggcagactgtgataagagcagaaagagtcacaggggtttaaaccaaattctccaatttcttagtaagaatttcatatgatacagggcaaaatccatcatcattatccttgctaacaaatactgactccttgttatacatatgccaggctatttgccaagctccttaaatgcattatttatatcagtcwcagttgctacccattagactattgggaagagccttccaataagctgtatcttttatgtaaacatagactcaaaaatgtttgcaagttatatttctgatggtctctcccctacccttttatcatcacaaatagaaattagtgagaccctataatttttttaagctaagggccagatgactacatcccagcttttcaagttccatattagttctctgtgaaactttagggttaatggctcgtgaacttagtctagtattcaggtcaaacatgcaactagtcaagcatgcaagcttgcatatgtgcagtcctttaaacttgtcctctgtcacttctttcccatctgtgtctttccagccttctgatcattatttccatcttccatgttaatctaaaggtcaactttctgctcttggaggaagaacatgcattcttggtgtataataaaattcaagtccctcttccyacttgtgattgtctttgtggctcatccaggcagcctcatcctgaatgtctatgatgtaagtcaaagaaaagaaaataatcagtcctgaatttggagggaagagatcawaagcccagtacatagtcccaacaggccacagtgattgtgtaaaaatacgttttatatcttgtatttgatttgccacacagtttaacagaaaagtaactttatctattttttccaattaaaggtagtaatagtacaatcaataattcctcctgctctagtgtggtaaattaatgtctttctattgtttttaaatcacaaagtgagcattgctatagaaatgtaaaatggtaccatttcattttaatctatttaattttcctttcttgaattatataatggggttaaaacattgaatagaattaatagaatgagtatttaattaaggaataatgagcttctaaatgaatgctcaaagaaactgcttcatagtttatgcagaaatcagataatgggcttaacaaatactataataattgtgttgaatgttttccatatttaaagattttttttttctgtattctctcaggagtagatttaaacgtaacccagttccttgattaggctacactttgctttcatagtaaatcccaaatgccttcccatggcccacagggccctgcataaggtgactctaccacctctggagtctgatgtcatagagttctctctggctctccccttcattccagccacacccagcttgcctttgttctgcaaagccacctttggctcttcccgccacctggcctttgctcttcctctttcagatgccaggtatgttctcacccccttcacctctctaaggcctcctcttctttcagttctcagggaatttttccctgatgatcctctccagactggatcagatacccacctccacacatacacacacacacatacacacacacacacagactccccaagaactgtaattttatttcttgacaattaacacgttgttatacatttctttcccatctgtctctcctttcagcctgtaatctccctgaggaaatatatcatgtctgttttgtttagtggtgtaaccctggatggatggatggatggatggatggatggatggatggatgggtggatggatgaatggaaggatggatggatgatgaatggaaggatggatagatggatgatggatggatggatggatggatggatggatggatggatggataaatagatagatggatggcaggtaaatgccgttgtggacccatccaaggacatatgagggccacaatgcacatctctgagaattcctagcacatcagcccctttccattctacttgaattcatttgcccacacactaaaaaggtattctataccagccccttcagcaggtgctgcagacataaaactatcagtgtcatggaagaagctgcacaggtttgtctcacttatacatggcctaaatattaattttattaattcattcatccacccatccacccacctacccatccatccatccaccacccacccatccatccacccatccgtctatccatctatctgtccacccatccatccatccgtcccatcttcagacctgctcatgtgttgggcactgtgctgtttactaaggatcagggctgagtcatccattaggcaccattatcacagtgctaggaccctaaaatcgaaagaaataaaaagaacttttagggtaaaataaatttttaattcttttcttcacatcacaaaaataattttttctgagacagggtcttgctctgtcacccaggctggagtgcagtggtgtaatcatagctcactgcagcctcaaactcctacactcaagagatcgtcccacctcagcctcctgagtatgtgggacgacaggcacgtgccaccacacctggctaattttttacatttttttttagagagatgggaatctcactatgttgcccaggctcatcttgaattcctgggctcaagtgatcctcccacytcagcctcccaaagagctaggattacagtgttagaataccatgcccagcccccaaaataaattttttaaagcacattactctattatgataggaggggttgatgaaggcaaaggtgactggggtccaccagccatgacgcagctctgctggagcacagggaagatcagtccatccctggtcttctggaacactcaggcaagtggcagaatcaggtgtcagtcaacaagtcagtccctcttagtcttgcttctgtatggctttgtcccttcacattccctcaggcctcacctctgctgccagatcccacttcctatacttaagatcattcattcattcaacaaatatctactgagtttcttctgtgcacctagcaccatgcaagagactggagataaagccatgaagagacaggtgcacatagagcctccagcctcctcaaatcatgatttctcacagtgttttcatcttggcaatgacactcatctgctttgacagagcaacttctcacttatgcactggacatgacagcgtttctacctgactggtggttcccagcatcctctagccttagcccatttcatgcccacatgattgatacctggttttctaaggtacaggtgtcagaagaaccacaaggacgggttatgagctgacatccactttgataagcaggggcagagaaccagtcctttggctctggaccgcagcaagagggtgaaggaaggactggcctaagccatggggatctaaggtgggcaggagtggcagagcaaagattactggaaaccaggagacttaggtctgatctttgggtcactaaacgactttgggcagcactcttccttcttccttccttccttctctgtgcaatcatcttcatctgtaatatgaagggattagatcacacatgtgtcaccaagccccctcctgactacatggcaggtagcattaattgatcacagcattctttcctgctgagcccagatgtactgcaggcctgtccacaccaggctcaggcagcttcacccattcacaagggtaggtcatgtcattgacacctgcctgccgtccttagactgggactctatcctgcttcttgccccgactacatattggaattatctaggcaggtgaataaaatgctgagtcctaggctttaccccagagcctggggaatctgaattgatctggggagtctgaatctgaattgattccctgactgatgcctgattctgccacttgactgcgtgtcccagaagaccagagatggactgatctcccatgcgctccaacctggctagaggaccccgggcagtttctcyttcatcagcccctccaaccataataaccataatagattttcatgcgctttaaccctggggaatcctgaattggaataggactcgggaagtttttcaaagcctctgggagattctaatgtgcagacagggctgagaaccgttagtatagttttcttgctcaagaattctatgatttttgtgagaagagaagatagaagataggtagacattaaacaagaatcacacgaatcagatcaaaataattgcaccctggagttgtttctgtgttacagcagcctcagtatcccttctcattcccactattttctagcctccatgcatgttctaagaattttccagctctccttttatggaagacaactcgcccaggtttgccgaggcgcaataaacaaattagttgcagtccccgccctgtcccctgagaggcctcaggattaaggtttatgattaatgatttccaagtcaattaatcagccactgcttttgaaacctcatttctcaaattacttttctttgaacacaagggctttttgatatcaccttactgtctctagattcactttcctactaattgaaattccaagatatttcttctttttgtcagcttattggtgttacttgtttataaaatatttgcaaacacattactattcacctgtagtgtgtcagaggtaagcaccaaaacaatactttatgctttcggctcaaaggaatgtgctaatgaaagctcatgaaattctctatctatgagaaagttgatttttcatttattgatttattttcaccacacctacttgaaacaagaatttgagatgtattacaatagaaacacaggtacatcaaggctccaaacaattcatgtagatgatttcttagaaaatggtttctaagatcatattaaaactggatatggagtgggaaggatgggattggttttcttcattagggaaaatagcagtatctagcagaggatctggggtcaaatcccagtctctccacttacaagtcttaacgcttgactcatctgattatgttgttattttggggaggcaaggctgcgagaacaaatgcaaacaaaaatggcttgaactcaatgaaaatttgtttctcattcaatgatagttcaggacaggtgttcttggccaccaggttgctcccctccatgtggtgactcagggacacaagctcctccttccttgtagctccctgcttccctggggttttgtggtcctctgcattcaggtaggcagagggtgaaaaagcacagagaggaggcacagctgttcttttcaccctcccaccacagagcagcacagcacagccatggtcagtatcattgctgcccacattctgcaggagagaagttagtctcgtggcctcacctaagttcaaggaaagctgagaagaagagcatagtatcttccaaccgtaatcctcttatgttattatttatttttaagtgagatgatgtgtgtaacatacccaatgcaaagcatgtagtaaatgactatgtgttttcaaaatagtgaccattaccatctgctttgtytgcagtttcaagccacagtcgaggaaggarctgtgggagttattgtcaatttgacagttgaagataaggatgaccccaccacaggtgcatggagggctgcctacaccatcatcaayggaaaccccgggcagagctttgaaatccacaccaaccctcaaaccaacgaagggatgctttctgttgtcaaagtaagggtgcttccaattgcctctttctcctcatgcgagcacggagggccccatgaggcagctcatagaatcattgagtttagaaggccrcagataaattcccccagtctcctccttctgggaattaacaaaggaaaaggctcatggcttaagggtgcactcgtatcctcagcagcataaacaagcagccataaaacaaacctgttttataggttctaaaatacccaaacttatgtgtaactttaagaaaaccaaacttaagtgcattttttattttgttttcatttttgttttttgagacagtctcactctgtcacctaggctggggtgcagtggtgtgatctcagctcactgcaatctccgcctcctaggttcaagtgattctcgtgcctcagcctcctgagtagctgggattacagctgcctgccaccatgtccggccagtttttgtatttttagtagagatgaggtctcaccatgttgcccaggcttgtctcaaactcctggcctcaagtgatccacctgccctggcctcccaaaatgctggagttacaagtgtgagccaccatgcctggcccaaacttaagttttaaatgaaattctttatacatttgctaaggaattattaacagatatgccaaaatgagatgtgtgaaggtgtttttagagatctgtgctcaaaacgtgggctacgacatgacttcttaatcttccttagtgagctcaattattccttaaaaacacacacaacatagttattggtgtgaaaccctctgtgacccttgctaactcrcacactgaccctctctatggcaacaagtagaacaaggaggaaatgtaattataaatgtaaaacctctagctcatgctggtaatccagaaatattagtgggggtggtagcacagaaggcttgctacaggtggccttggtattctggsagaaggcatttctacacagtttcactctttctgggaagttctggggagagtttctgccagagaccaggaccttcatgggaacacattttcttttctagtggatgaagccatttgcctgagcagcagggatcaattgtatttatagtgatagtaccagtgggcagagcagggaaatggctgcccactccctgtgtgcccttggccaagacacccatgttttctgtgcaccagtttcctcatctgtaaaatgagaatgttaatgtaacctccctcttagggttgttgttgtaatccattgagttgytataatgaagtactgtaggctggtggcttataaaccacagacatccatttctcacagttctggagcttgaaaagtccaatatcaaccttccagtagattctgtgtctagtgaggacccactttttgatagatgtccatcttcttctctctctatcctcacatggtagatagagtgaggcagctctctggattctcttttttttttttttttttttttktttttttttttgagacagagtcttgctctctcaccaggctggagtgcartggcctgatcttggctcactgcaacctccacctcctgggttcaagtgattctcctgcctcagtctcccgagtagctgggattacaggtgcatgccaccacacccagctaacttttgtattttcaatagagacggggtctcaccaggttggccaggctggtcttgaactcctgacttcaagtgatctgcccgccttggcctcccaaagtgctgggattacagatatgagccactgcaccctgccaaatcctgttttgctcatatctattttccttgagctgtagcaaacacattttggggaggcctgagctccaggatatgtgatggagatgtctatttacccaagttttatcttccaaacttcaggtctggaaaattgyctgacagattttatagactcaggactagccacggaggacagccagtggctatgtcattctatgacttttacagcttcgaaagtgcaacagccatggacacagagggccagtgccagggtttcctaataactttgccattgcccaatacattagtgcttttatgtacttcgtgcattactgctagtccccatgaataatatacagtactataattgcttattcatacatagtacattcatatataggagtacattacaaacctagtctacatacacataagcacgtattaacaatcccttaattaactatcrcacatctactgttgtcaagtacacaataaaacctaatccatacgaatactgacccgtactagaaatccttaatattacgtagtacatacattcgttcatcggacatagcacattgcagtcaagaaatctcttgccaacatggatatcccctaccaaattttggcctctgaatctaccaatctccgagaaatcatccccgctcaggagtactaccctcctcgctccagacctataacacttgggggtgactattctgaaactatacctggcatctggctcttacttcagacccataacattaagatcacccacatgttacccttaaattaagacatctcgatggactagtgactaccagcctattaaccaaccttggcaacagagtgagactctgtctcaaaataacaacaacgaaaaaagaaaaaaaagaaaaaccagacttgcaggaaggagccattctcctctccctacattcctgtgctggtccacaatgcagtggctctcaaatgctagcatatataagaatcatctgcaatgttagttaaaatgcagatttctgggcttgccccagacytgctgtgtcagaatatgagagagaggtgtgccaggtggttctgttgttcacagggcacaccacttgtcaaggggcatggccttaggggaagcagtttccatcagcttgtccgccctccctgcaaattccaggggaagaggtgcccacagaggctgatgctcttgctgacttcagctttgctagtgagtggactttctttgctttggaattgggatgcagactctccctcaccccacattggctgcctcccaggtcagtaggaagggccttgagttctatctgtctctcagcacatgtgaggcagagccccagaacaccttctagaagccagctaggccatgctctctgctgctgtccactgtgccagccactggtgcaaccatcagggatgcattctgttgcaagtaacagaatgttagactaatagtggcttaactaatgaagggaatttaagaatttttataactagatgaaggtaggccagtccaggattggccaacagttccaggtggcagagagccagcagtggggtgcctcagatgcttttgacattttcctcttggacataaagtagctgccaaagccccaggcatcatatcttcccatgatgctgcatcctaatgcaggaaacaaggaggcagccaggcaaatgagagaaggtgctcttatgagaccctctcctcttatcggggcagaaaacatcctttctaagggtcccccggccaatttcccrtgatgtttcattgaccaatgacatacgttcttccttaacttcaaggaaagctgagaaagtccaaatctggcctttgggcctttacagtgcataaggcagaggggggctggtgattgctgttgggcagtcaagcacaagcaggtctgccctaaccagttagcaatccaacatacagaagaactatttggagtctcaggatgctgctggtttccagcaaggtcctgccacttaaaaggaccaaatcccagtggctctgacagatgagtgtcggcttcgtctttaaaaccttcagatcagaagcacccttagctgctttctaaaccgattctaaaaccaccagaaagttattctttcagctgaatataatcaaccctacattttaagtttattttctattctgtcctcaaagaargtagtatccagaaagcatccgttattccccaaacctttcacaggcctaaacatagctattcattcagttctggatcctccctcttccagccaacaaacccaggtcctccatccttcccatgtgggtcaacttttccaggctttaaatttcccagggcagtggtttacaccctctcttgtcacttgaaaaaatattaattgaattgcctctctgtagcttccatcaggagtattttcaatttcctcctgtccctgacacagaggcccagcaacagacaaagcacattagtaagattgtgtgctttrtgagatcttggagggcttcttaatccaattacagcactcsgaggggattaggaacagagacccatgtgtcagcarctccaggtggtctggccctgggcatcatacagctggagttagtagatcccaccttaggcaaatggaaataaacattagcatggccctgctcccttcctaaggccagcctcacattgtatggctccctccctcgctgctcccctccctctgtggcttcctgcatggcatagttcctctgaagccagcgttccgttcagggagtgtcagcctgggaacataggagaaacactggggccggggaaatgactcttgcagctcttgcttccccactcttcttcctcaccatcttaacagcttcttgttattgataccaacaccaggcctagctccatgggaaatattcaacattcatcctgtccgctgatctttacaacaatcctctgtactaggattttattgaagagacagctgagacttcasgggaggcagtgacttgctggtggtcccagagttatgatgcatcagggccaggacttgactgccacccatctttctatctaataaaaaaatagggaatttaaaaggcagaaatatccaagaatgttagatttttgcacaatcaaaataatagataattgtgttgcacaagtctagtgctagagaaaagcacaagaattacagtcaattcattcattcattcattcattcatgcaatatttatttagagcccactatggtcctgacactgtgctaggtgctgtgtattcactggtgaaagaaatggtctctgtctgcagcctcccaggcagcttatagttataagagcaagaacttttgctgcaaataatgatatccccaggaaagaaggagaggaggagggagggagggaattgtctccttgggaaaaaacaaccagttgtccccagccgaggaaaaggagctgagcggcacaaattggttatttccaagcattttgactgtctcacttgtcagcagatggctggattccccagaaaccccactatcctcctgcttgtgcatacgtctccggctgtggagaatcagatgtcagaccaaactaggccaagattgtgattagtgctggtgtggggtggaaatggcccttgggggactggggtgctctgcatctcactgctgttcagagggcccaccctcagcgtcgtcatggcccagcaagccaaaggctctgtcccctccaggatcctaattgagatgaatagctgtattttccaagcatggcagctccctggccctggtttgaggtttactttaccgaagttgcacattctggcatcacttgggatggacagagatccattattaggatccatagaaagaaggatagaatggtgaattactgctgtgttacaaggattgaaccgacacatcactgtgcagccactcagcactaagagctttgcatctgttaactcttaaaatcctattactgaccctgctgggagttgttctaggtgaagagaggaagtccagttacaaccaggaagcatctccagtgtgtgtatgtgggcacacactctcccatgtgtggcgtgcttagcactgaatacatgtcagccgtaattattrtgaaagtgactttatttgcctaaagacactctgacccaacctgccagattccattcccacctcrgtgccagctstttccccagcatcaacggtccttatctctgctttcattttcccatgtccactgcaacctctacaactgttgttgcttacttttagttgagtgtaaatcaaatctcttgacttatttagtcttgtccttcttgcaagaatacccattacggcatgggtctgatgggttagctrtttgttccagtaagcattaggaacttgatagaagcagtatgccctcatcttacctaaatgtctccccatgcaccgctgacagagacccactctgggaaatgctgcacccaccacatcatgtgctctcgtggttgggaaagagagtgacagacactcaattggcagcgccattgtattaccaatgtttatcatggagtttctttgacatcctctggtttagtccacacagtggctgggggaggtagatactatcagccccctttgcaaaatcacctagagtggtcctcatcaacgctgcccattgacactggggtaggacaatccaccattgtgtgggactgtcctgggcatggccttgagtctagtattgctgtcccccgcccggcaaatggytgtagagccctcgagtcaattgaaaatgctcccatacattttcacatgccctcagttgggccagggcccagcggcttaactccatgtggctcagactttcaaatccttttccctacatcatactctactagaaaccatgcacccaggctatacttgaagggacatagagaccctttaacttcatggcaagtgagtgagaaacattaaatataaaactttggttttcctgttccatttgatccactgtgatcacagaggcagggttatcttgctataaagctactgaggattgggcgttggagtctcrtttaccagagcccccgtgggtgtcgggggtacggagttacaggttccaggcagggaggctttaggcatcaccattgccagggagttgcctaacgatatctcagagggaggctcactaaggttcaagtcactcactgcccagatcactaaggttcaagtcactcagtgtccggatcactaaggctcaagtcatgtgttgtcattcatttcttaatcaaaaacacaaaaacaaaaaaaaaccaacatccatacttaatctcacattttcatgtttcatattctttatcttaaagatagccccccagttacacaggcttagcctccaaagcccagctccatccctgaaggcccactgttgctcgtggaatttcagaggaagttgatgcaaaccacctgccttttgtggctggtgtgcatcctgagacccttctgtctgctttccagccattggactatgaaatttctgccttccacaccctgctgatcaaagtggaaaatgaagacccactcgtacccgaygtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtgggtgagtggctccggaaccacagacgggaggtgggcaggaatggcttttcctttccagtcgcagaagctggttgtcaggagcagacaccattaaattaaacttgttaacaatctcagcaagtgggaggaaagcgtcatagagaggaggttgtggctgacggctgcagagggccaggctctttggtgaggatgctgctcccacctgattccagcctgggagaagagtagcttcagtgctgtgttcccaaatgaccagccgggtctgctggccctgagcacagtccttgaacggagagagaagggagccactctgggtgacctcctgcatctcagaaacttgcctactttgtcatcagcactgctttrtgacaaaggttttgctaactccgtttacagatacaggtattgtggattcgcagattcgtagaggttcggtacttgctcaagcagcccagcttggtggtagaggaatcasgatggaaacaggacactctgcaaagttcatgctccttctagctgctcaatgctcactgactctgagctgccagaaggggaaggagcaaagtcacttcctggtgcttggaaatagaccattgggattggcgttctgcctgatgaggggcaggcaaaaattaataataataataataatgtcttcagaaatttctgtcttcatttcttaagctctgcccagtgcttagatagaaagcattttcgtaatgagatttaattaaatggtcgctatccacccgtggtgcatctaatgctcacaaataaaagatgccctcgttggtacatggtttcacaataaacttaaatcagcgtgcagatccaaatgcacgcctgtctctgcagaagaaagttattaatgttcctcctccaaaatctaatcttcttctcatatgaggtacaaataatcaagtattggacacacttaaaacgaacatgtgtctgattttcctgatttgaaacacctgaaaatgtgcaacagggactgagtcaaccactttactttagagcaagcyggtggagaagaagcagaagttattttccaacaccaaaagtggatttatttttacggctaagctttctgaatgccagatgaactagacaagcgtgtgaaataataccaaatcctataataatgtgaatctgaaatagccattcttttttttcttgttgctatctgacaatggaaacatgcaatttaaacatcaaagagagagtctttcttaagtacttagatgggaaaactcgtagcttaacagactacaaggtagttggacaaaggtaggatgtctccaggtgagcttaagtgtcatcttgtatttctacaattggaggtgaaagcagggaccctggaggcaataaaatgagttaaatcaggttgatgttttggaccctgtgtctctgccattgctgggacaacttgggatgctgccagtcatgaaagagctaatgcaatgggkaggggtggatggaggtgtctgggacccaggactagatgtcctactaagatgggacagacagtgggagaggaaggtcaggctgggttgtttgattaagaccagctctgctgacttgggcaaagaaagaacgtgctggaggaccctatggatactatatacgatggaggaatatctgaagaacccgctcgagatagcacaggagctagggcatccttcaggctctaggtcacaggaacagacagacttgcagttcaggatctcacagtgagaataaaccagctccagctgttttccattctagtgtcactcggcccatggtcacattcccagggcagctctgccttgctggagctggggtcatgcacctccctgctccaggcaccttggctagtgatcaacygggatgatgttcccagatacacagcacagagggccgctgactgagaaggagggatgaacatcctgtctggcaaatgaagcttactgctgggagtatggaggcagcccataggtgcagtcccagcaaactgagttaggaacaggattccagcctggggagggaggggtgcctgggagagctgagacattaaggaacatccaggccaagatttgagccatggggagcaaaggtcaccttactattaaacagcacaggcagataagggacttcatcctaccgctgtgtgagagaagaaggaggtcagagaaagcaacctagaaatgacttgaggtggcacctgtggggagaagctggaacgcagaaagttctgaggatcttcctgtttctctagccagtgtaatcatcacagctttggccttccatcacaaatgactagtacccaactcacagtgacttatgccaaaaggggtcctgcttacttgcataggtcagcgcacctaatggaaaagtccatgggaacaaaggcctccagcatgatggaattcaggtgctcagaacatattccttctctatatctggctctgctctcccctgggttgtctccatcctcagccatatttgcacatctgtagagggaagagggaagaggcaccagcaaacacctctccttgatcctascagaggaaagcaacatcttccttcctaatcaatagcccagcccaaggcccaggttgagtcacaagcacaactctctgaaccaagcagaagatgagcaggacagattgtgccacgagtcctggtgcctgagcctgccacagaccccagcacccagctgtgagggcctgcaggggcggctacccgaggaagtgcgggaggctagtcccagaggatgggaacaaatgctgtgtaatcaggaaccacagagarcccctggcccaaaggtgaaccttgtgaaccccacagaaaatagagctgcagtgtgtctctgcagctggtctaagagttctagcatttacagattggcctagctgagtgatggcaggaccaatccctttcccagccgtggagcaaagtaaatgtgtgtgtgcatgtgcatatgtgtgtgctgcacacatttctctctctggcctcactcctcaggcatattccttcctgctgggagccacagcggcccacacgtgactctttctcagcctggcactggctggacaccccctttcccctcctccgttcttctccccttcactccctcctacccacctttccctcctttctctttcttcccctccacccctctcctctcctggagtaaagtcgggataacatcaccgacaggttgagctattgtcatgggagctctttgggaaaaagaggctcattaattatttgcagcctttgatcctgcacactgagaagtgctctcccttggggcctgtgtgtgcagaggaggagtggggctgcagagaggggccaggatgggagacacttttctaatctaatcatctgcgctgggctaccccggcttctcagacagatgcaacggccttccaagttgtgatgttactgctgttgkgatgattcttcagggagcaggcactggaagragaaacttagctsgaaaagaactcttccttcttctcctcctcctcctccacaaaacaggaatcaggtgtctcctrataacattttagtatctctaatatctttttcttcttcttccttgtgttgactgctgatgtgatacctctgttcttgtcttcttagtttaaaagaatttaaacaagagacacacaccaaaagaagtgcagcatagagtaatytactgcaacagaaaaagaatatgttgaaagttaggtgcagaatagcagtatcctctgagagagatgattccgggcaggctgctcacaacaatgaggcagcaaagacccacaccagggaggctcccttctgggagtcttccatgattattcataaggaggtgggaagaggcgttactaggaagctgttctgggtggtcttccgggtgcacatgtgcagcagctgtacaaggtcgttcataagtcgcatgtctctttagcatctaaaatctccacccagggctgtgtttttcacaattatgatgagcagagtcagtttgaggacaggtaaaattaaaatgtgcatgttctgtagaggggaaagtcgccactgaagacagctttgcttgaatgagctcactgactgtgcgcatcctgagattgactgtgttggctgtgcggtcaccacagttgctgctgtgtcccgagaacacggtcacttccttaactacctatccggcctcactcctcctccttcctctgtctctttgcctgtctgtctctctgctgctctgtctctttttctctccccaccccaccatctctgtcttttctgacattccctgtgactcagctccaacaaccccatctcatgtcacattagtcaccaggccctcgaaactaaaagcccccatgagagaccgggaccctgagatcctgcagcagggcctgcccatcctaatggccactgtcacctcctccctgagggggctccttccatggtcaacatgggaagccttctccccaaccccaaccccrctgaaacttaggaacgcacttccagctaagtccaactcctgggccamgtcctgcctcgcatgaggaaatgcacttctcaggcaccactgctcctcggctgaccgyggccagacaccctttcatctccccagggaatgctcaagtcagcaaagggcgccttgatctccaaggaacctgtgactacaaagacaaggggtgtccaaacatcagagggaatcttctcactaaaaagcctgggttattaagacttgttaaaaagcccttcacattgtgttgttagtcaaatcaaaatgaacagcagtggtctagtgacagatgaaattcttctttttaatgacttttatcttcttatccttattataaagttaagatagtttctggaagaaacttttgaaaagacaggtaagaataaggaagataataaagtatctgtcatcatctcagacaaggaaatcccttttccacagcttggatctgtctccctcaatcacgtatgtgagtattctgtttttcattaccaaaattggcttgcattatccaccctcaaacctcaccatttttatttcccagtatacgctgaacagctttctgtcccaagaaatagccattatttttcgtcgctgaatagtgtgctattattccaytacagggatatactcatctgtttatttattcccttgttgttgactatttacattgtttacacttgtttgcagttttttaaaacattagtgggtatgcttatagtgaaattgtttaatgcatcattaatatcctgaagacaagtccctgaaaatactttggttgagcaaaagtattactgtgtattgttaatgttttttggcatatacagaattctttgtttttatgtctaggcagtcaaatttatattttccatcatttctaaattgatgtcacagtttagaaagtccttctcctctccaagatcatgtacatcaggttctaaaacagatcaggttcccactctgtcgtctccaggtgagatgatgataagacttgcttccactttcagcgtagcaaccgttcctccaggtgcacaaggtaaaatatcctgatgatattcgagtatctctaatgaggagaggacttatgtaactgaacttgttagaaagagtaacccaggctgggcacagtggctcacacctgtaatcccaatattttgggatgctgaggcaggtggatcacttgagatcaggagttcgagaccagcctggccaacatgacgaaacgccatctctactaaaaatacaaaaattagctgggcatggtggtgtacccctgtaatcccaggtacttgggaggctgaggcaggagaatttcttgaacctgttaaacctgggaggcagaagttacagtgagcagagatggtgcaactgcactccagtgtgagcaataaagcgtgactccatcacaaaaaaaaaaagtagccgaaagataattatgcaaaatggaagtaactacatttgctaaaccttctcctacagtgaaatgaaayatgggaactaacgcttccatcagatccctgatttggttacattagggaggcagccggcagctaaatccttctgaatagctgggaggactcacttctttctctctacaatcaagggcaaccaagtagcaattcctattccaaacatttttcagacagaactcatcttgcccaggatctatagtaaacaattccacagcagagacttctgcctacactttgaatatagaagatatgtgttgaagaaaaatattgttcctacccatgtaaaatttcatatcactgctcaacacttttttttggaaagggtcattcatccagggagccctgcgagtatatgtcaagcattttatctgtggggactaagtttggctgaacataacaggaaaattcaaaatgacagtggctcagagcagacggaagttsattttttttttctcacataaagtaggtctagagcaggcatgacagttcagggacagtggcagccccacacggccccacacagggttctacttgctcactattttaccacgtctaggctggcaccctcttcctcatggtctgttatggttgctagtgctccaaccttcatatctgcattccagacagcaggatgggaaatggagaaagaagagggatactccctctcttttaaggagactttctggaagtcatccacatttttatttaaattttattggccaaaattggtcacagggccatacctagctgcaagggattatgggaagtatggtcatttgactgggaagcaatgtgcattgttttttaaaccaaggttcttcactaaggaagaaaggaagaatggatagtgtaaggtagatggcactttctgccatgaatgcctttttaaatggaacctttctgcttaataaataactacagggtacattttaaaagggaaaaatatcccatgatactagatatttgcataatcaaaataatagatgatgttgctaaagactagtgctagagaagagcatatggattacagcaattcattcattcatgccatggtatttatgtagagcccactgtgggcctgacgctgtgctaggtgctgtaaattcactggtgaaagaaatagtctctgtctgcagcctcccagggagcttatygtcataagagcaagaacttttgctgcaaatgatggtgtccctataaaggaagaaagaaagggagagaggaagggaagaaggaatgaaataaattgcttccttgggaactaagaaccaatgatcccaagtcgagaagaaggagcagagtggcacaaattgcttcttcccctgcaccatgcccggctgactttcagcagatggctggattccgccagaaaccctgctttcgtcctgcctgtgcacaggcctctgcctctagggaatagggtgccagaccaaactaggccaagattttcacaacgccctgcagacatgggttttgagaatgatggtaataatatggctactaggatgattaaaatacctaacatttttatgtagaactttaccaaaagcactgttaccagtcttcttgtattttcataaccaccctgtaaatgagaacatcttgttctccctttttactgatgaggagagagaacctccctgagccgtggttaaaggaggaaagcacacaagcagggtttacagaggctgagttaatgtgaatcagaacgccggagcttcctccgyaccactgcgcctactgctgatgttggcttaaggctttttgaacatgtcttagtgtaacttcaccaagcttcacacttcctcaatccttgacatcattgtccatcttcccacgagactttgtgctcagggagagtaacaatcatctttatctccttccctaatgagccaccagagcttcctcagtaccattgagttagttaagcactttaggcacaggactaagaccttcagactttccacgggcctacaaaaatgtcagggacctgaatacatagtctattgactccaaaattcaaaaagaaagcagcaaaattgaaattaataaatatcaactgcccacggcatcatgacaactttagcaggctaaacctaatatttgcaaaagtgtctttacatttgcaaactatttgtagctctcaccttgcaagaacggtggataaattataagtgattattagcagaatatttcttatggcacagtaattccaaaagcaaaagtataaaaataatttcaaacatgtgataggaaaaaaatgtatttttagtgtgggtacattttagtacatttgatacagtttggggtgaggccaccaaagacagagaaaaatttttaagggctcaaatgtctggaaacagcccaatcccagcataaggactggtgcatgaccagtgctcagtaaccaggtggaatagattaatggcagctgggttgggggtgactgcatgcacacatttttctgcattaagtagacatgggttgaccgaatgcggtggctcatgctttgtaatcccagcacttcgggaggccaaggtgggcagatcatttgaggttaggaattcaagaacagcctgaccaacatggtgaaaccccatctstactaaaaatacaaaaaaagttagccaggmatggtggtgcttgcctgtagtcccagctactagggaggctgagrcaggagaatcacttgaacctgggaggtggaggttgcagtgagccaagatcgtgccactgccctccaacctgggtgacagagtgagacttcgtctagaaaaaaaaaatgtagacatagcttgcattagtccattctcaaattgctacayagaaatgcctgagactgggtaatttataaagaaaatgatttaattgtctcatggctctgcaggctatataggaagcatggcagcatccactcagcttttggggaggcctcaggaaacttaaaatcgtggcagaagacaaacagggagccagcacttcacatgtccagagtagctgggccgaggtgctacacacttttaaacaaccagatcacgcaagaactcactatcccgaagacgccaccaaggagggattgcgttaactcccctgatcccatcgcctcccaccaggctccaacattggagattatatttcagtatgagatttgggtgaggccacaaatccaaaccacatcataggttttgttttcttttaatcttcaaacattgactaatgtctaccaaccatgaaaacatttacatttggccttgttttaaaccaatcccaggaagggtagccagtgctagcagggagactttagaaggatgtgcaggtctctcacagaactttccaagtccatgaaagttacattgaagagccattgccgtcagccaacccttcttccgaagccttgatccaaattgagcctattctttgaacacagaatatctgaatcagatccaaattagatactcatctctttgaaaactacaactgctttgtcctgatttctttggggctctgtcttttttaagtcgtttccttcctcctcatctttctgacctggatgctttttaactttacagtagaattcattcatgcattcaaactggtaaagaatacaacatagaataatgatatttcagccccaaaagatttgttaaaatgcccaatttccatttttactggtcttcccatgattcatcaagtccttttctttaacaccttgtttaatctaatattggagctcattcaaaggaaatcacaaaaaatgttgggaaattaagcaaaaaccatcattgactggcgatgggacattttattctgtatcttctaagacctttggaagaaaaaggcaaaaatcagctctcttgaaaatgcaaattttgtcatsactggcattctcagaaacacaggggttcaraaatatgtagtagcctaccatttattgggaggaaggaggatttctaatcccaaaaccaggtttcaaaaccagatttaagagtttaaattggggtgactcccaccttttaaattttaatcagaagttaaaggccaaattgtaacatttctacctggggaaattaagagaaggccttcatcttctaaactatattattaacacttcatcttaattaaatgtggttactgacctcaataacaggatctgggatgaggtcatttttttggttcttgtttttaatgagttaagatttttttcttttttaagtcaacaaacacagagtttgaaatgtaaatggattgtttacagtggtgtctttgtaatttttaattaaagcggtgttgttccattgtaagtttatggtagcaatacattttattgcctattctgctgtggaatttttaattatttatgcaaatatattagcacagatgactcttgtttttagtggtcagatgttctgttatgaagatgctgggggaaacaaagcctcacaaattaaactatgggatttttaaagttttaagggcttcactggctaaaaatagaatcctggcttttataatgatccagagactgaagattttcattattcatgtcaattaaaggtgctcagtttggctaatatgaaacatctggccgtttgggtaaatggatgaaaggctattttacaaatcgaccacctttttaacatccatctacatatgttgttataaatttgccataggccagactttcattattgaaaacatggtttcaaattggctatatttgaatataattatcagggtccttcttgtcagccttagaaattaatcctcagaaccaatatagaaaatattgacaaatgttaatattgttccttgaccaatattttctaagctgttaaatctacttagctttttttttaataaacccatttgaaatagataaggattgctatataagctactaacatagcactgattgaaaaagccacacatttcaggattgcaacagaagtcasttgcatagggaaaatagctgatttattatctgagtttgtctatcaatcactaacaccagtcagccagcaagcacgaggagcttatcatggcattaaccctaacacgggtaatgaaaccacaggcagtgagtcatgtaactaattcaagaaatgcatttcatcatctgctcccaatctgctttccaaatgaatctcaaagcttgtattttcaagtgatgaggctctaaactacagtcctcctacaaatgcttaatttggggatttcctcatgcattccaatagcgttggcaggaatctcactagaagatccgaccttatatggctgcttctaagtattcttgggtccctgagtgtaggctgcacatgtgaaaggaggacctggggatttggattagggctatgaccggaaaacctctctctccattcattcatcccacacctgcaacatactgggtgcttttctaggcattgggggataaagtagccccagaaacaattaaaaatatctgttggycgggagcagtggctcacaccggcaatcccagcactttgggaggccaaggtgggtggatcacctgaggtcaggaatttgagaccagcctgaccaacatggtgaaaccccatctctactaaaaatacaaaattagccgggcgcctgtaatcccarctacttgggaggctgaggcagaagaaccacttgaacccgggaggcggagatggtggtgagccaagatcacgccactgcactccagcctaggcaacaagagcaaaaactccgtctcaaaaaaaagaaaaagaaatctgttatcatcgaaatcatattcctgtggaagagagaaaatgaatgagagaattaataaatacaataagtagcatagtaactggtgattaatgcaaagaaaggaagcagagaaggaaggaggggagccatcactctagatagagggtcagcagaagcctcaccagtgctgtgatgcttcagtgaagaattggaggaagtggaggtgagccacacagctatcccgggtggagaggtccaggtagaggaagcaagtgggaaggccccgaggcagagtgtgcaggattgtgcccagcgcacagcaagttgggggatggtgggaaatgaggccgatgctccggagaagatggggaaagtgttaagcatgctagtgggattaggaaagggggcaattaagggaaagggagacagaggcagagcagaggactggagtgtagggtagccatagtaatccaggtaagaggccatatgggtctgggcagggatggttgcagtgcaggcagtgagaagctgcagacactgaatttgttgttgttgtttttatttttgagacagagtctggctatgtctttctggctggagtacagtgccacgattttggctcactgctacctctgcctcccaggtgccagtgattctcgtgactcagcctctggagtagctgggattacaggcatgcrcyaccacryccagctaatttttgtatttttaataaagatggggcttcaccatgttgtccaggctggtctggaactcctggcctcaagtgatccacctgcctcggcctcccaaagtgctgggataacaggtgtgaaccactgggccaggccctgaatgttttgaaggtactggtgacagggatttgctaaccaactgtgccgtgtgtgtgtgtgtgtgtgtgtgtgtgtgtgtgtgtgtcagagagagagagagaggaataaagattgactccaagatttttgtcccaaacaaatggaagcacagagggcacatctctgagctttgcaagctcgctggagaagtggcaaagtaacttgtgggaggaaagtacaggaattcggtcttgttcttgttgagtttgaggtagacaaagggagcacatgagctgggtatcagggggcgtttgtgctacagatagaagcctgggtgtcatcaacatccagatggaatttaaatccttgagactatgatccccaaagagggaagtgaacgtagggctgtggccaagccctgggacactctcatattgggaggagtggccctgcctggtgctgtttcacatgaggcactgcttcctgagaatccccttacagccttgcaaagaaaagtacatagccagccaggtgcggtggctcacacccacctggcactttgggaggccagggcaggtgggtcacaaggtcaggagttcaagaccagcacagttccgtacaacggtgctgttaacttggcagcccgaccscaaatcagcatatcctgagtctatgcaggccccagggtagagtgtacattgtccccaggagtcgaacggacctgggccatcctgcctccttccatctcctgtyttctttcactagcatgtctgatccacttccctaacacagccaggctaggttggccgctttctgctatagctacaccaaattgctcaaggttacgatatagtagctggcatttactttgtcccaggcactgttccctgagccttctgcattagatcacccctcatttcacagcaaccctgtgggtctctgattaccccttttatacaggggaagacaataaggmttaggaagattcaggaaattacccaaagaaattcacactcagattcacactcaggaaatgtgactcaatgacagccgtcstcacctctctgctcttctgcctcccaaaccaaactgaagccagagaagcgtgccctgtgtgtgcarttaccagacccaatagcttgctctctccaacttctgtttttcagaataaaattgtttgttccatttctgattttagttgatggatttatgacagctttcattgctgatagccacagcaaaaatcattgctgccagatgcctgtaagagcatggggagggagtctggccaratctccatggactcaaggttgctccctggactcaaggttgcaggaggtccctagggatgcattcttcccggcttgctctttccatagcacagaggctcttcctgccatcatctgatgacagggatggctttgcctgctggacatccacctgttgcacgggttgatgatgcgaaatgtttttacagactccgtctgtcccggtttctttccatttaactctttcatgcccacttccctgtgcattctattcctgtgattgccttaaggagaacaaggatctgtcataaacttccttattttgccaaacttactataggcaaatagagactttcggacttgaaggatgtgttttccttatggaagcaaaggaaactgaccttgactctttttatttcatcctagattcaggctgtctctagaaactaccccagagcagctgcatgggaaatggcagacccctggtctcttacagccttgcaaagaaaagcacatagccggctgggcacggtggcttacacctgtaatcctagcactttgggaggccgaggcaggtggatcacgaggtcaggagttcaagaccaacctggccaatatggtgaaaccccgcctctactaaaaaatacaaaaattagccaggcatggcggcatgcacctgtaatcccagctactcaggaggctgaggcaagagaatcacttgaacctgggaggcagaggttgtggtgagctgagactgcaccactacactccagcctgggtaaccgagtgagactccatctcgaagaaaaaaagaaaagaaaagtacatagccaagtggccacaactgccagactagtgccagacttcctgagcacaaatccccacttgtccatcttccagaagtgtaaccttgggcagatttttaatctctctgggcctcagtgtccccacctgaaacatggggaggaatagtaatatctaggttatggagtcactgtgatggatacagaataaaagaattcagggaaagtgtttagaacacagtgcacggtacatagcattaaattaactgattcgcatttttagcaaaatgagcataatgcgtagtcatttactaaaggtgtctctttgagactgataggggtgtttttctagaatatttggttttcatgccttgtggattagtttatttttattttccacaagccagccccgggtacctcactgcttaaatctcatgataacagtctcttcctcattcctggtaaaatccaagggagcagataggagtttctaaatattaagttttgccatctgctgtttgcttgcctgtaagcaagcactcagagatgacagtgccagtgaatgaatggcgaactgctattaaatgtaggagttgaacaactgatttatgaacgtttgcagcttggccctttggtggaggtaggcttgattttgcaatttttctagagcacacatataactagtcatattttctgctagtaaaactgttcctagtttgggcattgggattaaatttatcagtattttaagatgctctgcaaagtacctcacactatgcaaataacaccatgagttgtagatactctgtcacccaaacaagtttaggatctggttgaatgtttgaagtgaaatgaatcagaggagactgttcctgtgagcaaaagaggacgtgacaattcagaacctctaatcatacctagtccactatctgtcaggattcatggtcacaagcaacagaaaccagcatgggctatgttaggtggaataaaacaagaacagacagggttgacattaggcatcacagaatggatagaaaaccagaagacagactggaaaaaatgagtagccgccagatagaactcaaggggagggaaggagggattagggaccaccacaaagagaacagctgagttctcatgttakgcttcccatgcaatgaacatgacctgtgttcacccccacatcactcatgcaagagcatccagtttgctggagttgtctcatgtcccatatcyactcctgctgcagtgggagagaatgggagtgggttactacctcccaccaacactgcacaaaacagggttttctccaaaagaggggttgggatgctatgagggatgataaaggatggggagcagtcaggaatgagaaacatccactccaaaacccttccacaagtgtgagtcttccacagtgctcgtgatgacctccacagcagacttgctgttatgactgtccccagctgccctctgtgaggatgggtgcttatgaggtgagaggtaaacatttgcatattcagttcccacactaaagagtgtctctgtcacaaagcaggaacaggtgacatgggccagcaaccaggtaaatctctgcagggcatgaagagccaagaatgctacagaacagggctgtggcttgcagagggcagggtgtggctctgggcagaccatcagggcaagagaaggcactctgccccaatacctccctttgggctggactagggagagtcaagccaggccctcatcttggtcataagctttaaggggataccgaaaaactcaatcatccagatagatgttttaatgcagtattttaaaaatcaaaactaatgcaaaaattagccaggcacggtggttcacgcctataatcccagcatttaggaaggctgaggtgggcagatcacttgagatcaggagttsgagaccagcccggccaacatgatgaaaccccgtctctattaaaaatacaaaaattagccaggtgtggtggcgcgtgcccatagtcccagctattcaggaggctaaggcaggagaatcgcttgaatccgggaggtggagattgcagtgagccaagatcatgccactgtactccagcctgggcaacagactgagactctgtttcaaaaaaaaattattgcaaaaattcataataagcaaaataccagctttttaagtaaagcaggatcattgttactgatttttcattttgtgtccagctcacatatgactcagcatggcgctgctgtgcgcaagctccttttcctctttgggcccatttcttcttctgtaaacttaaataggatcgcaaatgctgtgactctgtggatccctggatcaagagtagaaatgagttcaacctgcgtggcagatgctctgggccaagcctgtgcctacaacctggtggactaggcgaaagcaggtgccctttctgcaacagacagttagcaatgttgagtaaactgtgaccctttcacccatggaaacccacagctaggctccaaagaaaaagaagataaatctctgaatttaacaaataactagaatataaaatagttatgtttaaaatgattaggggaaaagaataggggccaggaagaaaggataaaacataatgaaatagaaaaggcagatgtgaacagtaactaaatagaaagtctagaaatctgatagagcattatctcattaatacttcggacacaactgtgagatgggtgtgatcatccctgttctatagatgaggaagggaggtcgaacctttcgtgagtgaaagagacggaattcaaatccagatatatttatgccaaagaacttttttttttttttttgagactgggtctgtctgtcacccaggatggcctgcagtggtgcagtctcggctccctacaacctctgcctcctgggctcaagggatcctcccacctcagcctcctgaatagctgggatcacaggcatgcaccaccatgcccagctaatttttctatttgtttgtagagatggggtttcrccatgttgcccaggtggttctcaaactcctgggctcaagcaatccactygcttctgcctcccacagtgctgggattacagacgtgagccaccacaactggcctcaaggaacttctcaacagggaaacatttctttcctttgttttgcaagagaaaacactatttttttaaaaagtcatgctcagtagagtgtgcaggttcgttaaacacctgtgatatctttttataattctgtgtaagatggggtcttcatgtgcagcgggcccatttcatctctgttccccattcattcatgttctttgtgtctggggcttcttttgaaatctgtaaaggtgggaggaccagggaatccaatagagtgagcacatgaagagaygtccttcragcccacactggatccacctggaactcccaccagggagttcactgggagtggggacttggcagctgccagggagaattcttaggcaagtggttactgtttgatgcttcaccctaaagttataaagatgcaacattttacagctcaacaagtaaacatttcccaaatacttaaaacatagattacctagtcactggtaaaacacagcaactggccttcatctccaaaatatatctagaatctccgcagttcttgcaactgcactacataaactttgtctaagccaccaccatcgttcacccagatgacaataattgccctaacttgtctcccattcttacaaggcaccatccacatcgcggtgatcctcttaaactgaagctcagatcccgtctctcccctgatgaagcccttcagtgcctcccatttcacactgaagtaaaacccagaccccctgccctggcccaggaagcccctggctggcctcggtgctgagcttcctctcctctcgctcctctggcagtctctcctccaaccacacggcctttcttcctcaaacttctttcccattcaggaactgtgcaaacatcattccctctgccttgaattccagtcgatccttattattcacaaattccatatttgtgagctcacccactcaataaaatgtatttgtcaccccaacattaatactcatggcgctttcatggttattcttggaggagtgcagaacagggaaaaatttgagttcacctgacgtgcacattcacagttgagctcaaacaaggccttcttttgctttgccttcttatttcagctctcatagtacaaataagtgccctttttgtgatctgtttagtgccgtgatttttatttttgcacgttttgttcgcaattttgctgtttgaaatggcgttgagcacagtgcggaagtgctgtccagcgtctctgggcacagaaggctgcgccatgccttacagaagaaacaggtgttaggataaccttccttcaggcatgagttacagctctgctgaccgtgagtgcaatgttagtgatcaactgtatacgttaaggaaggtgtgtttaagcagaagtgcacataagataaggccgtgtattgatgagttgacaaaaatgttgtgaccagaggcttgaggaaacctaaccgtgtattcttcccgagagcaatggtttttgagacagagtctcactctgtcacccaggctggagtgcagtggtgcaatctcggctcacttcaacctccacctcccacgttcaagcaattctcctgcctcagcctcctgagtagctgggattacaggcatgcgccaccatgcctggctaattttgtgtttttagtagagatggagtttcaccatgttggccaggctgatctcaaactcctggcctcaagtggtctgccccgcctcggcctcccaaattgctgggattacaggcgtgagccactgcacccagcctrcagtagttttataggacatagctatggtgagtaacaaagatcaagtgtgcttgcttgcctgaacattcactacctgtctccccacactaaactgtaaaccccttgagggcacggaccatgttggtcttcaagtgggcctggcaaataataggcactcaatacatgtttgttagttaacgaatgaattgcaaataaattatttccaaagacagtttttaaccaggctgtactgtacaggactgtagtgtgtcctgttcaggagttaatatttaatatgtctttgcaaaggataacaaaggatttccatcagggactgactttaatataaagagtgcaaatgaatgctaattaaatatcttcacttaattattatttgatgcacttccttggtttgggcctcccctttgggcttaaaaagatacaagaaactgcttctgtttctttactttctcccagtgtcactgactaggcaccgttggctttgatgaacctccctgaggccaccatggggagatggtgttgcctggttcccagtgctgaggctctcaagacactgctttcttggaaagttgatgcggccaggagcatctgttttgtgcttcctcctgggcagacaggggctgctcttggaagtccattctgcttcttgctaactcacacaggcggtatgaggaggatgcttagccctaactgatcttatgatctagcctggaacactgagagctgggtttgctaacaagccgggtcagtaaccccaaccttcttacttcagtccagcgtcttgccctgtattgtcttctgttagagcacggttggcaagtttcttctataaagggccagatgataaacaatataggttttatggaccacacaatctgtgtctcagctactcaactcgaccatcgtaatccaaaagctgccacatctgtgaataggcatggctgtgttccaatagaactgtgttgacacagggagtcagagggccagatttggcccatgggccatagtttgccaacccccatggtacacccctaccrgcattatggtatcttcatttgtgtgtgttctactctgtgctgcgagctctttaggggaaggcctgaatctcatccagtggtttcctctcaacatcttgtgtagtgcctgccccrtgacaagccctcggccaatgtttgctaaatgcatgacttataagacatggcccccaaagcacgggcattgtgaaacatgctaaccagatgaaaggtgacctaagccccagtggcagcccattcatcatcattctgcctcctgttgccaatattcaaaatagcaccagttgtttttctgtcaacaaatcaaaataatattcctgcatttgttcaacaaacagccactgagtgtgggagcagcatccagatgtcagctgggatctgcctgcctttgagaactaaataaatrtgtgataagttgataagtcctgactgcatgccccgtagcagcccagaggcttcccaagatttctgcaaattccagaggattggagaaggaagccttgactttccagaggtcacatctggcttcaagcttccacttctgcaagctagttccatttcttagctgtctcaatctcctgcctgtgccagcctgtggcatcccatgtcgcccttctccccagtcctcccttggcacacatatgcacacacacgtgtatgtgcacacgcacatacacacacactcactgtcatcagaattggttgcatgtgatctaactcactgaggatgtttagaggcatggaaagggcagttacatcacatcacatcaaacaacttcaacctgagaccctggaaagccctcgattttccatccttctcagcatcccatccgtctgtatttctcacaaggcacatcatcccagcatgtacccagcctcagcacatattgggactcttctctccaatttctccctctcctctgcactttctctttttaaacagctccatggagatgtgattgacatgcaaaagtgcacaagttgatgagttctgacatatgtgcactcccttgacgctatcaccgtgatctagatcgtgcatgtgtctagcatcctcagaaacgtcctggactcctttggcatcctcctttctgcccctcctttcctttacctcagccccaggcaaccactgatctgccttctgtcattgtagattagtgtacattttgtagagcttcatataaattgaatcataaagtatgccctcttttttgtctggctccttctgctcagcacaattattgtgggattcatccgtgttgtcacctgtgtcaccagttacacagagacaaagaccttctgcagaaagattcaattctatgcagtccccacctcgaaagaacttcagattcccttttaacagacggaaacatgccagaagaccaaaagggctctctgtctttagaaacccatggttgttaaatagccatttttctcccgattaaaaatagctatttttcagttgcctcagcagctgcttaataagcacctactatgtgccaggcactgttgttagggacagagtgggaatcaggaaaacatggccttcctcttggggaatsatcagagaatgggcaggtgaactgctaaaaagttgcaacaggtgtacatatatttcttttgtttacaggttttgggaatgcaatcccatatttcctttttttacacattgaagtacttttttatgagcaatgcatgctcgtcacaaaaaaattaacaaacatggagcagcataaagaagtaaattaaaaatcacctttaatcccactgcccagatatggccaccattatatttcattttgttaattccacaggcgaggagtagaggaatatgttttgtttcattttgtgtaattaaacgggccacgggaactactatcagcttcctggggagctgagttgtgtttattttttttaagagctactaatttttgattaacaaggatgaatgtaatgtttaagaggaatctatttacaccctcttccccttctcaataaaacaacattcttccccaccaagtgtggagtcgagactctgaggatgtatggccctgagctggrggattctagggacatttttcatgtcactacctagacagtcgtgtgagtgctccagcagtgagggatctyggctgcaggttacattccttgccgaagccagggctggatgataattcactttgtcattacttaattctgtgatggctgaaacgactgagccagaataaaastctcagtccctgaaaagatgagagactcagtgtcaggatgtttaggaacagaaaaagcaagagggcagccgaatggggccatcgggtggctgcataaagaagtctgatgatggatgcagcgctcccaattcatttcttttctaaatgacatatttgtatgtttccttcatcatttcattcggtccacacgtatccatgcggtgcactctgtgtgccagtcatagaggccacatccggtcgtaggccgtaccccatgcacagctgtcctcttggcacagttgactgaacatgctttygcygtgtgggagacygaagctatatctgtttgagctacaactaaaaccctggagtctctgcatgcctttgccaacatctggtggttccccaaatgtgtcaggttcttctctgcctctgtgctagggtttctaccctgaccgccacccaacaacccctgcgcccttatcctctcttcttcctcaggacgttactacgatccagccccacttcagcaccacggtcagcacccaccaattgcccagcactcctgctactgggttgctaggtatttcgcacatcagcccttctctgtgcctctgcccagtttgcttcctctgccctctctccctccaaataacagctgcctggctaatgtctgcgtatttgctggcagcagagtaacactgaggttgatgtccagctctgccattgagggttgtgggactttgggtaagttacttaacctctccagacctcattctctccaggtgtaaagggagataatacctagaggattaaataggctaatctagcaaagctcttagcacagtgtctggaacatagaaagaacccaatacatattaactattattgtaatctgtcaagaatcatcccaaatataccttgtgctaagaacctttcctcatcatttccttggggtgtaatacaaaaatctgacrtattccagaggcttggataccctccttggtactcacttggcatagcttccatcacactgtattttgtaattgctcatgagtgtgctagttaggataagtaataatagcttctgtgatagataacccctcaaatctcaatggcttaacacaaaactacattgctcactcctattacagtcgaactgcagatggtggggtgggatggctctgctccataacgttcagagatccttggcaccttccatttcatgaggctgcctcttcaaggtgtagcctccagggttgctgtggaagggaaagagagagcaaggagggtcttgcagggggtttgcagccaggcccagaagtgacattatcacatctaccaactttgctctatcctaatctagctgcattagaaactgagaagttcagcccgcctgtatgttcaaaaagaagataaaattatctctgaccacaggagtgcttctcatctccccaccaggccatgagatgctcaaggtcggtggccatgtgccttgggtctcttatccagtgttagctcccttctgcattccctggtcacctccagagctgagcaggtggcactgtggggaggggctttccaagcacagatgataggagatgcaaaggtacagagggtctgggagaaaactggccgcttcagggaaccacaagccacagcaacatttgcttgggctgcacacatattactgcataaaaatagctcgttaccaccttagcataggatgcatgtggaggtggggcagggatgagccagggcagcccaggagagcagagcttacagtmctctgggtagaggccagcatttctgatcctgtctgcctctgctatggagcctatgtttccttggttccaatggcaaggctaacaagagcgttcctccttgggtcatgtatctctttgaatagagctgcatccctaagccaaggaaacatattgtattgagtagtgctttaaagaacaggcaaggaatggaaattggcataaactttctaaaagacacgctgcagtatgtattaacttttttccaacagtcacactcttccatacccgtaatttcattcctaggaatatatctcgaaataatcagaaatggtgtcaaaaatgtatacactcaggaaacagatttatgtgcggagttgtacactgaagccttatttatggtagcaaaaagttagaaaacagccccagtgtccaacaataggaggctggataaatatattacagagttgccatatgatggaataatatgcagtgattaaaatttttgaagccaggagaaattgtttctgatataaactgaagtgacaaaagtgggacatccaagttggtaaacggtacgattccaattatacaaatcacacgtggagaagactttgaataaaatgtctaaggataggagcgggctttcaggctcctggaattatttggtgatttttcatgttttcttcacactstcttgtattatcaagttgttaatgttgaacacatacattacttttataaacagaaaagtactttttaagaaacaaggggcaaggaractaagaaaaccatcctttcttggcagactccctcagaggtactatgtttcttttctacagttctctcaggactcaaatgcttgcctagaccaacaggcctctgactccataataggcacgaactcgcaattactccctggtacacaaccttttcagccaccgtaacatccattcaactgcacaaaatatgtcatctaaaacctcatccagataaccctgcacattgcacttttttatatatggagaaatgaaaaaggctttttgctttgtaagttccataaagacatttcttggcatctagaaaatgacaagaacccttcaacccagacttcacctcacacccatccctaactttggttacagttcaaaagtgttcatggaagtttgaaaagtggtttcccttttcacctgaagctgtgatttccagtgtggtctggaggagaaaactgcctcgaaggaagctaagggatagaaaggtgttttcaatgtcttctcttaggtggggttttcattcagtcaggttaggttgttaaggcaagagagataatgaacaaaaataacaatcttaccctcaaagatacaataaaatgcactcatgttctcatttcgatgccagaatatgaacaccgagatggttctccaactcccatgcaccaagccccttacaagcttagactcgggtcaggtcctagaaaagaaagtttagggtgtttagggaaatgtttgcagtgtacccagtgagtggatttaaccaaatctgtatctcagagcaggcaccactcccatatcccaccaggaagccattgtgagatatagtctgcccacagccccgctgccacaggctccaatgccagggaaagctgtgtctccccatcagtgcaattctaagaattaagtactccttccttgccaattacatggtcactatccttagaattgaatttaagctctgatagaaaattgttgaaagccttcagtgctcatttttcaccaaactgaactctataatggtactayaatagaaaaaaaawttccaaagttcaattggaattttttcccagtaacttaataataaggctccaatttcaggaaaatagyttcagcatgagtgaaatcacactgtttgttatgcagcatcaaagctgtcctccaacacagggcagaggccagtgctccctggagttgaactccaacaatcatttaaaaacttttgtttccaatcatttagaaacttgtagatttttctggcaacatccaagaataagttatctcacttagawgagttttctgtgaaactgaagctcaccacttcaagtgctrtatctttctatatattgacttcayttctaaaacataggtttccccgattcttaaatagagtatgggaaaggaatttaaggtcatttgaggtaatcattcttataggttaataagtgaaccaagacaatgctttacctgattttgagttttttctgtcttttatgctttcatacaaaatgtcatgctctaatcactaaacctgactccagaaatccacctggaaaacaaagtagacaaccaagctttttgagaattttgacttttttaaaaaaagaaaaagaagcccgggcccggtggctcacgcctgtaatcctagcactttgggaggctgaggcrggcagatcacgaggtcaggagatkgagaccatcctggctaacacggwgaaatcctgtctctactaaaaatacaaaaaattagccgggcatgatggtgggygcctgtagtcccagctactcgggaggctgaggcaggagaatggcgtgaacccgrgaggcggagcttgcagtgagccgagatcacgccactgcactccagcgtgggggccagagggagactccgtctcaaaagaaaagaaaaagaatgatattagcaggaagagagaattaagctttattgagcaactactaagtgccaggcatttttctgtgcattttatcatttcatccttcaaacaaccctaaagctgaccttactgtcaagcattcaccattcattctacatctgactctcaggagaagaggagggaatgttgggtcaagtgatccccagggttccttcaagcaccaacaatctctatgtctcccatcctaacttaaattttataaaacaaaggatttgtttaggtgggagagtagataagtctgccctagggctggttgcctctttcagcccccattcatgcataacaaatcacacacaaacttagtgactggaarcaacatcgttttcgtgtctctgtggttttaatggctsaggaatgtgagcagggcacactgggagcagcctatctctgtgcctcaatgtctgaggccttagctggaatccccaaggcctgggagctgatgtcatctgaatgcttattcagttgtttatctggcaattgttgattgctgtcagccagaacatctacttgtggcctctccacgaggcctgggctctctcacaacatggcggccaggttccaaaggtgagcatcccaaaagccagcttgcagtggtttctctttcgccttttatgatccagcctcagaaatcatacagtgtcacttctattgcactcattcatgaaggccgtcataaacgctaacccacactctaggggacaggaactagactccacctgtgaacgagaggagcgtcagaaatattakcatggccatttttggaaaatgctatagagccaaartctgcatgaagagagaacagattgggaatcagaggtacytgagttcagattccagctycattgctcaytagctctgtggcatggggaaatcagtgaacyctttactgctgwgttatttgtaaaatgactgtgattgctgactgattatgtcaggctatacaatcatttctttggttgcaagccatggaaaccaaaccttatgaagagaagaaaacacatatgcaggcatgtgtgtgcacacacacacaagacatagagaagcaaagaaaaataggatgaagcaagcttcaggaatgccggaaaaagctgcttcagcgatctaggttcctgggatgaatggatgatatttttaggctctcacgatcaggacaaatcagctccaagtattttccatccttatgtctctctgaaaacattgtacgctcccagcatattaagtcctgggtggcctgtcttgagtcggactcacttcatcccttcactataggagagagaggcaccataatggaaagtctcagcaaggctacatgaagaatggggtaaactcatgggaaaatgcaggtgtccccacaaagaaggagaaatggataaacagcacatctactctggacatttgcaggactaagaaggatacaagatggaaagcagaatatgggtgtactgttcccgcttcccaatatgccatgcatgttcacgctccagaacttgactgtcagtcactcttcctaaaatatttcccttcctgcctccacccatcacaatcctgttggtctttctaggtcagtttcaaatactgcatggtccgtaacactttcggtgagtaggaagtaatctctttctccttgaattcctccattctattttataactttcttaggccattattacctccttctttgtcttagccatttccattttgctttatccaaayatttccaaacaccaggcaccttcatctcctgtaacctatctgctctctgtgtactgtcattcactgaatgcttttaagttgactttaatttgacttgtctttcttttaacttagcaataatatctgtgatatgccagctatatttttaccattcactttaaaacaaatattattgaaatgtttaaaataattgctgatcccctgttctactactcttccctattctggctgagttcctataagayagagatcagctcttagattccccgtgtatcatatccctgacatgcygcactgtgctattgatctggtggccgttcaataaaaagtcattgagtgaacaaatagaaagcgagaaagagggaaggagaaagagtgagatgaaataatgaagttaaagtgaactgagtgggactcatctttggtgagagaccctaaaggcaaaaaaaaaaaaaaaaaaaaaagagctgggaaagttgaattttgaggagaaggcaagaatactttattttccttctaccctaatgacascttctctttggactcatcctcctgtgagttggcaaggggaatggggagcagcttaagcagcagctgccaccatgaccattattcccaagcaacttgcccagggcaccagaaggcatgagctccatgtttcccagccaaggctcttccagccagcagtgctgatgggaagaacaggcaagccagagtgccttatcaagtgyaagactcaccacccatagaggmtccacccaaagccaccgggagaaccaacacatccctgcagacgacaaaagcgtccttttgctcatggccacatgccttgcagcacaagctcctctcaratrcttcccaggacctcaccgtaagggacagtcaaccagaygtgtgcttccacatgttcttcaaatgtgtttttcatttgcttgggttcaacctcattataatggcattagccagaggaggtagcatggtggttcaggtttctggaagtggggttragscagtcctttcactttcttaactgaaattccccaacrcccttggcttactcacccctcagcatgctttgttctctttctgtctttttctgtctaggttctctatcatgagtgtcctcttctctgaattcatagcctttgtggcctctcttcctgctaaccatgctaggctaagtaacgcccacaccgcctccactccccaaagctgtccacatcctagtccttaccttatacagtaaaaaggactctgcagctatgattagatgaaaggtctttagacgaccttagatsatcaggatasacccattttcaccataaaagtccttataagaaggaggcagggccaagcgcggtggctcaygcctgtaattccagcactttgggaggctgaggttggtggatcacttgaggccaggagttcaagaccagactggccaatgtggtgaaacctatctctactaaaaatacaaaaattagctgagtgtggtggcatacacctgtagtttctgctactcaggaggctgaggcaggaaaatggtttgaactcaggaggcggaggttgtgatgagccaagatcatgccactgccctctagtctgggcaacagagcgagaccctgtctcaaaaaattaaattaaaaaataaaaattaaattaaaaaattaaaatggaggcaggagggtcagagtcagagaaggagatgcaatcacaaaagcaagtcattggagccacataaggaagaatccagaggtcaaggaatgcaggcatctctagattctggaaagagcaaagaaacaaattctgccctgaagattctaaaaggaacacagccctgccaacatcttaattttagactctgacttgtgggactataagaataaatctgasttgttttaatccactaggtctgtggtcttttgcatagcagacacaggaacctragatattaaccytcatctactttctcttccartcyatgagggttcccccagcggactccctctataatcagtacggtccattcagcattcatccatgcacaccccaagttttccactctaggggtgccgtgtgtgcaccatttgagaaacacggcctctgcacaggaattgcatcataatcatccttgcatccaccatgttgcccacatgggctttatacatagcaaacaccctgtaaacatgtatttaattgcatagaaagccagtattccattgccatccacagtgagcctcttaaaatacattcttcatcagacccatttatatttgtccagagctagtcatgcatgatggtaggagaatgaaatgaataattttatttttgccatcaggaagtaaacattttattcatagactttgtcatcctgtgtaatagggtctgagtattcactctgcattttagaacatcagacatatggaaaatctatttgatgtgtagttctcagttcctgaccttatgtctttctcagttcattatttccacctctctctagtcattggatttgtagaaagaacagagatatttaagaaacattattcrttccttcagagtcttggatttctccaaatagtccaaaaaatggcctatttttagatgattgaattatactagaaaggtggtgatcttgcccccagatgacatttgtcagtgtctagaacatttcagggggtgcgaggggaatgccactggcatctagggggcagaggcccgggttgctggtaaagttcycacaatgcactggacagcctctctgcaacaagaattatccaaccccagatgtcaggggggacaattgaagttgccgcttctccactctccccaattagaagtatctgcttaggtggagaaatcctgggctggaacaacaggctgcaacttggccaaatgacctctgattaaaagcaagagagctggcttaaaacctgttcaaggccatttcgaaaaacctggaggctttccctgactgcaagcttggtcttgggcaaaagtgccttatgactgctagaaaagctaagagcatctcaaagttcaagtgctggcatggaacttgggcyatagcattgcatgctggccttctgcattcctcttggtgcctctttttaagagggatgttggcaaattcaggtgtgttcaagggaggcaacctggaaaaaaaaaaaaagagtgttgcggggagctgaagaaggaggactctggaagcacagaaacccagattcctccagccctgttactgccacttagcagccataagacctcgagaaattgactcaccatctctaaaccagagtttccttgtcttgggaattaacaggaagattgtaatgagttaaagttcatgtgtgaagcgcttagcaccgtsactgccacctctaagcactcaataaacagggctgtttatgcttgttattcggaacgggagagggctgcaactcgggcacctgaggcacaatgggaagwgctggagctggaaaaggaatgagtgatggacagactcgatcatcgttgtgtagcatttgaaggaggctgtctctggtgggctgaactacgatgaatgttagcaaaattctacaggcatactgggactcaacctggggaagccccgcaggctgctcagcatggatcagtgatcctcattctggccaccagcagaggtgccttgctacacgccaccaccttggggcaggtgccactggacagtagcctgcgtggacaactraagctgtcccttctccactctccccagttagaagtatctgtgacttcagatgcagggagattttgaagctatcccattagaaagtcaatagtctgcctacctcattctttagcaaggatgccccataattaatcaagtgggctgaaggaataaaagcctcctgtgctcattgcattctgtgagcaaacaatagcgggaaacaaatgccagacgggctgtggtaggcataacagatgacatagtaggaattggtttatcttggcatcttggggggctttatcttagtgtaatcagtcaattagcaaactttcctaatggctgagaggcacactggctagcatgtgtgtggttgtttgtttgtttggtgttttggggttttttattttttggtttttttgttttttgttttttgttttgagaaaggtcttactctcttacccatactggagtatagtggcgcaatcttgactcaccacaacctctgccttccaggctcaagcgattctcgtgcctcagcttcccaagtagctgggattacgtgtgcataccactaccacctggctaatttttgtatttttagtagagacgggatttcaccatgttggccaggctggtctcgaactcctgaccttaaatgatccaccgccttggcctcccaaagcactgggattacaggcgtgagccaccacacccagctggccagcatgtttttaggtgcttagtagacattgcattctttctccagggttgccataacaaagtaccatagactgagcagcttaagtagcagaaatttaatttcttacaattctgtaggttagaagtctgagatcaaggtgttggcagagttggttccttctgaggcctctcttcttggcttgtagatggctgtcttctccctgtgtcctcacagagtcttccctctctgtctgtctgtgccctaatctcttctcatgaggacaccagtcatatctgactagggcccactatagtgatctccttttaacttacctgtttaagacaatcatactgtgaggtgctggagattaggacatccacatatatatttggggaaacacaattcagaccagaacaggcaccactaaaatttggcagcaccttttaaaagggccttgaatggaaaggagagaacctgtggtttacaatagccgccagagcactgggggctcttgcgatctcatgagaccaaactccaggtctaggcacacctggtttgggacaggcctgcttyagcattgaaaacaggatctttgcccaacaggaaggttggagaatgaggcatgcatctaagaaaaaaatgcaagcaaaataaaaattcccacatattgccttaattgtctttasagaaggaaatatcccagggcaagaatcatcagggcatgctctgygccctgcatttgatttcatgttttcaggagcacccctcaaggtctggagaagcacaggtgctgtacctgtacaagccagcaaggcaaagaggcctggttgcaagatgtgaggcaacattttatattttacttatgttattcaatttgtctacacatcyatccttttctggaaaaagaccatattgccacttgagtttcagtattacagacattgttttcctctaagtgactagactctctgtttagctcgccacacaacatcatatctgccatgtgctgtcacacactaataaaagcatagaggagtatgtaaaacagcattgcttctctaaaaattcagccctattaagtttgttggtacatcacctggatttttattaaagtagtaaaaatgttccgcaaagtgactttgaagtaacagtacgattmtgagccacgttaaagaaatgttaaggtggagagctctgttgctttcaaatactagtataattctggccaaatatccctgtttaaaatgatctgagcactttaggccttttactaatgtatggattatagttcaagccagtagctagggagctgtgtgtttgagcctccatctctaccacctagcagcaaacagatcaacctgggaaaggagcagctgcctgcacttcattcactgaggattcttccaaccctctctccgtctaacgggctggggtccttcatggacgcattsatagatgacagtgtgccaatccagcacacaccagaaatggttactccaccagggagctcacctcatcttctgccattggcctcccaccccacatttttccaatgaggttctttgagtcygacttatttttgacaaagccacactggtttgtaatgagmattgcattcttttatacagagttggggagggagggagattttgaagggggaaaacacgaaccaagtaggtagatatttgcatctctcaacttttctcgtcaccaaaaaaaaaaaaaatttcctcttcaaatttgtaggtaaaaagacgtgtttctttaactttacctcycacaaatggtatgttcatctatcgkctgggactcttttagttaaaaaggaaacctaactcaaaccagaatgggggtggggaaagtgaattgatgtatctcacataactgggagatccaagggtggatgtggttttaaccagaactcsatctgagggtttgtgggaaatattcaaattagaacagttaagagcagacaccagccaatcaaaacagtccatgccagtgacgtcagccctgcatgtgccgtcagggtggggctatcaggaatctctctccctcttgactgccttcctcattgtcaacattactctcaaagaggctttggtcaggtttcaaaaggccagcagtagctctgggtctacagctccccagctctgcaccccagagaaatgcctgtccagtattctccaaaattcctgggctcaygctcacttgtccagagtagatctctagcccaccctatacccatcgctggccactggccccatccaaaactctggggcagtgagtggagggggggctgccctacgccaaatcaggtggtcttacaggaagaagtgaaaatagatgccgcagaagccacaacaatcccatccactgcaaatcacacgatagtaaatggcactttagaccccttctatagtttccagaaatgtagagaggatcacrttgctttagtgtcttgccccaagtgctattaatatccctgtccctaaragattgatttttattatcggtagaaatacttaatagaaatgaaatctacgctctcggtcatagatagctggcataaaaattaaacaaaacactgtgaagcatacttctgaagtgaccgcatacctagctatgctgccccagtgagctcaagtgtgttttcattagggcatttggtaagcctgggggaaactgtttctgccccacaaaggaatgttctgcaaacrttcagtaactaaccatgtgatgctttctacctctgtaactaaagctaaagacttttacctattgacttggattctcagctatcagtaggagggacagtttcaaaacattgtctatagagactgtaacatatgactatcacaagacagactcaggaactgttgaatattcatgagttaaatgggcaaaatgtttgacatcctggcatctttggatgtgtttgttttacatttagtagcttttctatagaagacagaaatgggaaatgccttcttaatctgcttgaaggagagggttctgatgatactcatctatcttcgatgagaatgggtctttatctttaattcctaattaacggttttgccaactacctttatctatttcccttgtgattttaagagaaaggaaaagtcttgagtgtgttgcctctgcccatctgtttctttacatcatttgcgagctcaggtacttgttatttgctgagcaaggactttccagctaggattggataaagcagtagctaggttcgagagtaagagttttattgctatcatttagagtatttcttcattcgttcatgcatgcctttgctcataaatacccccaccttattccacaaaagatatgaaatggagctttattgctatgagttcatgctggcataaatattaagctctgtgtaataatcacttgggctattcccgtacatagtgcagagttacttatggccaacgcaaagtctattttcccatcagaggttaacgttcccatttacttgatcagggtttggataatgcttcattcacagctgtttttcgcttgcaagaatccrtctactttatcctcactgaccttaccctggcaggtggtgccaggatttcctcaggcagttgtttgttttagcattttcgagtatttatactggctgcggtaagggagccaggatcctggggcttgtaagtaccaggtcttggtaagtctccttcctggcagcagcagcagcgttagtaaaatgcattttccaatactatcctgtgtcttaaatggtatttttatccattagagttgagtgcaagcaatagaaattaactctgaagaacgaatgcaaaaacagtgtctttgagggctgtgtgtcgctgacaggcaggcgggtccctcaggggagccctggtggacagtctgatgctcggtgccaactgtcagcccaggccaggagtcagagttgggagagattgtgatgccttggcttgggtcagggcccacttcctagctcggggatggtcaaccttgacaacagcgtgtgacaagggtggagtcatagcaattagggtgtttttaccaaagtgaaggaagacgaaatgccttcctgggtggggaaaaaaacaacagatgtccactaccctccccttttgcagtaattttctctccatatttgatgactattctatcagatattgttaaaatctttccccagtatatgcaatttacctttaatgtcatcttcttggtacagtcttccattttgctgagttcattttgttttccataaagctaggaaaacttagacttgcccacttttttgttttaatagactttgttttttagagcagttgcaggttcacagcaaaattgagcagaaggtacagggagttctcacatgcttcctgcccccacacatgcacagcctcccccataatcaatatcccccaccaaactgggacattcgttacaactaatgaacctaccttgacacgtcatgatcaccagaggccatagtgcaaattagggttcccttttggtgttggaaatcccgtgggtttgggcaaatgtataacagcatgcatccaccattgtaataccatgcagagtagtttcagaactctaaatatcccgtgtgctccacccgtacatccctccttcccgccaacccttgccagtcattaatccccactctgctgtacctcttactggctttttttatgtcttgagtcacagtcttgctctgtcacccaggctggagtgcagtggtgcagtctcagctcactgcaacctccacctcctggactcaagcaatcctcctgcctcagcctccrgagtagctgggactacaggcacgtgccaccacacccggttaatttttgtatttttagtagagatggggtttcactatgttggccgggctggtctcaaatccctgacctcatgatccgccctcctcagccttccraagtgctgggattataggcatgarccaccgcacccgccctggcctctttaatgattgtttacttgggtaggtaaagtcttccagtccttttcattctctctaaaatcagaaactctttggaaatatctgaattttcagatcaacatcattgcctgtaaaactctttaagaccctctttgaaatggggtaacagccattaaaaaaatgagaaggccagactcaggctggacatggtggctcatacctgtaatcccagcactttgggaggccgaagcaggtggattagttgaggtcaggagttcaagacccgtctggccaacatgtctggccaacatggtgaarccccgtctctactaaaaatamaaaaattagccaggggtagtggtgcacayctgtagtcccagctacttrggaggctgaggcaggagaattgcttgaacccaggagacggaggttgtagtgagccaagrttgcaccactaccctccagcctggatgacagagcragatactatctccaaaaaaaaaagaaaagaaagtgaggcaaatgaagacttgtagtgattgctttactataatcccctaatctcccctgacttcttccccactttttgtatatattttccatcttctcccattgggttcagtctgaactgaatctgtctgaactgcctggttcaccgcacgtgaaagtccctgtctccactttcttctgtctcaggaaacaggctcagggcagctgagaaacaggcccaggccatcctgctgaaggacgacaccatcaggaagaaacaggtagtgacatgaaatgggcacctactatgagccaagggctgactcttggtgtctatttcttcatttaatgatcacggggacgctgtgagctcctttcacctctcactgcctcaatttccttacctgtaagtggcgacgataattccttcctccaggactattgtgagagtttgagagctagtttggagaaaaagtaggccaattaaccagctcccctgcatgcaaagcttgttatttctctgtgacagaggcagctctttaaaatcttaccgtgcacgttctgcaggacacctttcyctggatttttctttcacgcaaaccccattcagttcctactgtgctctgcttgcctctcctgttgttgagaggctcaggaaaaacaactggaactaattcaccactctggcttgatgaagtcacttcctgctgctctgggcattggcctctggaacaatcaaccgctgtctggtgggaattctattaacatgactgtgactgtcttactttggacagtcttactttggattgcccccgaagcagatgctgagacaagggttagggtgaaaatagtttagttggsagaaaatcccataaaataccagcgggagagcaggaagtgggacaggagaggaacacagcccacacactctgcattgtccatccagccaccactatgcgtacaggagctgaatcccagaggaacacactcctgggcttattccatccaagtaatatcgtaggctgggggaggtccccaaacgccagtgagtccttgaccccagtcattgtccaggctcttgactgtgagaagaaattcaagaatgagtcagaaaatagtgaaagtatggtttattgcaaagcaaaaagtatacactcaagaaaggtgagtgtgagcgttttcaagagtgaaggaatcgctctcaagggggattggggttgctacctctatggatttctttaaccaagcagtggaatgttcatgaagattcctggaaaaaggtggagatttctcataactgaggtgtcacccatttttgcaccaaatatgggtgttcctggaaccatcgaggtgccggtgggtgtgtgatatagtatgttaacgagcatatattgaggtcctagggaaaacctaagtgaaatccaccaccacgatgggtccarttggtcttagccagcttggcccacactcttgttttttcagggtcttatcagcccctagcttctgcagctatttcaacattttccttttgctaatcatgtgaaactactgcctggaattttctattcttctatgaccaccctgtattcttcttgtctcatggggagcaagggagctgaggtataagtaccccagtcattgggtgagggttgctcctgagagaggtgctgattctcatcgcattcagcctgctgcatagatgagcaaaggcctttggctgctggtgcaagttctctggcaaaggaatgcaggtgctgacaggtgcatttggcctgatatgcactgtagggggatggcttccagggcaccctcaatgcctcttaaaatcattctctccttaaaaccagcycattcatctcttgggggcttctgcctctctttcagacaaattattgcagagagtccagtagccaagtagaattgcattgagcaggcacatttgacaatgacatttgattccagaacttgtcaagctttgttctcagaatatgaccagatcctaataatgtctgtccactgttgagggaccactgcgtaccagaccctatgtgggatctgtgaagtctattacctcattcagtcatcccagcaaccctgtgagggatcccccactgtctccaatttctgcactaggagagggcgacatggggaggttaygccacactccacgtcactcacccacggccctctcagtaaacggtggacacaggatccgtagcctgaatgtctgtgtcatggtcaagctccaggtcttttccagcgccacattttccagcacaacaactagattagtaagtgttcgcttatgaggatgtactaggagcgtagctaccgagcgcttcctgcataccacgtgcagttatacacacctcacatgtaagaatttaaacccccacggtgacgctaggaggtatgcacggttacttccattataaggtgaggaggctgtggcataccatgttctgtgccatgtcctcagataccattataccagrtgccattccttaagcccctgagtaccaatcccactccctctccatcacacacagccactatggaatacactcacatcagcgtcagttggccccactcactgtggggcagaatttccctggtctgatgcctggcatctgcccagaaggcactgcagcrtaggggacagtggggtcagactccactgtaggaatctacatctccctgcacacactgtgaggccttgcaagggctactgcacatcagcgagcctccattttcctcatattcaagatggaatcaagcttgtcttcctggcgggttggtgaagatggcactaaatgagaagggaacagggtaggcaccaaatggttgctgctgccgaatttgggaccggggtgctggtggtcatctgagtgccagctctgcctgaccttgatccagtacatacgtacacacacacacacacgttcacacacttgtgcatgtacacatgtgtacatcatgcacatacatgtccacacattcacacaccactcccacatctgcacccacatgcaagtactcatacatgcactcatgcacacacatgcacacacattcacacatgtgcactcacacatgcacacactctccagtaagctttttggagttcatcaatattacacccaagtcagcatttattgagcacctactgcataccagcattatgccaagcacaagagattaggggaagttgggcgtaatggctcacgttcataatcctgctctttgggaggctgaggcaggaagattccttgagcgtaggagttcgaggacagcctgggcaacatagtgagaccccgtctctgtctttaaaaaaaaaagacacaaggggagcccagaaatgaaacagccaatgtatcatttcaggcagaccatctcgttttcacaggaagcagcaaagacagggtgccagacacctttgccacgctccactggcttccatactctgagaaaagagggaatccgactcatgagagccagaaatgaaattgatgcaatcccaaacccagggccagtccatcctggaaggtaagccccatggggccttgtgactgcctcttctttcaagcaaggtcctgtcataattttctccctggcacaacctttatggagtgggttataactgtgcctgaaatggactggcctctggcagagcattcctcggtgtgggagccatcaggccctcaggaacgagtcttcctgccaccaggaggtttcatgtatgcacctgtatcatcagtagtgtggtgtttcygtatcgtcagaactcagcacaccatttctggccagcatggttgtttgatgtagactgagaagtgggttcagtaatgagcacctggcacactcaaactctgctagggttgggtggccacactcctttgaggcttgaccaatgtcacctgaaggtcaccaccagtagccatccagaacagtttaattgggggttggcagtccatctgcagtgacacactgcctgtgtcctccaaaactcagtggattggagaattgagtcacgatgaatcttgtaacccatacccagagccctgaagaackcaggttgtttgcacgcccagccacaaagaagttgccttctcttgatctttgaagcaattaaatgtcatttagagaggagaggtttgctgtttaaaaatattttttaaaacagcttgagtttattcttgtaaggctgccattgggtctgagaccccagaggagcagtgcrctgccttgcagttactccgcagtgggcmagacaggcatgttttgctctgggaagagttgctgaacacctgtctgagcaagggactctttgtggctgtctggtcgttatgtacaccacttggtcctacctccaagtagcttgtggtctcctgggagctgtaagaaatccaaaccagcaaacaacatagtttttgtttccagtgttaaccacctggcgaatggtccagataggaatgctgtagaagctccagggaggaagagactccaggggctcaagtggtttagcagggctagcaggactagcaggacaagacagagttygaatgagatcgttgcatctaagtggaataaggagaagctgataatgcaagaaggtcaaccrtctcacacacatctagggaccgtggggaaacccattttgctagagtagagagattggatgaggaagtacaggctgcaccctggagccaagctaagtaaactggacttcattctgaactgggagtggaggggtccatgtgcaaaagagcactgtgggaggatccaggggacactggagccctggagcttgttaggaagcaagctactcattcccagggaagaaagaggaggactcagagtggggaggagtgtgccacatgaaaggtgcccacagtattcaaatcccaacttcgctgcctgctaattatgtgaaccgatgctggctacacaatctctctgagccttgctattctcatccctgaaatggcaatagtaatcccagcctcaaacaatgatagttaagattatatgaaatatcatgcatgtagtgccagctacatatgtacagtgtccaaccccacaaaggggatccctgttattcgtagggagatggtgtagcagtgttgccctagagccaattcatagcagtttgcaggrgccagttgttaccatctctttgtagctgtgcattcagtgacatcgtgggagtaactcgaaactggccacaktggaaatacttctatcatggaattagacaaacactattaattcaagctttccccacctccagagaatcagatgttaaacatttgccagtgttcctctggcaaagaaaaggaaaatagccagaggtargtgaaatcaaatgagagaagtcyaaccttgcaaaactgagccaactgcactgatgtatcctgttgtctgtcccacaccctcgcaaggcttttggtctttgtccagcagagtcaccacgtcttattcaggttacagtgctgagctatttggaaaccaggctgggggggtggatttcaatgtcatcttactaaaaaagytcactaatgaaaagtgtattgctaagacagcagcttcatatttctcccagtctttatcagcagccatggattgaatcgttgacttgattttactacactgaggtcccactgaggaaggccaagttcctaaatcatgcacctgacaggtgccatatttctgagcacagagctgagctgtgaccttctagtttcacagtaactagagctgggtgacatgcttaataaagggagtacatggtgcatttttaaaatatggaatgaaggtggaatcatgcagacatgtcagtctgaaactggttaccagaagcaaggtgatcaatcttcctgcctgtcttaggatgctgatgtgagaagcacgatgactttcacttggcagaaggatttggaagtatctgggcttgataagctacctcatgccaaggaccatgctctgtatacgayttcatcttttcacccaccctatgagtgaggttttagtgtctccatttcacatatagagaagtaaaagcttggaaggttagcacctctctccatgtcccacagatactaaagggctgagccaagatttgagtgtgcttttgtctgattcgcctctgcttggccctctgtctccaagctgctgcttagctggaggctcctcagtgacatcagctcactgtggctccctctgcctggaatgttctcccttgcccaggccttcatgtgactgtctccttttcacttcagtctcactatcrtctcctttgcaaggctttccctgatcaccttcgctaaagaagccctcctcaactctgcccacctgtcactggtcactccctgtactgttgcccaatgggacggctttcagagcacataccactctctgaagttatcgtattgtgtgttaactayttttatgrtctcccttcctcttgtrgaacagaagctccatgagaacaggaatttcatgccttgttctctttcatatatgcagagtaaagaagaatgtctgacatataatagctacacaataaatattgaaagaatgaggggatgggtggacagatgcatagatccatggaagaatggatggatggatggatggatggatagadggatggatacatgaattgatggatgcatggatagacacatggatgagtgatgaatgcctgggtgggtgatgaatgcatggatgaatgtggaatgcatggatggatgatgaatgcatgggtgcgtgatgaacgcatgggtgagtggtgaatgcgtgggtgagtgatgaatgcatgggtgagtgtggaaagcatgggtgggtgatgaatgtatgggtgagtgatgaatgcatgggtgggtgatgaatgcatgggtgggtgatgaatacatgggtgagtgataaatgcatgggtgggtgatgaatgcatgggtgggtgatgaatgcatggatgaatgtggaatgcatgggtggatgatgaatgcatgggtgggtgattaatgcatgggtaggtgatgaatgcatgggtgagtgatgaatgmatggatgagtgtggaatgcatggctgagtgatgaatgcatgggtgggggatgaatgcatgggtgggtgatgaatgcatgggtgagtgatgaatgcataggtgagtgaggaatgcatgggtggatgatgaatgcatgggtggatgatgaatgcatggatgagtgtggaatgcatgggtgagtgataaatgcatgagtcggtggatgaatgcatggrtgaatgatgaatgcatgaatggatggatacatggatggatgaagttgtacaagctcaaaccagctcagattggaggaagcgtcttacttgaagccccctgtgactatgttsgggcttgtctcctaccatctcactgaaggagcctatctcctaagctctctcctagacacctgtatccttactttcccctcccttcccagcctgagcagtgtcagcgtcaggagcaagatgattgatgaagtgtcagcagggacacaaccagctgggtgagcaggggctatattgtaacctgcagccaggagctgctcccttgagatggcctttgggtacaactctatatggcttcccagcctttcttccagctgcaggatcatcctacccctgggactcccttattggtgtcctcattaggccaaycaatgcaaattaasccctgattcacagatagtggggatatacagtcaccacgacacatatggcctctgtcatccagtttcactcagtctagagaaagaaagagatgaataaacagacccttttagtataaaagctatgatgaaagtgacatttgaggtgaaaacactacaatataacagcagcagagagaaaggcacatcagtcaaagtcaaggaaggaagggacagctgggctcagacttgcaggtagaccaggrcaaggatgttcaggcagaggaaatgggataaacaaaggcatggtggccaagagagctagatccgttcactcaacacacaggcaggaytgcaacgggtcttgtgtatcctgtggatctaatctatccttaggcrtcagtctgggaaacatgagttccgtcttctccactaatctgggaaggagggtcaagtggtacctctgtctccacctcctccaggcctacacagtttgtgactgacatactgagcaccaggtctgcatcacccaccttatcacaygtgggcacaggatctctgccgggggcaagcggtatgatgtgtcctggtcacggtctggctggtgatttggttacatccagacacggaagtcgacctagaataacctaagacaaaggcagtcgtttctctggctgacattgtcagaacgttaaacaaccaaaaacagcaacaaagtgatgggccaagcaggcaagtttgggaacagctttaatgactaatttctaatgagagtttcaaaacactaattttccagaacagagaatcaagttgtgctcatttataacccgtcatctgcaatgagacagaggatatttctttctgtgttgtcagttaactttctgagctggacagaatacaaactagaagaggtgggccgtaaatcagctcctttggaactgataaatggatattgtacaaatcctgcatttgcattggctctgaggacataaatcaattctcatgatcttactttggaaaaaaatttccctttgaagtcagastgagcgatttatgtagcattctttcctgactttatttttctcagctttttaatgattgtcttttcactttctgcacttacacaacattgtaaagtgttgcattttcatrtagagaaaactggaccttggtctgaatcttcccacaagggataattttataacttttttgctcagccattgaataacaattgcttttggaaagattgtcataatgtatcagttagaaggcaccttagagaccatcatttcacatgacctctgtttttyagatggggaaactgaggcccaagagtgacagtcatgtgctgcaggtcacaggccaagtttgtgacaagaccrgggtgtctgttcgggttttggagaaacaaggaccctagatagggtccattcattcrttcatttatttatttwtttgttcattctccagacaaatcgttatcttggccccttctgctgcagccattgccactaagaaggcaggccctgcaggggagactctgcacgtcttttgtttgttgagtatttgctaaacgggcaaaaaatggaagaaaaatcaaaacatcactgttggctgggcacggtggctcacgcctgtaatccyggccctttgggaggccgrggcgggcrgatcacgaggtgaggagatcaagaccatcctggctaacacggtgaaaccccgtctctactaaaaatacmaaaaaaaattagccgagcgtggaggcgggcccctgtagtcccagctactcgcgaggctgaggcaggggaatggcgtgaacccgggaggcggagcttgtagtgagcggagatggcrccactgcgctccagcctggggcgacagagcaagactctgtctcaaaaaaaaaaaaatcaccgtccttttttggcgttctgtcagtcaagagtattctgaagactaycgagggaggagtgtttggtttgtgccttgttttgttctgttttagcagccctggaaatcatggatacctcccttccttgaagttatctttcccatgtataacagctgtattgatttatgagatataattcacataccgtacaattcacccatttaaaatatacaattcaatggtttttagtgtagtcacagagttgtgcaaccatcaccgccctcgattttagaacattttcagcaccctaaagagaagccccatcccccttaaccgttaacgtgcttccttctccccactgctctagtgaccactaaccagcttcctgtctctgtgggtttgcctagtacggacatttcatcggaatgaaatcagctaacatgtgatatccttaatggttttgtagcagaaagacatctacgtgggaagggacgctgctgagtgtttagagaamagacacattcatcattttattgtattttctcaactttagaacagttttcaaacatgtggaaacgttggaagaattttatagcaagcaccctttgccccatcaccgagaytctcccagcacatcttcttctgcttgctttatttagtgcacacctatccacctgttccagagatcaccactgcggcagtgggttctcaaaggagaaccttccaaccttcccgcattgagaaagaaaaatatcagttttactaaatgaaatatcaacattggagattttataagccgagaatgttagtacatcaacattagaagccctaaaarataaaattgcattcaaaggccaaaaaagtcttaggcttgctagctctccaggaaaggcctgtgtgttcaggacaggaggactaaggaccaaacaggtttgggaatgacagatcccttgacggaactggctgacaactttgctcaccagtcacagcagggcagcccagggagtgaacaggggcgttggcggggagggcagccattcccgcccgctgctaatgggctcgcttctcaaaggagcttttgggattcaagggtttaagtatcaagtttgactgatggatttggagggaagaattgaaaactgcctgagggaaggcgctttgctttttcttttgtgrggcaaaagcttttgaaaactgtgactgtacaaagagccacagctcctctgaggagtctgttatgcggcaacacatactcagatgtggacagcagtgagcacgctgcctggaaagggggaacagcaccgcgggcaggcttcagagycacacaccacrtctctgtctcagagtctatcctcgaccacagggtttaagtcyttgatgtgcacactgggccctggagagaaggtgcctgttctcacsggctgaccccacaagcytgtgagccgtaagcggtgtgattcgctaacagttgaatggcactggctatgtgtgtatgtgtatgtgtgtgygtgtrtgtgtrtgtgtgtgtgtgtgtgtgtgtgtgtgtgttgtgaagatacatttagtttgagtccctatgaarcgaggagaaaaggtcttgacraacaacagttcaatagctcctgccaatatgtgcaatgcaattctttttagtgagtgaattaggcttgataagaactacattaaagcttctgttggaagaggaattcaaaatgctcatctttgtaatttacccactcagtcaccagtgtttaccaagtgccaatggaagcctggagagaagagaaagcaaagataaataagcgtgtctctcggccttcaaagcactgtgcccagcaggaaggaaagcacacaattacgacatgccgtttttattgtatatatgtttatatattaggttgggccatgtgaaattgctgatgtgacgggttttgacgagagaaatggcaactgtgtggttcaacctaatatttagatagtattgtcttagctcaggctgccataaccaaataccacrgactgggcagcttgaatacagacatgtattactcacagttctggaggctggaagtccaagatcrtggttctagctggttcagtctctggggagggctctctttctggcttgcagacagccaccttcttgctgtgtcctcatgtagcctcatttccttggggcatgtacctggagggtggggattagggagcatacagggtctccttttataaggatmctcatcctatcrgatcagagctccatcctcatgacctcatgtaaccttaacttcctaaggagaggcccacctccaagtactgccacaatgggggttagagttctatcaacatccgaatttggggggaacagmaacaaatgttcagttcacaagtataaaatggatatattatttatgtgcatatacatcatatactgttacatatcatagataagacawgcatattatacatatgtgtatgtatatatagtaaatataccatctatagtaataaggtttcacaaagaagagaaaatggaaatgtagagatataaaggaaatcatctttgtattactagtctttttattgccaaaaaaattttatttgcaaaacaaatataggctcatggtaaaaattttagcaactgagatargcaaaactaagaaagatgtaaatcccactagccagataccactactcctaagacccaggtcagacagygaggcatcactgttaagagcatgggcgctatggttggacaactctatcacttactagctgtgtgwcctggasccagctacttagtccctcaccacctctgtttcttcatctatataatgggtcagtaatcccamccacatgaagttattgttagacttaaataagctgacccatgtaaagtgcttggaaaktccctggcacaaagcaagtgctcaataaatattatctgtgactctattattatcatcatcatgatcataattattaccgcaactgccactagcattcccttccaaggtattttctcagccagcagcagcaaatckgtttgggattgtatgtcaagccctgtgaaaaagaagggtttggcacacagggcttcatacaaagaggggttttgaagctgacctggccattgccaagtcattaccgtgcttgtgagaagggggcagcgagcctgccacatgtttgcatgtggaccctcacggtgctatacacatacctacctactataaagatttacttcgtatgtgttgtcatcttgtcatgctgtgttcatcatggcttttaatgtctacgtagcattccattatcacttttgatcaacagttccctgattkattttttatttttctayagtaaacattgaaggagaaaatataattgtygctaaayatttcagccaaataagtctgagctatgcattattctaaggccctctctcagatcttcacaatgcaaatctgagtattaaaggctctgagaattcttgcgcaaagggggacctcatttgatgttattaacctggcattccccagttttggaatgtgctccctatagctatttctttaagctaaataattagaggaagaatttctgggtcaaagaatatgtacagttccaagagattttcatttgtttccctctagaatgttgttttaggaactgacaaacttggagatacctccttctgggctaaactgtgactttttaaaatcacaattcgatgaaaagttcaacacactaaaatatacggtggtattcttttaaaaaattcatacaattgaaccgggtacaaagratcacctgggttttttgtttgtttgtttttgttttgttttygttttttggtttktggtttttttgagcttttagattcagggggtccatgggcaggtttattacctgggtctattgcgtgttgctgaagtttggggtatgagtgatcccatcacccagacagtgtgcatartacccgatagttttcaacccttacaccccttccatgctcccccttctagtagtccccaatgtctattgctcccatctttgtgtctgtgtgtactcaatgtttagctcccacttagaactgagaacatgcagtatttggttttctgtccctgtgctaattcrcttaggttaatggcctccagctgcatccatgttgctgcaaagaacacaatttcatcctttttcacagctgcatagtattccatggtatacrcrcactgcattttctttatccattccaccattgatgagcacctggattggttccttgtgcttgccattgtgcattgtgctgtgataaacatacaagtgcatgtgtctttttggcaaaacaatttatcttcttttggataaacacccagtagtaggattgctgagtcaaatggtagttctgttctaagttctttgagaaatctccaaactgctttgracaggggctgaactgatttacattcscaccaacagtgtrtaagagttccyttttctctgtaacctgrgcagcatctgttatttttttgactttttaataatagctattctgactggtgtgagatggtatctcattgtggttttgatttgcatttctctgaggattagtgacgtggagcatttcttcatatgtttgttgaccgcacgtatgtgttcttttgcaaagtgtctgttcatgtctttgaccattttgtaatggggtagttgtttgcttgttgagttgttaaagttacttatagattctggatattagacctttgttggaagcataatttgtgaatatttctttccattctataggttgtctgtttattctgttgatagtttctttgccaatttttgtttttggtgcaattgcttttggggactttgtcataaattctttgccaaggtcaatgtgcagawtgctatttcctaggttttttccagctggattcttttctcgtcttctggcaagtcagtttagaagaggttgatttattcagaaagtatccattttctttttctagacttcagacaggaaaatgtaaaatgagcaaaattctcgtgtataaactagctcaaaggtttgtggaagatttaaatgctgcatgacaggtagcaggtagtcgataaatgccagttgtgaatattgcttttcagattaaataacaaggctgaaagtaaatgttttggacaggctagctattcttcatacatccaacctaaaggtaatcatcctggtttatttatttattcaaaaaatattgaaaaattcacactgtgagccgggtcctaactagccctgaggatagcagtgaacragacagtgtggagtttccattctagtgggaagaccggcaatgaacaagccaatgaatgtctgatcacacaaccggtgtgattacagcttacagctctttcccatgggagagtcaacagcttaatgggatggagagtaactggagaaggccaccttagatgggctggttaggagggagatgatgtgtgatctgaagagtgataatgaaccagccaaggggagaggtgagggggagaaaccaacagctaatgcaaaggctgggacgatgggagagcctggctagctttggastggggaacagggtgagttgatggtgggaggtgagcagkgatcagtccccaaagccacaaaggttttgaagcctgaaagggacatgacrtacrttttttaaatctcactctcctgttctgtgagcaacagaatagaggacccggaaactgtagtagggttctgtttctacactagtgctaatgtagaacctcctacatccagaaagatgatagcagagctgagccacattcttcctggcaactgatgttcccacacgtagaaacagctggcatcctcatacagagggaggcttgcaggcccaggatacatctcatcccccttgctaatctcagtacttgacacccctgacctcaccaggggcaccaaacccaactgcttcctgcagggattcagctgcacttgtcatcacagagccttgaaatccctggggatatcaactccttggaattccagkctgctcttccacttgcttctgacacattgacttttctgcccattcactcacccatctttaaccaaggcctgtatggccagacatgaggccactcactgcctacatgaagagggaaagacaaagtgtatccctgggagctcrctaccttgtgtgaaaattacaacatcagatagtaaatgccttggtgaagatacgcatcccaagggcaggaagctccccaccttgatcactgcaaactccccagtccctaacagartactgggaagatagaaggtggtcaaagcrtatgtatggaatgaacactggaaatcartacacagggctgggaatgtgtgattctgagcactcmgtgatggaaataaccctccagctccttyacagaacagccagcagcatcacctgttttggtgatggtgcctccggatgatgatccgtgagcgcacactggactcgtgctcctgggtgagctctctccttgtgaaacccagatgcttctgtctcccagggaccctgcagccctcccggtaacctggcctccatcacgaatgcagtctctatagacggttgtctattaggatgccactggagagggaggtcccgtcatcacctaagctaagcacagctgcctctaagtacctccttgcttggcagcyggccagaccacattcactgascttcaagtcataatgcgaggctcagccatctatctcactgtggtccccgctgcagctggcttcatttattgacttcttgaaagtgscaatatccatgctcagcttggtctgagctggactcagagacccaggtgccagagcaaaggccatggtgtgtcggttaatcacccaataaaaataaactctgagaacaaayacagaggggtgattaactttcccattctggtcttctgacatcccrgtttgctctcccagtgagcstgtttctttgagataaaccaccctgggaaactgatcacctgtccagacaccaccatgccttggcgtaagtggacaaaagtggaacgtgacctgcaagcagcgcagcctgagacttaggcagagagccccctgccccaggttccatgctgctgagggccttatcagaaactctgaagcagagcaccagactattttattctgctttttgctcttgtaataaagtgttattagtgtttagtcaccagattaaaccccaaagccttacctcccctcctgtgaccatccatgtactccaaatcatgaaccaaaaaacagggaccaccaacagcccttaccaaaagaagactggaagcacaaaaaagcaacttaccatgaatcaatttaaagtgaagaccaaagtgtgactcaaaactgaaaaaatatatgtatttggttaagatgtaattgttaccraagcaccaggggtttggtctgggtcctgctgttcactgcacagaaagccaatcactgagayaagacaaaagccagggaagaaggctttaatcgggtgctgctgcagccaaggaaatgggaggtcagtctcaaatccatctctgaaatgaggggttgatgcaccagagaggaaatgtaaccgtgtttgggaaaacatggatgaaattggaaatcatcattctcagtaaactatcgcaaggacaaaaaaccaaacaccgcatgttctcactcatagatgggaattgaacaatgagaacacatggacacaggaaagggaacatcacactctggggactgttgtggggtgggggaaggggggagggatagmattaggagatatacctaatgctaaatgacgagttaatkggtgcagcacaccagcatggcacatgtatacatatgtaactaacctgcacattgtgcacatgtaccttaaaacttaaagtataataataataataataataataataataataataataaaaacagggattaaagcrgggcaaggaagagaagttggtcagtaggaagcaggtggtcctttaggcaatcctgatggatgaggggtctggctcctcattatccagaggcagtggtctggtaagtttcagctccttgattttatctgggagacctgatggttggcttcttgagaaaggaactcagataagacaattgtaactttctcaagttttaaagtctggaaggaacaatttctgtggttattcaaaaaaaaaaaaaacataagcgtcagttctgtgggacaatttgatcactttattttggagaaaaaaatgatgaayagaagtttgtttataagtttaaccccaataataggctagtctcacagtgaacacagatgaaccaagaattgctttgcttttgacataatttttacaacatcccacggcagtacatgccaaacttcaccttgtgctcagcttatgcccygcatttataaagagattgtctttcctaaccattcgagggytttgtccatttcccaaaggacctctccccagtcctttgccagtcaaatcactctttcgaagcagttgtaaatccactgtcctttctcttcttcaatcattgattcccttctctccattgcgttttcacttgtcatggatttacttatgattcctttttttcttcttgtattgctttacttgtaattagcaaataataattgtatatatttatgaggcataatgtgatggtttggtctttgtatacatagaaactttgatcaacatctcccccttcttcagccctctccctgctgccatgaatttgactcttttagattccacagatacatgaaataataaagtatgtgtctttctgggcttggcttatttcacttagcgtaattcttatactctgagtatcctcgtagaaccctacatcttttgtgagattgacagtcatactttgtgctggactggtgcatctttgggatggttttgtcactgggcgataactcatgaggtctgctgaccaggtagataccaggagtaagcaggatatttggctgcaagagagaattataggcctggtcgggagttcattcaggatgttgtaaatggaatactggggtgatgagcagtccttgtgggtcttgttcatatttgtatatattcaggcctaggaatgcagggaaaaaagggataaaacacactgaatgaaaagagtgtgaacaaatggatgaagagcctcacaccaagkaaagcttacgttgctaccaactggtaccaaactccaagtcgtcctgttcttttccaagcgccatttctrctgcttagaaaaagccacccaatctggatacatggatgtagcaaatttaaccytagacctagattacctataggatcagacttgatcagtcattaataatgataatgaaaattaatcatgaaagctrtcttgtggttgcaccttaaagcatctgtgtaatgcttttacccatactaagagtgttcaatccctgttttcacctaggattgataagtgtrtttctggatttcagaaatcggatagcttctgaagtctcagcctgttaatatggtaactaaatatgttaaggtcctagtctctcaatgtttaattactgtttaattttttatttcctaatttactcaatgtgtatgatattgttaaatttgtggctttataccctgaatctctttgtctgtatttctctgtattgcttggcagtcaatttggtcaaaagcaacaacgaaatgacccttacgaagtgtcaaatgtccctttatrtgagatataaatgtctttgcaaagacacttataaagttgtgaagacgttgtttccttactctaatagctgctgtattcacgtaggtttcaaaaatggggtgggggagggcagtggcagtgagcgcctagcggaaactatgtcaatcacccctggaaataaatctgcaaaatggactagcaagccctgactaggaagagcccggccacagcaaaatcttattgcaggcacaaaaaggtcctattgcagcagttgggagacctttggtaaattctaacaaagaattaatggcctcgaacaagacgcccggtatgacctttgccagaagaaactaggagcagacttgcttgcctggaacaggtggtgaggaggttttcagagaagatgtgtgcagtccctggcaagtagctggtgcccaggaaatgtcagttccattgtttgccagggaaggctcggtgcaygtggggctcacacacaaaggaagaggttagagagtccgcagaaaagggtgggagctcaaaacagtggttcttaggcgtttgtctgcaggcacgctggtaattcatgctgaccatgcccacaatcagtggcacctagctgtggccccacccctttcctgcccactattgaaagtgactacatggcaaagagcgcctatttcctagactaaatcattctcagacttaagttattagtgagcgytgttagactcaagttccttgatatctacatcacaactgagtagtttatctcagtggtaagtctcgaagtttgacttcgaagttactaagagccttccaataaaagaacagtttaagccaatattgtttcaccattgatagtgatgaagatattaaattcacacacatgtgctgtgtgattttaaacctttctcaaatgtgtatgatttttataagcagaaatataattttaagaaagctttatatctatgtaatagggttcttttttttttgggaaatattgccatcctgtaaattccagtcctatgttcctgagttattccccactaaggaaagcccagctgtgggacatagacctggtttccacctcagagtttaaatcattattctcagaatggtggttctcaaactttggtgaatcagagccacctggaaaacatgttaaaaatggaaaggtcccatcatatcatcaacagccctgatcattctgatacacwcccaaattggagaaccagtggcacaaacaaatgcccaaccctcgtgggctattcacaaggcaaacaaaaatcaagctatgcttgggaggcagagatccacattggaaccacacttctgctgctggaaagctgcatgactcaggcaasctcctagaccactctgagtctttgttttctcatgtgtaaaataaggtggtaatatctacctcccaggttgatgaggcaatggcagacagtaatgtatatgaatacatacatcgtacgccacctcctcagtgatcaatgaatgtgcgcttccagttgtagacacaacagcagaaagttaatgctgaaaaataggaaaacactcacaatgcatgatttacgatgtgagggagcctgctggcatggcccttgtcacgagagtaattaaataaccatttgtgtaattactaatttatatcctgtctccctgctggagtgtaagttccaaaaactggagggaatacactgctgtcttcccaacaccaagckcggtgcctggcatgaaacagacacccagcaaatgtttattccaaatgagcgagtgaacagtacgtcacattaaaaacgtgygtgtttatgtatacatcgatacataggctggaagcctctaggcaaaaatgttaatagtgcttatctctggaagtggattagggtgattttaatttttttcttttttctcctccgtattgtctgaattttctgcaattaacacagaggaccaaactagcatttccttgggtaaatgcgagtggagttggagccaccccctaccactgtgcctacaagagcatgttttcttgtgattccagcttccttgggggtttcaatatgtagtctctagaattaaaagggttttgggccaggtgtggtggctcaagcctgtaatcccagcactttgggaggccaaggcaggtggatcacaaggtcaggagtctgagaccagcctggccaacatagtgaaaccccatcactactaaacatacaaaaattagccgggcatggttgcacatgcctgtaatctcagctacttgggagcctaaggcaggagaatygcttgaacccaggaggcggaggttgcggtgagcccagattgcaccactgcactccagccttggcaacaaagggagactccgtctgaaaacaaaaagkgggggtttaggagaaataggaatttagtgatttctaaagataagtagaatttgttcttattcaccatttccttgtcctgatcatggactatgcaaaaaagagctcacacaacaggcctgagactgctgttcctagaaagacctgcctacaaggttggcctcagctggtatgtagaatcttggatgtggggagggctcccactctcttagctgataagagtgactcactgcacctaaactgcttgcgcgaacaaatgtggtttatgctgaatatctgttttccyyctgggagtcaagaattttgctaatgccatgtggagggtgtctacgtgaccagccccccaaaaaaaaccctgaatgttgagtcttcggtgagcttccctgatggagaacatttcacatatgttgtcacaacttgctcctggaattaagcacgtccggtgtgaccccactgggagcagactcctgcaagctggtacctggtttccccaggatgttgccccatgtgccttttttctgtgctgttttccctgcgtattttccctgtgataagttttaaccattgaatatgacaatrtgctgtgttctgtgggccttcctggcaaatcactgaacctgggagtggtcttcgggacccccagcacacaaacccacctaactaagccccctttgacagcatgtatcagatccaaggcaactaaagggatgggaatgtctggagcagcatagaagtgggagtttggctgggacaagagagacaggtggctcttttgagagacctgcctatgggggakggatgaatgagcactttagaattctgggtcacccagcacatgggtcaaccaatgcatgttaaagaaggtttctactctcattcattccctcatgcatgcattcaacaactgagtacctacccactcagtgtgtgcgggccactcttctagattctatgtatgaagggttaagtaagatagatgaggtcactgccccttggagctcacattctaagttgtagagctggccagggaaggaggcagacttcagagagaccatccrgagtggcttctctagggaacacagaggccttggtgttggagctgagatcctacaaagcacaagacacacatgagaaaatctaagacttatccgatgaggcaagtagaaatgtgttgagaccagaaataatttactaatttcaaggaatgaaaggaaggccagcgagtctgtaacttagggaggctgaggaaagaggtagaaaatgcaggtagaaagtcaggcaggtccagatggatcctctaggaccttagagaccatggttaagagtttggattttattctatacmccatgggaagtcattggtgggttttaagycggggattcacactctgtgatttaacactggctgctctttggagaatggactgtagcaagcagaagagaagcaaagaatcaggtgcattgcagtggtctacacaaaagacgatccctagtyrtcttaccacctrcctcctacaataaccaaagaaagtggacccacaccacagctacctcggtccactgcatgtgtggaaggtgatgattctcttgggcatgatatatattacttgttgtcatggtagggatcagaatgtctgtaaaaagcaaagttttggtccatgtgccatcagaagatgccagctgccatatgccagtcagaattgtcatgtgctagagcctcatgcagatgtccacaggatttcaccaggagctctgggatgcctgggaaggggatccagggaagggactggagatgtcaagagctcctgccctgttctcagctgttatggagtcacagaaggtcatrcctacatgaaaggcaaggcaagaagtatcccatcctcccaaccccaagaggccctgcccaggccactcactggacaactcttcttgtccacatctgctggttgtggcaccccatccctgggaaatttgctaatttcaaggaattaaagaaaggccagtgagtctgtaacttcggaaggctgaggaaagagatagaaaatgcaggtagaaagtcaggcaggtccagatggatcctctagggccctagagaccatggcagtcctttctgtttactgagactgctttctttggctctggtttcctgggacaggaagagaacagtaccctggactgtgatgggctgtgactgtctaactaatctaggattctggaattcactagccattcaattttatccatacattttgtcagaagatttgaaatatgccctttactttacactcagggccatagctacatgagctattttaagatagtgtatttccttcaattgggagttctgtctctttctggttctgcttttaataataaatacggggtccagtggactgaaattaaatagggtgtgaagaattcccctactgtttcccttctttcctacagttttacagggttgtttgtatccttcagcaggaatataaaaataccctgtatctcctctcctttcgtagtttttattttctacgtttctcatagtctttcctatcctactatatatrtgtgtgtgtgtatatatatatatatatgtgtgtgtgtgtgkatatatatgtgtgtatatatatgccatatatagagatagatccatcttccatctattactatatctataatctccctatatataaatttgatacgtatataatctgtgccatgtctagtgctctgctatattgcattgatccatttggctatwgtgcactaattgcccaatattactttatgacatttttaagtctaaactgaaaggaaagctatgctcagtcatgtaatgytggcaaccatgctgcgcaaacatgggtcccctacatcaggggtccccaacycctgggccacggacggccccaacccctrggccacaacatcagattgttattggagcacaaatcctattgtgaactgcacacacaagggatctasgcggcacactccttatgagaatctaatgcctgaactgaggaggaacagtttcatctccaagccatcccccacmtgttcatggaaaaattgtcttccacgaaaccagtccatggtgccaaagaggttggggactgctgccctacctcacagaaagcgagtgaccccaagaagcctgcagragggacttgtcaaacctttgatctctttcaccttcccaccaatacttgagcccctgagggcagargctggcagcccttggctctggaagtccttccaggtcaacagctggccctggccacttgcctggaagctttcttccctgctcygagggggccctgctgagagtgagcccsccttccagggtggcgcaggccccagtaacccccactgcgctgcctgcgactcgaattctgttaatcagtttgccttgcgtctcccaacaccgacacccagaagaggccgaggcttggcaagcactcagagcagcttctgtgaagctacattacaggctgaaatgagctcagcttttaatttgattttttttttcctgtaacaagcaaagttcacattacagataaattgcccggaaattccaatttaataaggcgtatgcatttttcaggcctagaagcattgaaaacatcttgcacgctagtatttttacactgaaaggtttattaaaaagacagctttgaaaatgtcagaaatttacatagcgcgcctggccgattggtcaaaaagcctgattggacaaaagcgcacggaagccaggaagcgggagagcaggctgttccgtggtcttgagctgttctccctccacatcgggaacgatggctccaccgttcattgtctccacccagctcttagttcatgttacatgggtgctcagcaaatgagtgtccgtctgtcctcctctgtctgcaggtgtgkttctgagtaggagcagcaagctgtccttccagggcatctgtggggcaggcatacctccttgaggtctcccatgggaggaggcaccaaacaaaataagcaaactggccaggtgcrgtggctcatgcctgtaatcccagcactttgggaggccaaagcaggtggatcgcttgaggtcaggagttcgagacyagcctggccaacwtggtgaaacccygctctactaaaaatagaaaatttagccaggcatggtggcaggtgcctataattccagatatttgggaggctgaggcaggagaattatttgaacccaggaggcagaggttgcagtgggctgagatcgctgccactgcactccagcctgggcracagarcaagactccgtctcaaaaaataaaataaaataagcaaacagaggggagcagaaagagtcctgtgaaaactcagttaaatagcacagctctggatacttgattatttttttaaggaggaaaaagagtgasacattgtcctgtaaaatcayccaaaccctggctttccctggaaatgtggcgcaggcaggcctaaccgtgctgagtattgtttctgaggactgcctccgagttcatgtctctaagcattttattgaatacaactgcttctttgacaagaaacaagcaaacatgctaattgtacaacaaaattatggcatcatgggacaaaaaaggaatgacagagggagcatcaaagagcattgcttgtacgccaaacatgaaagccaaatttatttaattcagtttttatttatcttctaaactgagttgagtaatcaggcaatagaatgcggttcatttaaaactttcattatttcaaatatgttgaaccactaccaatcactcctggatcaacaggaaacttgctacctgatgagttgccttttttcttttttctttttttttttttttttttttttytttgctttttccatccccatgattgttccaacagaaggagaaaagatgtrataaacctttaccgggcaccgtctgcgtccagrcactctactcggccctgggggtgcagagcacaccaccccagccttaggcatgaaaaacactgtgtaccgagaagcccagcccctggaatccagcatgctggtgctacattccagctctgtctcttattaactgggccgcttttgayaagttgctaagcctctctgattcttggttacctcaaccttaaaacaaggatgatacccacttcatcaggttgtcatgagtcacaaaaataaatgtagtgatgytcttaaagggtttagcaccaagctgggcccaaggaagcattctgtgtgtctrttgaccaacttttacctaycctgacaccaaggagcttagagtttagtggagatggcagagccgtcagggcccgtgttaggctcccaaaggcatttttaccagtgcatgtgcctcgcacagacctagtgaggtgattaattctactgggaaagtcacactggatgaacgagaggagacgtaygagtggggtcttgaaacagtaaaaatttgccaggtggaagcataaatgactctttaaatgaaagcctggtgtttttaaagcagttcattctcatgagtaattcatcgcttctgttttcacaaaatagtgaaaggatcattgcagcagcaagggcatgtggaagccctgcgttcgcctcatccgttctccccatctgtcccctgtcacagttgcagcatmaaaacattgttcccctaggctctgctgagtcggatgtttctgaaacattccaggggaccgtgtgagtcacatcagggaggacacacagggccatgaccccagtgagccattaacacacccatagcctgactctgcaacggctsccccgagggcgccccgcacaagaccaagccctttgtgtcagcttcagtttgccctcacagctaccccagaacaccactgggactgtccccragtcacagaggaggaagtagaaacacagagaagtagcttgccaggctcactgttagaacccaggtcctttcctctccagagtccatgactctaacactcatgtgatgctggcaatgtgaacggctggggggaagcagcagagggtgacagcaggccttggcaccagagatccagcctgcgaatcccaaccatgccccatattagccaatgatcttggcaaagttcacatawctctaggcctctcagttcctcatctgtaaaaggggaggaataatattatcaacctcccagggctggtgtgagggctgaaggcatagatgctggaagctcctggagcggtgtccagccggcgcaatgtaaggctcgatgctgctgcagctgtrttactattaatattaaagggaggctgcaccccgaggctgttttaggaaagaacaggccagacgccttccaggaagcatcagcaggagcctctcctggcgtccttctgcagtttgggggtctggtacatccactttgcaggacaaaaacttgatttgattctcaggtcagttcacatgaccccaacacaaaaaggattgataccaacccagaccgcctctgtgtgaattaaatttacaacagcgctgtatcagagcatctgtcaatgctgactggaagcccaaagacctccagatgrttggttctgagactccaggagaggctgggaacactcggaggggctctggatggtggccaggcgagggtggtaggtgaattgctgtctgtcctgggtcgccatgaggcttgtggtgactgcatagatgcccattccctttgtcagccagmaatttcttattccctggctccccttctcaacaacccaagttgaccatcccttcttcagtgaccacagcctcccccaggtaacaatcccattgcagcccccaagatgacctttaagtcatggacaagggcagttcttcttctccttggccacacaggaggcatccctctggcttccacctacatctgaataatcccacccaccacacttcgattcaacttaactctatcctcagaggccaccttttctcagaattcgtatcttcttcgaagtaagatccttcaggtgaaacatacctgctgaccacccaccctgagtcactaagttagctgggaagcagcagttttgagtgtgggttcagggtcgcagctccaaggtcagaccacctgggcccacgtcctgactctacgatttgcgtagctgttgstttgtgcctcagagtcctcatctgtaagtggggataytatacctactataataaattagtaawgccacggtaacaaagtattgcaaacatggaggctagaaatttattctcccacagttctggaggacagaagtccaaaatcagtctaactgagtcaaaaccaagacgttggcagggccacgttccatctagaggtctaggggagggtccttcctgccactccccacttctggtggctgcagcattccttggtttgtggccacatcactccaatctctgcctccacggtcgtgtggtcttctccttttctgtgtctcaaatctcctctgcctccccctgaggacacttctgattgcatttagcaaaccacaaacaaccccaagataactcaaaataatctcatctcaaagaccttaactcagctctgcaaagtctttgctctatgaagtaacattcccaagttccaggattaggaggtagatatctttttcccgtgaagactcggggttaacttgctccaagcscttcagttggagattttcaatcctgttggttaaatcaggttttaaacatccttagacccaaatctggccatacaaggcagagaaaatcaacttcatgcatctttaccagtgtaaagattcccatgtcacttcatggggatgtacttcaaagatgggtaggaaatggcagcaaagtgccaacagcatctttctggcttaggtctgcaagtggcacattatccaagccacccaattcaaagaaagctgagtcatgcccagttgagtctccctgatagataagactattatttcttactctatgcatctatattgtttaaatctcaaaagagcaacctcaaaacaagtaacattttaaaatcttggatggtttcccattatccaaagtcaaaaccccttaaaacagtagttcaggttctctataatattgtctaatctgtttctcaaaactcattaacttttagttcccttaaagaaactgtttcaaacacaaccctctactttctagtccctaaatatctgtatattcaacaaatatttagtgtcgcatatgggctaagcagtgttcaagcagctggtgtcacagcagtgaacaaatttcttgccctcgcgtaamctacatcctaatgartgtttctgttccatctgtaatagtttggctgtgtcctcacccaagtctcatcttgaattcccacawattatgggagggaccctgtgggaggtaatcgaatcataggggcgggtctttcccatgctgttctcgtgatagtgaataagtcccatgagatatgatggttttataaagggaaacccattttgcttggtttcactctctcgtctgccaccacgtaagacrtgcctttcaccttccgccatgattgcgaggcctccttagccacatggaactgtgagtctattaaaactctttcttttgtaaatcactcagtcttgagtatgtctttatcaacagtgtgaagatggactaatacaatttgttaactcatattctctcttcctggtttgtctgtcctctcactctctgatgacatcctatctattcctcctgtcttggtttggatgctgcattctctgtgaggtgcccaatattgccctggatcagaggtagtgagttcttcctccaagcattgatgtgccctgcttgtaccttcacaacagcacttctcccactagtccacatacgagatacatctgaggtgtgaaagaaacaagactggacgtggactcaggatttgggctgtgaattctgctttgcttctgtgagagcttggcagatggcaagaacatcttcctcctgggagtgtcaagaggaataaaggaggcacacatgcaaagtgcttaacacaaagcagacccagagtcagtggcctcttgactttgtgaatgagcaactgtaacagaaatgatggttttggatttttgttacctaggatccagcacctagcctaggagctcatgccctgcactctgtaaatgtttcttgaatctactttgaatgcagagtctgacattgtggggatttttttcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggtgagtacttgacaaagaccatcaagggtatacttttctgctacaaatatacttttacattttyaaatttcttctgatacacccaggggtgttcttgggaagaatgtaagtgtgtgggaacagcaaagtaaatgtttaamtatacacatgttgagttcagtaatatctccaagtcccagaatcctcagatctttttggaaagtgaataatgtctggtgagaggtcagagcaatgaactcaccctgtcccatcttgggcaggcgtggaggttagaaagccacgctgatgtgctttgtcttggtgtcatgctctcatttgcaaagaggctcttggacttaatacaagttgaaagtaagtcccagaggacatcactgaccctgaccattgaattgttcttgtagcttttatcctattatgacacgctgccaaggaaaggcatcaggtacmctcagttagtggctgcacaaccacaaagcaattgctgttcgttcaaaagatggtaatgcactatccatatgccagcccctgattagatgctgggggcgcagcagtaaacaaaaagaaagctgtcctcatggagctgaygtgcagaaaggaggcaaagttcaaagtgccacgattgttctctgctcctttgagatcagactgtagggcacaagggyagaaggagggcaacctcttaggagagtgcatggtaatctatgcaagatggtggcctggaccagagactaggaggggatgagaaaaagagagttcctatatacttygaatgcagagctgacaggatttgccgttaactgagatgaggggattccagttggtttggggacatgttaagctgcaatgtgtattgtgtcaatcacacaagaagttttgttctccctattattcctaaaagccagctgtttatggctaaagattcagttttgagtccttycatatcaagatgaatatttataggtgcccattgttatactcmacaagggtgaacyaagagttctcagtcctggtcctcgtatgccggctactcacacaaaccattaggagacaagtctaagaagtgagcaatccatgtgacacacaataagtagagaktgcttcaaaataaaggtgagccttggggttagccttgaaagacgggtaggattcggatgagtggcattacccagaaatccaaggcagaggaatcaaaactagaagggggcacagcacaggaggtaagaaaaggaaaaaataactgttgtgtctgctataagtgcrtatgtaggaatctatttggatgtatgtggaaaagtcacatcttcaaagccagatgattcatttgatagaacagggaaccaggagaccctgaaacttcttgaggaggaaactgacacgatgaaatatcaggtrgacaatgttcagcaactgaragctggaccagatcttgtgcttggtccwggagactcatggatgaataatacatggtccttgtgttcagagggctcatgarttatttggaaggttagtcaagtacacagaagatcacagtagagtgtcctaactgttctgatggagctaagcccagagaagcccctgtccagcctggggggtagtcatggagagctgcctgagagaggggacatctcacctgcrtgatgaaggatatgtggattaaaggtagggcatgctagttctggtgttgagttagttggcagcttctgattggttagccttaagtttcgtttttctttaacatagtcatttataagaaatagctcatgttggcygggcacggtggctcatgcctrtagtcccagaacgttgggaggctgaggtgggtggattacaaggccaggagtttgagaccagcctggccaatatggtgaaaccccatctctrctaaagatacaaaaatgagctgggcatggtggcacacacatgtagtcccaggtactcaggaggctgaggcaggagaatctcttgaacctaggaggcagaggttgcagtgagccgagattatgccactgcactccagccggggtgacagagtgagactccatctcaaaaaaaaagaaagaaatagctcacgttcagttttgcttatgtttgcaaatcaagcaaggttaaggtgacttatgacacctaactggctttttctgcccagtggttcttcaggcctaatttccattttaatttactttaacaattgwtatgactgaactgtgtcctctcaatgttgaygtattggagtcctaatccctggttccatagcatgtaccttatttggaagcaggcttgttgcggatgtggttagttaaggtgaggtcatgctggagtaaggtgggccctgatccaatatgattgatgtcttcmtcaaagggggaatttgaagacaggcatgcacacagggagaacaccacataaaatgaaggcagagatcagggtgatgcttctgcaagtcaaggagttccaaagattccctgtaaacttccagcagctgggggagaggctgggaggagagccttcctcacatccctcagcaggaaccaaacctgcagatgcttcagtcttggacttcaggcctccagaactgtaagacaatagatttctgtcgtgtaagccactcctttgtggcactttgttatggcaactctagcaaagtaatgcaagatttaatggagtcattacctataaagcatttggaacagtaccttgcttgtagcaagtgcttaacttaactatttaaaaaaaaaaaaaacaggtaaagcattctagtagaataaagatgtgagaagttgggaagttggtcagcattagtggaagctagcatggcaggttctttgtgtgcaaagataagggcagagaagcgtrtggataccggactgttctaaggttggaactgggtcttgtgctgaatgcccagcacctaccatggtgcctgacttagagcaggcactcacatgcctgtagaataagtcatgaaatcaatcgtgaaatgctccacatgctatgccatggactttggccttgaaaatgtcactcacttgcctccagaataaacattgtgttttacaaagatacacaggcacagtggctcatgcctgcaatgtcagcactttgggaggctgaggtgggcagatcgcttgaggtcaggagttcaagaccagcctggccaacatggcaaaaccccatctctactaaaaaaaaaatatacctcccctccacaraaaagaaagatacatcctatagcagcatagaaaatggacgcggtgatggcaagatgtsaggagggaggcattaggcagctgcygcagaaatacaggtaagagaaaagagaggaccaagccaaggtagtgaagttagttggggaaaagtcagcctgcagtgggtaaatgtgttagaaaccatagcaggtatcttagttgatggggtcagagtctgcgcaagcataacataaacggaccagaggggaaraacctagataacatctgaaaggaagaaacaaatctttgtcaagagcttatactgaacatgagctagagaaatgcaatattcaggtttctggtccagaaatcaggaatgactatttcatcaacgtaaacagggagtgagtttcagaggactggtccttcttgttttcggagggtgggtgttgagattacgtcccagaagaagctgrcaagatagaaatggaataaggagagattttgattagsgagttgcccatgcagaagagatgcgacttatcagaacagaaaagctttccaaaaggaagaggtctggacagagtactgagtacagaatcagggatgaaaataagccaagattgtttaaaattctgtgtaaaatgaaaagtatccattactgatcagctaaagtaacaatggcagggttctgtagtatgtagaagtrtctgtatctgtggagaaatttctcagcaaagaatgtcaagaagcatggatgaaatatagcgtagcatggctggcatttctttgtgaaattttttgtgcaattataaatccaaagaaactagaaatgcggtatacttgaattgttaccagaagcgagagccttctttacatgtatgcagtaatcagttaagtgacactgtgtgcgtatayaccgtgtcccgaatattaagaagaacaaaaccaaaatttgcagattaagaaacagacaccaaatttagttggctttctaaaagtcgtatcattaggatagcatttttctacctttagtttcttgcatttttaacagtctttaaaatttctgtgtggaagcagcaatctggtctaaacttccgccataccacttactagctatctgattttgaagaaataatttacaatgtagtcaggacctaatgataccttacagctgtttctcatctttgagactcattgagtctcatctatgttttctcaacattcagcrtacacctgtatgaactgtctggctgtgtaactgtgaaagcttctcacagactgtgagtctcattttctacrtatacaaaatgaagaagataattcctacttataacgttgtgagaaatgagtgaagtgctgtaccctctagattctccatcaaaagccatattaaatgttcactacatgttaatcccacccaggtgggggtttcagaaaggaaagaatagagccaggaatgatccttccatgacccaagaaatatacagcttgaaatccacttgttgtctaactctgttaacgctaatatcagacacggaaatttaaaatctggtaccacagatgtttccagagagctaaaatgtccccaaaggtgtaatggtaaatagaaaccaggttggcattaacatacaaaaccatcgttaggaataataatctcgaacaagacccaaaggacttacagcaaaaagaacataaattaaaaagcccttataaatcagagcaacttttatttaaaagctcctttttgcctcaccaaaaacttacctctagtattatgtttaacccrgaaaagccaacactatctattagatcaaagttagtaggccaagcaaggtggcttacacctgtaatcctagcactttgggaggctgaggttggcagattgcctgaacctaggagttcaaaaccatcctgggcaacatggcaaaactccatcccgaaaaagaatacaaaaattagtcatgcacagtggcacatgacttgtagtcccagctactcaggaggctgaggaaggaggatcacctgaacccaggtaggtcaaggctgcagtgagccaagatcacaccgctgcactctagcctgggcagcagaatgagaccccgtctcaaaaaaaaagtaaatagtgctaactgatctctcaactttatccaaagtgagcatttgtttttattagttttatagaaatttaatttatttgatggaaggagagaataaggatttttggcatataacactaggaaagctgaaccaaaataaattgatttctccaaacaaagagtaactcaggaatttatgccaaaacatgttgataaaatatatggcttcgggaacttccatgtaggatacagtayggaagtgtccccactgtraaactagaaaaatctagwtaaattataaaaatcagataatataaaaaaatcttaattgtaaaggaatcagggagctgcagaagcaktgacaactagataaactaaaataccaaagagggaaaagtcatttcaaaaagaaaacctttttttttctctgggtgcattttctgattctaggtgagagtcaggcttggcccatgcagagagcctargatggagggaaagaaattagaaacgagtgtcagaatcacagggagcttttgtgacaaactggaaacttgaggggctgcttttcctctgtggacaaatgccctaaaggacagagtgaaatctccttgggtctcacagaaaacagagacctaccaaaggaagcaagctctcctcaaatacatagccattctctcatttaagatatttgccagattttgaaggtacaaggagttaaaggatggggtgtgggatggctggagagttaagatggtaaccactgaagggaagaattggatttcctggagcctttcagactaagatactccagactttcaatcaaaatcccagtagggccatgcccagcaacaggagtaagccagaagttgaytcagtcttgttcaacttgcaatgcggcctgacccttttcaagcccttactaagttgatgaagcaaggctccatctgatacagtttggctctgtgtccccacccaaatctcatcttgaattgtactcccataattcccatgtgctgtgggagggacccagtgggagataattgaatcatgggggcrgtttcccccatactgttctcatggtagtgaataagtctcargagatctgatggttttatcaggggtttccacttttgcgtcttcctcattctctctttgcctgctgccatccctgtaagatgggacttgctcctccttgccttccaccatgattgtgaggtttccccagccatgtgaaactgtacattcaattaaacctctttcttttttaaattgcccagtctctggtatgtctttatcagcagcatgaaaatggactaatacatcatcctatctgaytaatacaggagagggaaaaactcatagcascatatgtcatcyggagcctctccaatcttttttttaataatgcccaatttacagttttataaaaattacttgacctgtaaagaagcaagaatgtgtaagtgatgaacaagagaaaaatcagactacagaggatccagatatttgaattagcacacaagaacattaaaataaacatgattagtatgttcaaggagacagaataaaagatagattcmagcagagagaattacacaagagatytgaaatctttaagaaggaatcagatagatattccagaactgaaatacatattatcatattaaaaactcagtaagtagacttaacagcagaacacaggatttttaacctggaatatgaatctatagcaaacaccacaagggaagcacagtgaggataaagaacgggaaaaaatctgccaaaagactagtgtgtggaattggagttacagaaggataggagagtgctaatggagcagaaaaaaaaatttgaagatgtaatgtccaggaattttccaaaactgatgaaagacattctccctattaaatcaaaaagtttagcaaaccacaagctggataaatttgaagaaaaacacacctcaracactgaaatcaaactgatgaaaaacaatatcaaagagaaaatgttaaaaatagcctgagaataaaagaggcatttacctgcaaatgagctacaatatgacttatggctgacttctagatagaaataatggaatgtggaaggcaatggaataacatttctctgagcactttaaagatgcctaccaacctagaattctttagttctcaaatttttcccttcaaaatcaaggtgaattaaagacttttggggcaaaaaaaaaaaaaatggaattgtattgcaagcaggtttatgccttttactgaagagaatatttcaggcagagggaaaatgatgccagagaggcatagaaacacaagaaacataaataaaaatagaaagttaaatatgtataaagtaaaaaagtaaatgaagtaaaattgtaaggacataaggagttaaaaatatttatagaactaaaatgcatgacagcagtaacagaaaaagtgagaggctataaacatagttaaaacagtttctgcagcattggagatgtagttaaagcaatactttgtattagactctaataagtcaagtatctatattgtataacccttagggtaatcactaaaagaatataaaagaaagtaaaactaacaaattaatagaaggaaataggtttgactaatccaaaataagaaaggagggggaacaacattaaaaagatggccaaatagaacaacaaggtgatacagtaagtatatacctaattataccayagtaaaatgcaaaatgtaaacagattaaatatttcaagtaatattatcagactatttttaaaaatcagcaaactggatgctacatacaatagacacactttaaataaaagaacaaagaatggaaataaaagaaaaatataccttkatagtacagtctctcctaaaaacacatgaaagtattttttaaaacaagcttgtccaacccacagcctgtgggccatatgtggcccagaatggctttgaatgcggcccaacacaaatttttaaactttctttaaacaacattatgaaattttttggcgctttttttwtagctcttcagctactgttagtgttagtgtattgtatgtgtggcccaagacaattcttcttccaaygtggcccagggaagccaaaagattggacacccctgtttaaaacaagaaacatgacaagaggtaaagaggccatttcataatgatgaagggaggtatcaaaaagaaggacatcacagtcctaaatctgtatgtactggacagcacagattccaaatatacagagcagagaaaactaaaaagagaagtagacaaatctacaatcattgtgggagtcttaaaacatctctcayatcagcttcaagaaaaaacaacaaggagtaaagctgtaaaagatttgaacaaaataattaacaaatttcatcaactaacatatatagaactctgaactcaacaactgagttcattcttttcaaattcccaaggaaaattacctaaattgtttgcatgcagagcatatagaaaagtctaacaaacgtttttaactgcaattatttctagtatatcctccaatcacaatggaattaaactaagcattagtagcaaaatataaccagaaacaccctaactgactgaacataaaacagtacacttccaaataactcataatcaaaaacaaaaatagaaatatgaaatgtcaaaacttgtgggatgcactaaaccagtgctcagaggaaaattctagaaaataggaaacaaatatacaagacaaaatcaacaaatccaggctgggcacggtggctcactcctgtaatcccagaattttgggaggctgaggcgggtgaatcacctgaggtcaggagwtcgagaccagcctggccaacatggcaaaaccctgtctctaccaaacgtacaaagattagctggatacagtggcatgtgcctgtaatctcagttacttgggagcctgaggcaggacaatcgcttgaacccaggaggcggaggttgcagtgaaccaagatcgcaccactgcatcccagcctgggtgacagagcgagactctgtctctaaaaaatttttaaaaattgaaaatcaacaaatccaaaagtttgtcctataaaaagattgaataaaattgtaaactcatatcraaactgttgggcaaaaaaagaaaaaarcacaaattaccaacactgggaataaaaaagggaaaatgactatagccatcaaaaagatacaaagatattatgaacggcattatgcaatatatttgacaatttggacataatggacaagtttccccaaaattaaaacttatcaaaaataacctaaaaagaggctgggcatggtagctaatgcctgtaatcccagcactttggaggccgaggcaggaagatcacttgaggccaggaatttgagaccagcctggccaacatgacaaagccccttctctgctaaaaaatacaaaaattagctgggtatggtggtgcacgcctgtaatcccagctgcactctgtcccaaaaaaaaagaaagaaaaagaaaagaagaaaatcttaactagcccagtgcttatggaaaaaaaaaaaatgttcttgaaaaccaaaaagaaaactacagatccagatggctttgctacatgtttccaaatatttaagaaagaaaaacaattttatacaaacccttccagaaacagaaatagaagaaatacttaatccctctttttatgagacaaggtttttccaaaacctgacaagatcttacaagaaattaaaattgcagaccgatctcactcatgagcataaatttttaaattcttaacaaaaatattaatgaatcccacaaaaatgatatgatcatctcaagagttgcatttgaaaaaaattcatgttgatttctgatttttttaaaataatgtttagcaaactaggaaacttttttagtctagttttaaaaaaaaaataacagaaggagctgctgctacagcaaacatcttcctcaatggtgaaatagtaaaaactttttttgtgacctsagtcccagccagagcgagaaggcaaacaaaagaaatactaggcttaggaattaaaagtaagaaatctctttattcataaatgatatgcctaaaataatctaaaagaattttcagagaatctattactgattttagtaaaggtcatcaggtataagatcagtatacamaattaattgttttatataccccagcagtaagcaaatggaaaataaaattctaaaagatactgtttgcaatatcatcagaaacaccaaatagcaaggtataaatttaaagaaagatatgcaagtcctctacaatgaaaactacaaatgactgcctaagataatttttktctccctatttaagcccacattaacggagagatataccatgttcatggattggaagkctcaatggtattgaaatgacaattcttttcaaaccgacctgagggattcaatgcaataccatgcaaagtcccaatcccagcatggggatcggggcagaaattgatacactgattataaaatttatatggaaatacaaggagtgaaaaatggccaaggcaatcttgaagaataagttgtagaacttacactaccgtacatatatccagacgtattagaaaaccatagtaattgaaaccatggtatttgcacaaagatgggaacaagctgaccaatgcaatagaatagagaattcaggaagaattccacacatacccagtttctgattctaacaaggaaaacacaacacagcagtgcaggtgagaaagcatggtctttcaataaataaggccaagttgattgaataaacatattttttaaaatgcatcctgaccccctcttaaaccatatacaataattaattctagatatattacagatcaaaatatagaaggaaaaaatgcatattttagagaaaaacatatgagaacatatatgtcctttgtgtaagcaaagcttttcgtaattaggatacaaaagtactaaccacaaaagaaaaaaaaaagatagattacattraaattaagagctttgattcttcaaatgacacagttaagaaagtaaaaagtaacctacagagtagaagatatttataatacaaagaaatgctgcaggcctggtacagtggctcatgccctataatcccagcaccttgggaagccaaggtgggcagatcacttgagccaaggagtttgagaccagtgtgagtaataaagcaagaccttatctttacaaaaaataaaaaaaattatccaagtggtgtggcacacacctgtggtcccagctacacaggaggctgaggcaggacgatcacttgagcccaggagttcaaggctgcagtgagccatgatcacaccactgcactccagcatggaggacagagtgagatcctgtctcaaaaccaataaaaaaamaaaaaaaagaaagaaatcctataatctgtaagcaaaagacacaacccaaagaagaatagataagagacttaaacaaatacttcacagcagaaaatacacaaatcctaacaaatgtatgaaaagatgctcaacttaattaaataaagatatatacattaaattatacaaatataaattaaaacacaaattaatcaaggaaatacaatgaagtgcagtacagcagcatacctataaaatggctgaaatgaaaagatgaaaaatacccagtgctggcaatggtgtgaaataattggaactctcctacacagctggtagaagtgtaaattgggtacagccacgttggaaacatagtatcaactaaagctgaacatacatatgccctatgttccaggaattacatgcctaggtattatctatccaacagaaatgtgttccccaaaacacgagtgccagaatatccactattcataagagcccaaagttggaaattatccagatgcccagcaaaagttgaataataaattgtgatacattcacaaaatggcrtctgtacaataataatgagtgaatgaactgcaactattcacaacatcatgggtgaatctcacaaacatagtgtgcagcaaaagaaggctgaaacaagaacacacatgctaaatgactgcatttatataaagctcaaasccaggcgaaattaatcctagccagcagatcaccttgtggatgggtttcttgatctggtagtactagactacatgggtgtgttcagattgtgaaaattcttcaaactgtgtgtttgatacatgaagatttctatgtttcaataagaacctaacaaaaaatgcatggctgcagagagagagcacgtagctagtcctgtaaccattcacatattctcaagtaccttctgagcatttagacagactctcagcatcttgttccaaggaagggcaatccctgtttgctgatgggccaattttgccaggaaaggtgagtgataagagttctacataaggaacaaagcaaagcaaatcatgttccctgcagtccctaccatgctttgcaacgggcagaagtgacaccatcgttaacttgctacacacagctcaacatactcagtttataacaattttaagatggtagcaaacgataactttcctttaaataccccttagaggatacaaactgtcagatcagaatggagtgatgtcaaaagagcaggactgaaaacctgatctgaggttaacagaaataaagagccctttggacctatttgcttggggccccagagctagtctagataatttctagaatcgtgcttcataataattttgataatgcctaggttgcagatgacttgaggaggaaaagacacgttgtaaccaacagaatattcaaggtactttctttaaacttaaaagaaaatccttggctarattasatttcactgagtttagttgagcaaagaacaattggtgaattgggcaacctctcaagccaaagtaagcwgagagagactccagcgcaggcatgtagtggaagaagatttatggacagaaaaaggaaaatgatgtacagaaaatggaaatgaggcacaaaagcagctggattggttacactcggcatttgccttatttgaacgctatttgaacagttggccctttgattggctcaaactccgagactggcacragagtaggtgacagtctgtttacacctccattcagattatagttcactatgtacagrgaaacctttaggcggaacttagcatatttaagaaggcagctttaggctaacttgattttacaaactgttatcagtaattttaatgcactataaccagcaaagtggctcacgcttgtaatcccagcactttgggaggctgaggcaggtgggtcacttaaggtcagtagttcgataccagccwggycaacatggtgaaaccccktctctactaaaaatacaaaaattagccaggcrtggttgtgcatgcctgtagtcccagctactcaggaggctgaggcaggagaatcgcttgaccctgggaggcagaggttgcagtgagctaacgccactgcactccagcctgggtgacagagcgagaccccacctaaaaaataaaataaaaataaaataagtaattttaatgagctgtaaattacctaagaacattgtttcaataaaacagaaatgcttttgttttgctacatcaaaactggctgtggccaaatgacttgatgagtaaagcctttaatcctatagattaataagttgtgacctttaatgctggcattttatctttagagatgaatatcgtcatttgccttatatggtccagattttctgaaaggtcaaaatagtgccttcagagtacaggcactcttttayggaagacttcaatgaacacagaattgctgccctctcttaagaaaggataaaataaaaaaaactgttaaggaaaaacccaagcggtagagagaacattcgggaatgcaataaaatggaatccctttggggatgtgctggcagtggagcaaggcagtagcaattagcactggccaaatcccagtgtcaataccactcctgcctacaggtaatcaccagaaaggtcaaatgttagtcgccctgtcttatgtgggctgaaaactgtcacaggcgatttmtcgtaagggttctggaatcccactggggacggccacagrcaggaaaggcatcgttggccgctgcttcttggctcactcactccacgctcactgctcagaattctctgagactggtcttcctgcctccttcttactggtaacctaatctttccccctcctcttgcttgaaaattgtgtagggttcattgttccatgattgttattgaatggggctcttatgctctcacagaagacctaaatgatgactgcaaacaatgaagacaaatattttgctccaggaagcccaaatgccctctcacactctgccaagtttaaagaaagacgaaaacaaaaggtgtccctgttagttccccctaaggctcagggcatatgaaatagtttgaacctggcagcccaaaccatctctacggggcccgtattaagtctttatatgattatcaaacgcgtcatattccccatctatttccatttaaaagaacgggggagtgatggcttttaaaacaagccaaattaccactaaattcagcagcatgttttcatgacttagcaacttatataaagtatgtttgagcctgccagtgaaaaatgtgatgtgggttgccaagaagacacacagatatagaaccaggcataacagctgtaaaattaaaatggaatagactaagataatgatttttcataggctaagatatatcatgtcccagcctgtcttctccttcagtcctctgtaagatagatgttccaataatgccagctgattcaaaattgaaatattgttcaaaatatgyttagattgwtttttttwaaaaatkgttattcagccccagagtgaaatgactactgaactactgaatttatagcccccaaactgagggtgggaggggctctgaactgaacttcagaaagatacctcagcctgtggtctttctcttttcatagctcaaccaagctctagactgcaggggggatatagtaagrttatttagattgattctacttaaaagatgctagtttggataaaatgaagccattagttatgatggcaacccaatcaagccagtttaacaccccttatctcagctgtgatattaattgaggaggaaaaataaattgatgacccagccatcattccgccttacttcaagcactcgcaaaatatcagtcatgttgaaaatactacctacagtttgtcactgacaaaatggcccaataaaagaactcttaagatctggtaatagtgaggtgtgatcagagccattggaggggcagcacactgggtccactgagataatggagcctagtgccatctacacctcaggatgagttcagctccgcatcttagctgtgcaatgatagcygagagacttacactctctcagcctcaatttccccacctgcagaatgaagataatgccatctgcctgctgggttgttagagggttggaaatcatgaatgcacaattcccagtactcctaagcatataagaaatgyttaagtgaactgacttgaactgagtcatggactgatcttctaagcatgtcattacagaatcatgagtgctgaggcaaactatgaaaaggcacttatgaccaccgtggtggtgatctgagcatttttctagggaatggatgggccatggacccccccacttggacaaggatgctaaatccaattagccagaaaaggtgtccttggacgttggcatcaattcatgsagcttgtctctggctgaatgggcaggtggaagcctgacagcaggacatttctacattgatcaggcaaatcaactatcttaaacagaacattttcattcattttttatgcaaaagaaactgattttgacattaaaatactgtcagtgatgcccatctcaaccagttcatcctgccaaagtgtcttttagctggtcccccactggagtcccccttccccagctttatattggcattgccatctacccagtcctcaagcaagaccccttcctctgtgaggctcccaccccctcagcctgctcagcctcctgaagtcagccctttactcttgcatcctgcctgccttccctgaagccctcgcaatggcctccatgacagtcctggcctcctcactcaagtccattcctgcctgtgcgtctgcatcctctgctttgtatcaaagccattctcctgctttaaagtctttgaacttctcacaaaatagccacaccacttcgtccccctacaacaaccttcatcctctctacaaggtattctcatttctagcacactcaaatgccatctcttcatgaagccttctgatctatccccaggcagttaattatcccaagccacaagtattttattatcacctctcttcctgtgcttgtaacaccatcccacatctgcttacatatctgttcctgccatagcattagcgtttcaagagcaggcacctgtaccattgacattagcacatttccatccaggcagagggtagagtccyagtaaatggttattgactgaatgaataaaatgaaactgtcatgtttaaacatggcctcaaaattaattatttccctttttttcttttmtctaaagtcagtggaatggaaaaaaaaccaaaaagttgaatttttgtacaacagtttagttttacattattgtctcttctaaaataatttttcagcccaaattatgtggataattgcttcagttctacatcaagtatagtatacacggaaacctggcgttatattattgcaaacttattttccaccagactttttgttggcttactattaacatttttctatatatatatacacacacacaaagagagagagagagagagagagatttctgagatgaaattggcaagatctctattagcaaagcaataaaactgatcttaagtttaaaaacaatgagattctcagcttatagagctgatttgtaaaatactggtgctgaaaaaccatattaaagagaacacaaagtataaaataaaacaaaggataaccttagaagactcctggttcacttacagctttctttttttttttctatttttatcttaaacaggaggtacacgtgcaggtttgttacctggctcactctcagttttaaagcaaaggtgaaggtacatttagagtcctgttcagatgacataagaggcctggcatgtatttgctcacagctgcttattgaaggttcaacagatgcacagctacctagagggaatttggrgccatagattgtaccgctcttgtgtccatgctcaagattgctcattagctcacatctaaattgtggctcctctcagatgggcccatcttcctgattaycctcccagaatgtgggcctcaggcttccttgggacactagycaaggtccctctctatgtccctggtatgggcaccctgttctgagtcccagctctgcagacctctgccccaccacacactgttttctccccaagggttagatwaggaaggatttgaatttagacagagccactactctcaaaatagaagcaaacttatggaaatacaaacatatatgattacatttacaggaagagccatacatatttgttttttaaatcaaattataggttggcacaaaaataattgtagtttttgccattgcaagtaatggcaaaaaaccacaattacttgtgcatcaacctaagaattcaaacatatgctgagcacttattatatgggcttcctgttttccctgttctctgtcttcctacatttcattgttcacacagacaacctcactttgcacactgtttccaaataaaaccacttgtactcataacttccaaggtaagacatatgctgcatgcctctgggcctacctctgggaagatttgggacaagtggctggaaaagtctactactttctaagacttctcagagctaacttctgaaagtttgtgwtgagatcctaacattctgtgcctatgaaaccaacccatctgatatggtttggctgtgtccccacccagaatctcttcttaattgtaatccccacatgtcaagggcaggaccaggtggaggtaactgaatcatgggggcagtttccttcatgctgttctcatggtaatgagtgagtctcacaagaactgactgttttataagcatctggcattcccctgcttgcactcactctgtgctgccaccctgtgaagaagatgcctgcttctccttgtcttctgccatgattgtaagtttcctgaggcctccccagcaactcggaacggtgagtcaattaaacccctttcccttataaattacccagtctcgggcaattctttatagcagcatgagaatggactcatataccatctcactgtggcaagaccagggatcctattcttctaatgggaccctcttgggagaggcatttggagtcttgtcttactggtctagaaattttgtaacatgtatatctagtcctttgtgttccgatgtggatagcagctgatgaggtttggctgtgtccccacccaaatctcaccttgagtggtaataatccccaagtgtcgagggtggggccatctagagtaatggaatcatgggggcagttttccccgtactgttcttatggtagcgaataagtctcaagagatctgatagttatataaacgggagttctcctgcatgagctcccttgcttgctgccatgtaagttgtgactttgcttctcattctccttctgaatgattatgtggaactgtgagtcaattaaacctctttcctttacaaattagccagtcttgggtatatctttattagcagtatgaggatagactaatacagaaacattattcgtaatagacaaaaagtggaaacaactccaatgtccatcagctggtgagtagataaacaacatggtctatccatacaatggattattattcagccataaaaaagaatgaagtattaatacacactgcaacatgtacaaccctcaaaaacattatgctaagtgaaagaatccagacccaaaaaactacctactatatgactccatttatattaaatcttcaaaataggcgaatctgtagagacagaaaattgatcagtagttgccaggggctgggagtgggcatgaagagttagtacaaattggcccaaggtttatttttgggggtgatgaaatgttctaaaagtaggtagtggtgatggtcgcacaactctgtaaatgtactaaaaattaatagtcgcaaaaataaagagtaagaaaaaagtaaagtagaattagaaaaaaatatttttaatccctgcataattctgagtttaacatgttcatggttattgtaaagaaaattaaaaatagataaatgtattattttaatgttaattacctagrgaaataatcaccacttacatttttatatatgtctttctaatttttctctaatcatatgtagatttttaaattaggatcacactatgtttttagttaygtctattaatgacaagatataaagcacttatatatatagctactgaacaacagaacctgtgaaaaaaaaatctcagtgttttttagctaagtggaaatcctgtttggtcaaggtttttcatgaaataaaatccctgaaatttaaatagacaaaaaaacacacacacaaattgtaatcgcaataggtttgttaaccaatgcacacagcaaatcaatatgccatgacaccaggttgcagcagagaaacaggtttaatcatagtgttaatggaaaggggtcatgatccagaccccaagagagggttcttggatctcatgcaagaaagaattcagggctagtccacagagtaaagtgaaagcaagtttattaggaaagtaaaggaataaaagaatggctacgacatcgagcagccccaagggctgctggttgcccatgtttatagttttttcttgatgatatgctaaacaaagggtgaattattcatgyctcccctttttagaccatataggryaactkcctgatgttgccmtggcatttgtaaactgtcatggtgctggttggagtgtagcaaygaggatgaccagaggtcactctcatcgccatcttggtcttggtgggttttagccrtcttctttattgcaacctgttttatcagcaaggtctttataacctatatcttgtgctgacctcctatctcatcctgtgacttagaatgccttaaccgtctgggaatgcagcccagtaggtctcatcctcattttacccagctcctattcaagatggagttgctctggttcaaacaccttgaccacagggtcacagaacgagaagatgggagggaacctcaaagccatttccccaaggaagttgaggcttgggtttttgagggctttggagtgggcagaagtgtggagatcaagagtacagggtgaagtcataggaaggggagaggaagcagctgtgttctcatgctgatcctgttcccctgtgggagacttccaactggtggctggaattctggggaggtgtgtctgaaaaacatcttaagtgtctataggaacaatggggatgcaaatcaattcttaaacagtcttctggccttaatgtcagagatcctatctaggggaacggtggggaagcaaatgtcaggatctagtgctactgtaactgaggaactggttagccactcactgcagcagagtccaattaacaagatccaggcctggtacaagaaaagtgaatttatttttgaagctagcttggaaagacacaaagtgtcctgctttaagtgtgctgcttcatctttggagcaaaaagcagacatgtttataaggttaaaggggaagwgagcaagggcaggaagtccccctgctagcctggtgtcttatctaccaaacagctgagttggcatacagttgagttggtgccttcctgggcagaaataagttgtaaaagtggccaagtgggcgtgttttcaccatgtcctcctgaggccaccccagaagtgggagttccgtggagatgtgctttgatctgcaaattgactgtcaattctggagaagagatcaytggggcacgtagatgaccttgccttgtagggaatgtgtggtgagggggaggtgagaggttattttgcatttcaaaaagggctaggtaggaagcaggctgaaaggggaaaggagaagagaagagaaaaaagtaattaaaccacctcagaaaaatcagggtacttggttacggtacatgacctactgcaacaaggaactgggccagggtgcagcctgattaacgctgaattataactgtatttgtacccagaacctggcatgcaattcccgtcaaccctgtggggatggtttcaaaacctgaccctgtttctcattgcatccacacccacagcgtcaaagcaatgccaggagaaccacgcgtggctcatgtttcttggaggagtcctggttcagttctacaggcttcccacacaaagcaatatactgttggccatgtaggtaagaaaagcacaggaaactgttttttaccctttctaccagtgtttagtaccaaccacaagcaccaaaatactcaaacttcgagctctgtggctctggctcttatggacggggmagtgctttacaattgccaggcattccattcactttatagaatagccagaaagctccagggatggggatgccctgccagggggccacagctcttaaacaggtgacatgcttgtgactggaaagaggtcccgatccagactccaagagagagttcttagatctcacgcaagaaagaattcagtgcgagtccattaagtgaaagcaagtatattaggaatgtaaaggaataaaagaatggctactccccgtagacagagcagccccaaaggctgctggttgcccatttttgaggttatttattgatgatatgctaaacaaggggwggattattcatgcctcccctttttagatcatagagagtaacctcctgatgttgccatggcatttgtaaactgtcatggtgctggtgggagtgcagtagtgaggaccacgagaggtcacccttgtcaccatgtwgattttggtgggttttggccagcttctgtactgcaacctgttttatcagaaaggtctttatgtcctgtatcttatgctgacctcctatctcatcctgtgacttagaatgccttaaccacctgggaaggcagcccagtagatctctgcctcattttacccagcacctattcaagatggagttgctctgatttcaatgcctctgacacactaatgttagagcaccttggacatkttccttaatctgagtgtctagttttcttttctagaaaatgagaaaaaactagaatgtagacccccatgtgctcaaagcaacarcctgcctggtttgcttggacttttcctagactgtatgataacaggtgctcgattcctctaygtaaatcttcaccttttattaatcatattaccctgcttctcttagaaaacgcacagttctgccctccctacaccaagatcacaaaaggctaagtgtaagtcatgagccaaccagaccaagagtaacccaggcaggccaggtggccaacttggccatctcataggcagttatcactgctcaacttgaagaaatacaaggttaattattggagtttgaaatccagcagtggaatccatgtggtcctatcgtggtcatrtaatgtgctgaggctcttacaagttgtcagtgctgagtgggaacgacaaagccagaaacaagggcaagcagaggttgaatgccaggaagaccgtggcagggtgccaagtccatgaagcaaaagcaccgccatggtctaaaaggcatagtcctctagagcaacagagccagtaactcagatccaaaggaaagaaaatgataaccctttccccctcaagacttgccattgtatggcagcaggagggctgcttgcaaaataaataacccaccaacatttgtaggttggagatctctcagtcaagagtgacaggctgtcactgaaaatgggtcggaaggaaaactgtcattcctactaagcaattttaaataggctttgtttccagatatctgtgcctacaagtcctcatttcctcatttggaaatgggatttgatatggttgtattaggaggtaaaattaaaaatatctccttacatcccattcacactgctgcatgatggaattgccaaccttgtaaccaaaacacatgtctttctaataagaagtcaatgacacaagagaaaagagattcctgcagctaaggtttgctcctggtattttccccatgatatcacccaacacaatgtacactctgtgggtggagaaggatggggggtgactttttagcttgtatacttatttgagaaccttaaatgagatgcctattaaactatccatgtatacaaatagactcaatattaagaaaagaagtagtataagactgaaagacatgcttaagagaaaggagggagccatacttcaggaatggagaaatgaagaaaaatctatactggctaaagtcaggttagctaggagggaacatatgaggaargcccaagtcttatgctgctagaagccagggcagaggcagtaggctggaaaggaccagtggtcrtcttggaaatatgtgctccacttgaagccatttggataaaaaataagaattcttagaacactggacatcccagaaacacgataaattagcagaccaaatgccagtctgcaactgctggttaaaaagaaaaatccaattacttataacactgaatataggtcagcagaaactcccggcatcaaagaaactctgaccataaagacttagtgtatatttttacaaaacacttcacagggccttgtggatcaatcatggattcaattttgttctacaaattaaaatcaagccatgtttaaagcaatctcattaagtcgcttgccaacgggtgcacacagtaccacactcctggtgtgacatgaccattcttatcattcatttttggaaccctcctttcatggatacaccacccctcacctcacttccctgcttctgccttacctgtgctttccctgtggcttacctggattatcacaaccagatcccctgcagttttcagccttgccaacatctgaacatgtcaaagaaaaatgggcaggacagagtttgaaaggcaaagcctttattcaagsctacaataagggagagagattgaactaactctgctgaaacaaacaatgggacgatttttaagagctgggatgagctaatggaaaagtactggaagatgtttgtggggaggttggtccatgtgattaggcatctgtgtttgctaatgggtgtttactggagttaggctccaacccttccacagagactgagagacagagacactattcctttccatgattacatttcaaagagatgtcaggtccttgagaaaagtggtcctgggttgcaaaactagcaacaggttggaagatttacatctcacagggacagagaaagaatttacaattgcamgtttctaaagtaaatgcttcaagaaaagagaagtcaaggcctatattagtccattctcatactactgtatagctactactcgatactgggtaatttataaaggaaagaggtttaattggctcatagttccacatggctggggaggcctcaggaaacttacaatcatggtggaaggcaaatgggaagcaaggaccttcttcacatggtgtcaggagagagaagtgctagcaggttaaatgccagacacttataaaaccatccgatctcatgagaactcactcactatcaagagaacagcatgggggaaaccacccccatgatccaatcatctccctccctcaatatgtggggattacaattggagatgagatttgggtggagacacaaagccaaaccatatcagggctctagagtctgaaagaagcccatctaaagtgtagtccagcacaggggaaggttatggccctcttggtcaagcctatctatccttaggaggtaaggaagttcttctagccttgcctcaaacccagggtgagcattagtatatggtgattctcctggtggctgagccacaggctccaacactgttccccagtcatgaggctctaaaccactaccccacagaggcccatttctataataaggtcctgctcccaagcttcctcctttctctccatccttatccctcccccttccctgcctggcatggtcttgtagctggaagaygaggcctcagctctggggtctcatttctgcttcacaaacctccatcagcacagactgtccccatgtggagcccagccccctgctgttatctctgaaaaagatctactcaactctataatcattttcggctactgagctattcgtcctacagaaatagtaaatgctattttactgtgcatggccggtgataccagcaagcctaggacattggtcccagcgcctatcctgcctattgtcctactacagggacaactatgactatgctagctggaaatgatgattccttgggtacccagcctgactatgacacaggctgtcatagtcatttccagcaagcaaaataggaacaggaagctaagaatctcaaatacatttagaatgacctagtcaaatgccatttctttttttttttctttgagacagagtcttgctctgctgcccaggctggagtgcagtggtgcagtctcagctcactgcaacctctgcctcttgggttcaagcgattctcctgcctcagcctccagagtagctgggattacaggcacgtgccatcatgcccagctaattttttgtatttttagtagagacagggtttcgccatgttggccaggccagtgtcaaactcctgacctcaagtgatctgcccacttcagcctcccagagtgctaggattatagacctgagccaccacacccggcctaccatttatttgtgaaaaaaaaataaaaaattccacttacatgggttccccagagtcgtcagattcatagagacaaggagtggaatggtggctgccaggggccaggggaaggggaatggggacttggtgtttaatgggtcagagtttcagttttgcatggtgagaaagttctggagatgaatggtggtgatgttcccacaacaatttgaatgtacttaacaccactgaactgtacacttcaaagtggttaaaaattgtcaattttatgttatgtatatttcaccacaatgaaaagaacagctcataagaaggaagctgtaaatagtaataataataacctggaattatggtttagggattatagcttgctttcatggttaaaatgagagcctgtaagactcaagctatgtaataaaaattctggtggagaaagtataggttaatgcttgctctagagaaggaggcctgacactcacrgtgtccatttgagcctgtcctaaatctctctggacctcagcctcaccatacctacaatgaattggcctcagatcttctgctctgatcttgcaccaagcctgggcttgcaatctgcgtgtctgtggactcttcaggtatatttctgaatgcaggtgcgtttctctggaggcaggggccatgaccttcagcagattcccaattggaaactcacctcccaaccacgttgaagacctgaaagctggaatggttcatctgtcagcagtccttacagctcctaacattataaagacagaagcccctacaaactcagccagacccccacatgtttagaagttagacttctctgatccttaaaatggctaccatgagaacatggcccctgggctccctccagaagggagctgcaaagagggagtcmcattctagctccatttctgggtgttttgctcaaattgacctgttttccctattgaaagagaaaattccggccaggagtggtggcttatgagccaagatcgtgccacactgcactgcagcctgggagacagagcgagacgctctgtctcaaaaataaaaaaaaagaaaaaagaaagaagkaaaagaaaagaaagagaaaattcataaaggagggaccccgtcttcactgtgccttggttttgattcttggttatgagtggttccatggtggtggaggctgctgatggaaagaggaacagaggggtgagggatttttgctgaaaatctagagaatacttagaagcccctatatttcctgggccccagaaatgattggagccaaatgggcttgtgaggaattttgaaattttgaatttcacctgaattttggatgtgatttttctctatcccgtgcatagaaactgagagaggctctttccctcaggattttgtgaatcttgtctttaactcatcgcccaaagtaacaaactcatcttactaacttcagaaaaagacatcaccagcctggcctgggaataacacataggaaattgaagacagtagtatacttaagttcacaaaaggccaattcttayggccrtatttcaaatgctcataacgccttctcatccattctaccaaatgacttgtcttcataatatattcagagtgaaaaaacataatggattcttccgagatattcarttagttcaataaaaagagaaaaataatttttcartaaagaaatttaactaaatgactaaaactgacagtgaaaaaccaacttcaaagtaattatgcatttcttttgagtttgcgctctaacgaaagttgatgatatgccaccattagaaatagccatccttcaaatgatcaattgcatttgtgttgctattttagcagacatttatttgaatgtttactctgtagctgtctttgggtgttgatatatttaaatttccaccagccccgctaaagagtatcggctcgcacttcttcatgactcactgctcagcttcctttaagctggttttttccccgttaacagaaacctcttccmaaagtgtcaccagtaacattctccttacaaaatccggttacttctcttcacttcttatcctcgtaggggtcatgacacatttaattatgggtcattgactcctcttccaattctctcctgcaaaactagcatctgctctttaaactttggggtctctcaggattccgtattccacccctctggcattctgaactttcaccctgggtaaccactttgttagagaagtttcaaagccatctatgtgttgatgacttcccaacccctaactcagcctgggcacttcygccaagctgcacaggtgcattgaattcaaggggtcgttagcacaatcaagactgaaccgctggtcttcccacttcccactgcactctgctcttcgggcagcctcatctgagtgcttgatcaccaagaaaagacastgctttcctgctcgagctgcacacatcatgcctctcttcatccatggctggtccgcctgcctgcagggtctcacatttcctatcaatccaatcgtgtgctttctgaagataagtcagatcagattgttcctggatcactgcctttccggaaagcctctggtggcctcgtgcactctgtagaattggtacaggycccttgtgatgctwctcaaggccctccaggagcccatgccatcctcagtgccctcagctctggaggagcagctccaccacggcaccccatgactttgcatgtagagccacatggggagggtatgacctgcagctgcgctgagtcttggcagaacaccctgcggtcccccagccagtttctcattgccttccgggttctgtgaggtgcgggggctttctgcctgcccctctcaggacacagctgctgctgtaaaactgctgagaagcagcttggagttggctctactgcaacatcccttctttctgttgcagttgtccaktcccttttattctgccatgwcctgcgccaaggccatcatgcccacgcctgcttctactgtctaagtaataagctgtctgcatctaaagaggtctccttgcttctttgctaggacttgcctgcgtcctgtatgccaacttcaaatactcactacccttctaacccccgtgtaacctgatagcctaactgcaaacttaatatgcgtttcaaaacataaatatagtacaagagaaaataaaattatacttggaaatctggctaagtgaaaataaggattagaaaaataaaagaaagccataggttagattagtactgtatagtattagtttattaaactgataagaacagatctgtacttcatcttagccaagaggccaagaaacgattgtactactgtataaaattatggtgctgtaattttagaggtgcttcaaattrttttgggaataaggcaaatctgtatacttaaaatgtgtgacctatgaatttggctctaacctttcttgcagaaaattagaaactactaacaaatggtttgtcccaagagcaaacctctaatgcacaaatgattaaagatgaactcagagaaaaatgaaggcaagctgagttttattaacattgtttaatgtttaagtgaaatacattattagggctgggcacaatggctcatgcctgtaatcccaacacattgggaggccgaggcaggtggatcacttgaagtcaggcgtttgagaccagactgaccaacgtggtgaaatcccatctctactaaaaatacaaaaattagctggacattgtgktgcacacctgtaatcccagctacttgggtggctgaggcatgagaatcmcttgaaccsaggaggcagaggttgcagtaagccgagaccacaccactgcactccagcctgggtgacagagtgagactcaccaaaaaaaaaaagaaagaaagacattattagattggtgattatgagggccattatcttaaaatagtatttcctaaaatgaaaaacatttcaggaagtagctgaaatatcaggaaaaaaacaaggctttaaaaataaggyccaaagattatatgatgattgcttctatgcccctgtagccagctagtgatctcatttctcatcactaacccagcttyctaaatctgtcctgtccagcagggtcagccatcccagcccccagtggcaccatcagccatctgagactctttttcacccccagaagaaaatgtcttggatttaatctttccctctttagtcaactcctcagttagagtagagctacagcagtgaaaccatggccatctctcacggagactccgtcctccccctgccaccaacatgtgtgaatacctggctacttatgtaaaagatttaatttgataagtgaggaaaagtcatatttatctccattctttgaatagatttcagtgtgtgagaatgactttttagtgtgtgtcagaagcttagtattctaagggtaaagtattaagcctaaagaacttcaatcagaagtcttaaggccggatgcggtggctcatgcctgtattcccagcactttgggaggcctaggcaggcggatcacgaggtcaggagtttgagaccagcctggccaacatagcgaaaccccatctgtactaaaactacaaaaaaattagccgggcatgatggcaggwgcctgtagtcccagctactcgggaggctgaggcaggggaatcgcttgaacccgggaggyggaggttgcagtgagtcgagattgcgccattgcactccagcccgggcgacagcgcgagactccatctmaaaaaaaaaaaaaaaaaaaaaaaaaaaaaaaagtcttatatatgataaagggctttgtaaaccactaaactttataccaaaaaaatctattattgttagtcttgtttgcaactattaataacaactgagaaatgggctgggcatggtggctcacgcctgtgatcacaacacttttggtgtctgaggcaggatgattgcttgacgccaggagtttgaaatcagcctgggtaacrtagtgagacaccgtctctacaaaaaatacaaaaattatcctcttagatgyaaatgctaaaaaaataaagttagccaggtgtggtggcgtgcacctgtggtcccagctacttgggatactgaggtggtaggattgcttgagcccaggaggttgtggctgcagtgagccatgatcgcaccactgcattccagtctgggcgatagagtgagaccctgtctcaaaaaataaaataactgcaaaatatactaagtttacaatgcaaaaagtgctatggtaaattgctctcgcatataccagttgcataccaacatcttccctttttcccacaggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacagtaagtctggctaaagcatttctgcctatkcttccagstttcagtttattttctctttcccaaaatgctgtttctctactgttctctcaagtattctcatttggttcattttaagttattggcatattataaatactgagaattttcccaccaacaaacaaatgcaatttataaaaatattgaatatctgtttcaaacacagacattttctcttctgcttcctctctgatattttctatactgtacaccctgtgttgtatatcctaaccwgtctgctacatacactatttagtataactccaatattctatctttaaaattttcatatatttagggggcacaactgcaggtttttacatacatacattgcatagtggtgaaatctaggcttttactatccccatcacccaatagtgaactttctcttaactaatctgtagtttctgccatcccagagttcccagccacaagactgtgattctttgttcttcctctttctcttccttttttcttttaattaaactccacagattctttgtttgtaactagcttacaaagaatattggccaacctgcccagtctcagaccttsaaaagataggagtctctgcttctccccagctatctcttggctcagctgtctttccagtctcagagacagagaactgtgttaacattaactttcaccagcgcattggagagrcttttcgtggtgtacctgctgtcataaaasactaaaggaaagagaagtgctaggataagaatctttatagtcttcaacctccaaccttccatagtaygctgcagacctcctcagacttgacttggtttaatgatgaccttgggttttttttcaaatccttggccaccattgactttgatgtcttcttccatgcatcttctttctcctttataaaacttscaagcaatgtctcctcccacaagtccttccacataggcaggtggaattcaaaacttaacccaacttctatcacttgccttattaagactgaaacaccaacatattaatatggagtatccctatatccacaatctcacccactttcttccccaaatgtaaactaactaccaagttcaccttgtcttccaataaagtaaaagaaaaaagaaaaagaaagacattagacactatgtcttcaataatatacttatcctgctgttgaccccgtcagggttcccacttcttatgtcagtggtagaacttttgagggagacagagaattacscatttcattaggttttgcaaatgtattgtacaattgtgcataacattttstatttaaaaatctcatatctattgttatagccctatctcatatctcatttttttagtgccttttgcttgttattgattctatttgcctgtttgtctattttattgctttttaaataatgaattctgttatactgattatttttaattaaaacagaccttctcttgtttgaggggttagtgttttatttgctagtttttatggctatagcctatttgaataatcatctccagttctttccaattggaactttctcattcaagagtttcttttttgggggcrtgcagaggggggtgagcatcaggataaatagccagtgcatgtggggcttaatacctaggtgatgggatgatttgtgcagcaaatcaccatggcacatgtttacstatgtaacaaacctgcacatcctgctcatgtaccccggaacttcaattaaaaaaawaaagaagaaaaaaaaaaagattgtatcctctactmaaggaagatrggaaaatgctgtttgatttaatctgccatctcactaggtgagcatcacattagtcattgctgctcctgtcaccttctggtaatgatcatgcttcatstatttttatttccctgtcattactctcttgttttttctcctggttttacctaatagataaatgccttctaaatgattttgttgtctcacagtttttttttctgaatatttagccctgtttattcccagaaaggggcacttaaaaatacatatgaccctaatcatgtgagtgactttatctcaaggctaaagaataggccagctggtgcagccactgccaagtgtcacccaggggcctgggtgatggtggctattgccaccgcacatgacatcagggaagtggaggggaagcttaaagatccagtctctatgttgcgggttcccacccaaatgtagagctgtggacagaggattgatcaaaaaaaacaaaaacaaggctggactcagtggctcacacctgtaatcccagcattttgggaggccgaggcakgcagatcacctgaggtcaggagtttgagaccagcatggccaatatggtgaaaccccatcagtactaaatatacaaaaattagctgggcatggtagtgtgygcctgtaatcccagctactcgggaggctaaggcaggagaatcrtttgaacccaggatgcggaggttgcaatgagccaagattgcaccactgcactccaggctgggcaacagagtgagaccctgtctcgaaaaaaaaaaaaaaaaaactaaagacaaaaaatgtaggctatagaacccatctccatgataacacattagggtcctgcccacattgagagcaggtggattttcaccttagctttctagatgtggaacgcagtctttgtcaagatggctttttcgtgtaataaatttgcagggaggagttcttggtaatcaatcatcttcatgaaaggagctctccttgaaacygattataatcgcgccgaggcacagaactctggtgatggaaacactctgtctctgtgytgttcattacaggagccagcagccatgtgtggcttctgggcacttggaatgtggcaggtgccactgaggatctgaactggtattttcacttgatgttaatgaatttaaatgtaagcattcgcacaattataaatgaaaatgcaatgcctgtttggtgtgactttcatcaccaaaacctcactcttttattggaaaaagtctcatccrctctcaccagaaccctccttgcctttacagatacacacgccckggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcrggggccctgcgcttcagcctgccctcagtcctgctcctcagcctcttcagcttagcttgtaagttgacctaactccagtgcatgcacaaacaggaaattgtaacttcactgggttcgtgaagccagcattttcccatatacctttccaagaagatgtttcccagaagaatcattcatctttagtgtatgtctgtatgatagaacatgttatatgtaaaagtgctcccactgatgtttaaaggcatcttaacaatccctgccagccagtctgagggattgtgcaaaggtgttcattgctagcctgcaaactaggtggtaagcaaaacttcctacagctgccactcaacttgagctaatgaaaatgcgcccagattagttaactagtctatcagaggcctgtttctctctacattatgcagaataatcttttgcaaggttaaaacagatattatgagactttctgagaatagtcgtgrgaatttatggatggagggtgggcygcagggaaaatgataaatgcataatttacactgttttttcactggctagtaataatgactataatatcatgaaacattgtttttaacaaatgaattattatgccaagtagtatagatgtgaggataaaattaataaatacatgtctcagatattccttatttatgaaatactagtccaatgttaactttagccgttattcatatataactgttaccatccaaaagccttttgggccttgcaatttaccttttgagaacgtatcggtgtaattgtgaattaggaagttgggaaattgacagaaaaagaaaacagaaggttttttatcctactgacagtggtgagctgccaggaaatcacatagtacaacattgsacattcacgtatataaagctctgtgcaagaccagagtcctgtgagtagaaggaaaaatgaagggccaggcacggtggctcacacctataatcccaccactttgggaggtcgaggtgggtggatcatctgagatcaggagttcaagaccagtctggccaacatggtgaaaccttgtgtctactaaaaatacaaaaattagccagccatggtggcacatgcctgtagtcccagctactcgggaggctgaggcagcagaatcacttgaacccgggaggcggaggttgcagtgagccaagatcatgccattgatctccaacctgggygacagagcaaggctctgtctcaaaaaaaaaaaaaaaaaggaaacaagaagccattatagcatttcactggcccttcagactgggcatttctgaaagcgaacatatcatcttcccctcctgacctgcccctctgcctgacttgtctctgatgactgtaccaccaccatcatcatcaccatcatctccatgtctccttcctggtcttcccactgcaaagcccaacagagtctaagggtccaacactttccatccatccctgcctccaccctcctgtctcaggtactaatgtcacttaacctcgattatctcactggctttctaactttatcttctgcaaagagagagagaaaatagaaatcaagaggccacccctcggaggcttctcctgagtcttttctgtaaagcagagacaatttcagatgaagggttagagatgggagtggggactgagaagaaattaggaaaccttgtcaaagcacagataattcggctgtacagcaattgggctaaacgttgagcaggggtggtccagaggagtttgtatactgtcttagtccattcgggctactataacaaaataccataaactgggtggcttataaataacagagatgtattgctcatggttctggaggctgagaagtccaagaataagatgctggcagattcattgtctagtgaaagcccacattctggttcacatatggcgccttctccctgcattttcacatgatgggagaggcaaggcagctctctggggcatctcatcccatcccatccatgaggacactgacttcctgacccactaatttcccaaaggcccaccctcgtagtaccatcaccttggggatcaggtttcagcatataaactttggaggggcacaaacttcagagcatagcagataccatgaatttatagcaacacattatgcttgtttgcccccttgctttgctgacagatatyctagacctagatttctagagtgtaggaatgttcccttcgtgagggtatgctgtctggggcctggtttgctgagtcatcactagcaacctgcaagtcactcttgcatagtatcagctggggagatggtggtggatctcaagtctggctgcacaacagaagcacctggggaacttttaaaagtagctacccatacctgagccctaccctatggctggaagggcagcttagacatttgtccattttaaagcctcaccaggtggtccgaagacactgggaaatcaggaccgtcctggtgagtgactccaacgtttaggtacaggctcctggacattctaacagtgtcctccaatcttgtccccaccctaaagacgtgctggttccttcggttcacaactcaataggaaacaggtggaggagagtaaagttaagaatacaagtgtgaagatgtttgctaccgatggtgccagaaaacctggcaccatccctcctccagagaggagggtacggtgagatgacagaacacatccagtatgagaatttctatagcaccaactttccagaaagtgtttcagaagcttasagaattaaaatgtgaaccagacaggaagttaaacttgacaaggaagagaaaccaactaggaagagwtggggatggagttaactgacactaaatttggcctgagcttctcrttggcttgccgtacacaattgccactgtgygataagagcaacgtgttaattgcagtggtagttcctaaatgctgctgcacgtcagaaccacttaggaaacattttcaaactacgaattcctgagctcagtgccctagaaactttcatttgtgctctrgattacgacttgagsttgaggaatagggcgttggggaatggtaatgaatggacgcatggacagacagatggataaatgaaaggaaacatatttctccctcttttcttttgttctttttttcttcyttcctttgtctttcttttctttttttcctttatttgtttacttatttatttatttttttgagacagagtctcactctgtcgcccaggctgaagtacagtggcgtcatctcagcttactgcaacctccgtctcccgggttcaartgattctcctgcctcagcctcccaggtagctaggattacaggcatgcaccaccatgcccggctaatttttstatttttagtagagacgaggtttcaccatgttgtccaggctggtctcaaacccctgacctcaggtaatctgcctgcctcggcctcccaaagtgctaggattacaggtgtgagccaccacacccagcyccttcctttctctttcttcagaaagtaaaatattacaggcaaaggtaaaattgcctatgtttctctgcccaattttattttctgttctctctcctcagaaacaatagctaccatgaattagctattcatgtgtgtgtccagatgttttatccttttactacacacaaactgacacatacactcactcacacacattcacacatgacacatacagttctattttgtgcagtttgtaaaacctcctgtaattcatattatattgggcataccattctgcgacttacttttcttcctacctgtgttacattcacaaggtccatccacgttgctctaattcagcgttcagcaaactttttctgtaaagggccaggtggctttgtgggccatattagtctctgtcacatattcatctttattgtttgtttgtttgtttgtttctgtcttttgtaccaccctttaaaaacgtgaaaacccttctttgcctgggagctatccaaacacggacttgaggttagagtcagcccacagcgttccttggctgaaccccgctctgctccatttactcctyctgctggaggatcctgtcatttgaatacggtgcagtggattcccttatcagcagacacattcgaatcatttactatgaccaacgctactacagtaagagatctacgttttccaccagcttctggagtgagcgccagacagaccacaagcccagcactgcccaaagaccagcacttagaagccactgctctacaagcaatgcttgcagctaggtgcggtggctcacccctgtaatcccagcactttgggaggccaaggcaggcagatcacttgaggtcaggagttcaagaccagcctggccaacatggccaaaccccgtctccactaaaaatacaaaaattagccaggcgtggtggcaagyacctataatcccagctactckggaggctgaggcaggagaatcgcttgaacctgccaggcagaggttgcagtgagccgagatcrcaccactgcactccagcctaarcgacagagcaaaaaacaacacctgcagagatccaggagcaactggaactcaagaataacagagtttggataaatcggagagcagtacttcctatgtgattgcaaagagataaaaattctatgtgtgtgtagtgggaatgmatayacacacgtacatgtatgtttgtgtgcacgcacgtgtgtgtacccagaaagtagacaattaagggggttacatcacacattgccctctgtaaatccaatttctgaacatcaaagcctcactccgtgacatctctttgaagaacraaggcactgcaggaccctgctcacggttcagctactcgggactggaaatgagtgttttaaatggagaccagagccgctgtgcacctgcttgttaaaatacagatttccaggcccatccaacctatggcatcaacatcccaggtgacaggggcctctagctcaaagcccagtgtttggttatttttatacaatatttttataataatacacattctgctaccaacactccccatatattaagtattagtaaacattgaatttttttttttagattaaaaaaaaaagacttggcagtatttttttcttaccaacaagggattttcttgtggtcctcactttgagactcctgatctacagatgacaatcatcagcaggttgccaaggatttcccacttctcatctctcaactgagctcttgggtcaagttaatctaaggcagaattgcctgataatccctaaagaattgcttcacagttggtatcattgataaaasacaggcacaggtacactagctgtgaaataccaaatgtgctttatgtgctcgtctaaggggagccatcccatctagcatctgatgattgtatctcactgtaagtaggggcacctgtgtgtaaagtcgaaattattcccacagtgaaactctggatctccttgtgtagctggaaagtattcagttgacactccaatggtttgctgtacaaagacagtagtttcagcccccaaaaaacagttaaaarcaggtgttaccacttaccttcaaaaacacacttggtctggtcatgtgtaaaaggyataagattttctaatattgttcatttaaatgttagagatgcctgccaaatgtcatgatttacgtttyattatatacctagtccaagacattcttcctaaccaaaaagggatggacataataagacatgtaagaatctgggtcagaggtagcaggaacaggtaacyaccagtgcccaaccactcaaatgcataaaagcagacatcaaagtggccgacccacgtgtgctaccatttatatgacattgagaagaggctgcacagaagtgagcttaaacccttaagcaaggattggagaaggaggagggtgatttcaaaaaacactgaaattagtagctttctttttttttktttktctgttttgttttaagactgagtcttgctctgtcacccaggctggagtgcaagggcgcgattttggctcactgcaacttctgcctcccaggttcaagtgattctcctgcctcagcytctgaagtagctgggattacaggcacctgccaccacgcccagctaatttttttgtatttttagtagagacagggtttcgccatgttggccaggctggtctgaaactcctgacctyaagtgatccacccacctcagcctcccgaagtgctgggattacaggcgtgagccaccacgccaggcctgaaattagctattaaagtacataacttcctaactcagccatagtccttacaagaattttgggagcaaggaaatcagctggtagaatctctttgatgtttctttaaagcagggtcagcaaastctaagacacagaccaaatctggyctactgcccatttttgtaaataaagttttattggaacacagccgcgcctatcatttccatatcgcctgtgcccgttctctgctgcagtggcagagctcagtagctgccaccgagaccagctggcccaagaagccgaaaatattaactctctggcccttcccacttcaaagcatcattcataaaacttcagtgtgatgtaggagaagataatcacgtcacattcatggcaagaaaaaatactcagatccaagtagactggcagcaaccaaacatgctgatgtgtggggctgttttctgtattttcttcagtggtctggcagttgtcccattttctagatgagaaaactgatcctcagaaaggtctccaggtgagtaatcagcgaggccagcattcaccattgactgcctcccttacagaaaaggataataacaacatttcagtttagtatgacctgatcctgtaggtggctttactgcaactgagagttgaactgaaggatctgcatttctttctttgacatctgaaaataaaggaaataaaactactgatattgaaagtaataaaaaatgaawatgaaatgatttttactgtcagttttttttgttttgttttgttttgttttttcacagagtcttgctgtgtcacccaggctggagtgcagtggcatggtctctgctcaccgcaagctccacctcccggattcacgccattctcctgcctcagcctcccgagtggctgagactacaagcgcccgccaccatgcctggctaatkttgtttttgtatttttagtagacatggggtttcaccgtgttagcctggatggtctcgatctcccgacctcgtgatccgcccgcctcggcctcccaaagtgctgggattacaggcgtgagccaccatgcctggcccggttgttgtagtataaagtgcatgtcagtggcatgaagtggatgtgtaattcttcccctagcaccctcccagtgaggcaagccggcattgccattaagctgtttctgtggtttttctagcacgacttttatggtatggcaagtctcaaaaaaagaacttgtcgggaaaccatttctgaccattgctttcwgcttaattaaccagtattagcaagaatgtaaaaggacagatcaggtgaactatcttaacaaataccaaaagtaaatgtctctatatggagggtaagatgtagacaaactcagacacaataaagaaatttaaagaggkgagtgggcagggcacagtggctcatgcctgtaatcccagcactttgggagactgaggtgggtggattggataaggctgggagtttgagaccagcctaggcaagatagtgagacccccatctctgaaaaaaagaaaaaaaagccccaccccatgtcagctaaaaattaacattaaataaaatgtggaccaggcacggtggctcacgtctgtaatcccaacastttcggaagcctaggtgggccgatcacctgaggtcaggatttcgagactagcctgaccaacatggtgaaactcatctctactaaagctataaaaattacctgggcacggtggcacacacctgtaatcccagctactcaggaggctgaggcaggagaatcgagtgagcttgggaggcagagggtgcaataagctgagatcatgccactgtactccagcctgtaggacagagtgagaatccatctcaaaaaaataaaaataaaaataaaatatgcatgcctggctgggtggggtggctcatacctgtaatcccagcactttgggaggccgaggtgggcggatcacaaggtcaggagttcaagatcagcctgaccaacgtggtgaaaccccatctctactwaaaatacaaaaattagctgggtgtggtggcacacgcctstaatcccagctactcaggaggctgaggcagragaatmgcttgaacccaggagttggaggttgcagtgagccaagaytgcrccattgcactccagcctgggcaacagagcaagactttgtctccaaaaaaaaaaaaaaaaaaaagccaagatgagcaaaagatagccagtaaacacttttaaaattttatttttcaacgtattgtttgcataaaacaaaatgcatccgttgcaagtgtacagtttgatgcattttggtaagtgtacagaattttataccacgccctagtcaaaatacagtttcctttgctattgatcccctttccgcaatccaggctctcattgatctgctttctctaataatggytttgtcttttctagaatgtcttaaagygtaccagtattttgttcctttctattgcgaaacgtattatggacagacacggcctgcaaaggcattaaacccaggtagagtgggctgtcttcggcctgcagacggccgcggtcatgctttgcagaggagctgtggccccttaaagtgacatgacattatggacaatgacagttgatccttgggggctttccatgcaccttgcgcatgcaagctaagggctttacataaattaaataaatttcctcaagtaaccatctcaatagccctgggacgagtcacttatgttatcatctaaattgacttaaaacaggaatttgagactstaatttgaaaacaagagattggagcctatttagtggattttatgcagccaaagatgtttcttgttgttgttgttgttcttgcttttaactaatttgcctcccaggagacagttgaaatgtctagagacattttgattattatgcctggcaggacgccactagtggcatctagtggatggagggtaagggtgctgctaagcgtcctcccatacacaggacagcaccccccacaaagaattatccaaccccaaatgtcagtagtgctgaggctgagaaaccccactctgctctctaaccaaaattagacacagaaagtggagacattctaccaccctgacaacatcaatggcttttgcccatttaaaacaagaaagaggaatatgtatccaacccaaaacaacatcttaacattctttctaataggcttttgcaaaaatagttcatattttataactgtcttgcagcatggggtataagtgtaatcattgtaaaaatgaaacctaatcattgtaaaaatgaaacctaatcatkgtaaaaatgaaaagagtgcctcaaaacatctgaagttcttagcagagggcagcctgtcttcagtgggcacttttggatggaggcaggactagggtatcagtaggagtgagaacaaaggtcagaaaaatgagtacacagcacatgtatactgattaatttctttcttttttccttcttttgatggagcaagactgtaacagaagcctgagagtgaggaagggctttgscaactattactgtagacacagtagtttactcaattttatgaactcttagtcctgggctggaattcacgcctctgctggaattgcacagacaaaacgtgcttgcgaggagtaaggtggcaacaaaagaaaaatgcaggcaaaaacacgcctcattttgaaaccggatctgagcatcctagagccagagcctctcccagccaacattgctgagttgagcagagtgacagactccacactggagccagccccgcagctggccataaggaggagccacgagcaggtgctgggaagacaggctcttgaacgcacactatgctgatgtctctttctgtgaagttttctacatgagtgacgttctcaaagtctgcaacacagtctgccatgagatgccttttttcctctgggaacacaatgctactttcgtgattggctgagtaatggcccccaaagatgtactcttcatcctaatccctggaacctgtaaacatgttaccttatatggcaaaagagacttcgggcaggcacctgtcatcccagatactcaggaggctgaggcaaaagaatcgctcaaacctgggaggcggaggttgcagggagccaagattgtgccaatgcactccagcctgagcaacaaagtgagactctgtctctaaaaaaaaaaaaaaaaaatttctcagatgtgactcagtgaaggattttgagatggggagagtatcttggattagccaggtgagcctgatataatcacagagtccttataagagggacaaaggaagagtcgattagaaacagaccatgtgatgacagaaacagagggaggtcagaggtgaaaaagagaagatgctgcagtgctgcctctgaagatgaaggaaggggccatgagccaagggatgcaggcaacccttagaggccaggaaaggcaagggaacggatgctttcctagagcctccagaaggagcacagcctggtcaacactgatttgagccccataagactgagctcagtcttctgacttccagaactgtaagagaatasattcgtgttgtttgcactttatggccatttgttacaggagcaacaggaaattaacataccatgtttgggccaggtgcagtggctcacaggtgagcctataacccccagcactttgggaggccaagatgggaggatcgcttgaggccaggagttcaagaacagcctggacaacatggcgaaactccatctctataaaaaatgcaaaaattagccaggcatggcggtgcatgcctgtagtcccagctccyccggagactaaggtgggaggatcgcttgagcccaggaggcaggggttgcagtgagccaagattgtaccactacactccagctggggcaacagaatgagaccctgtctcaaaataaaaacatatcatgtttgaagaaccaccaataggtatcttgctctgtgacttgtgatccttaagtcaacatatatatatatatatwgtcacaggaagtcgatacatatatgggataatcaccaatctctaagatacatagcatgctcataaaatagccaagctctgtgctgagagacaaagacataaggctcattggtaacggtggtaatagcagctctcggtctgagcgatgtttggcatctgaagtcaccattagcattttcagagaagtccagctttttaccatatarccattcattctgtcttccaatgtgatccttaaggaaaaaaaaaattcccccatagtcgtgtgatgtttaaaatgtgtttattataccttgcctgtcatttttctggcttttagctaaaatgttttgaattgagtggtgatattcccgacttaactctgaaccctctctattcaggtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtrtatayrcacggtatttatagagagagactatcctggagaagcctcgttttgatgccattcttccttgcaaggttaagcaaggtgggtggaaactaagacacctgaaccctccagggyctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtyatcatggaggtcatacatgsatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtaygaaaagtaactgatttgtattctgtgagcatgtaaaagcggaaagttagtgcttgttctaagattacctycttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagtaactgttctctgatttctatcttgtgtccaatgtcactgatgttgggtcttgtcttagtgcaagttcacatttttgacagaccatttggggtccgtcgtacatctctggttggtgagtgagtctatgaagacagaagtaccagttctcagcatgggccatggactcatcttgtccacctcatgatatgatctgagggtgtcataatcagctataaaggtaattgcatactcaaagatgagacggaccattctcagttgatgaccacattaagcatagtcatggccatctgtcaacagtcccaagacctggggatttttctctggaacaaatcctgttgctggatcaggagatgccacaccttgaacttgatagggtcattctccacgagcacatgcccccgactcagggacaggggaatctaagcctgtgcattcacactccacaagatttcctctactggctttacagggcactrtcacgcgtctcccgggcgcaccttgctcccctcttcctgcaaggcagggggagaacgttcatccttgaacaaacaaagagcatcctcagccagtcaggcggctggtagccggacacatatgctaactggcaatcaggaagtcaccctccaatgtaaacttcagccacatgcagggagaaacacagcagctgagtggccattcactcaaggaaacaaatacagcatgactccttttctctcaagctggtaggctctcctgcactttgtgaaccgaaccagaagattaacttcgctgaaaattcagaaaaataggagtaaagtgcacacttcattaataaatagaatatgcctcaactttcccttatttaaacatattctctgtccccacagttctaatcaggacagagatacttctgtcatgttgttcctcctaatagtttccagaaaaaaaggaaaataaaccaattcttataggccaaagtggtagcatttcctgaatcataagatgttttgttcatttgctggaatatattacattgtttactgaaaaccatagtagaatcaaaatgttatttcattattacctatgcattttatctgagtccaacttattaaaaaacgaagtcaagtaaggaccagaaattgcttttcccaattactgagcacwggtctgagggttttatttccactgagcaaatagtcacaccttcacttctttttattaatactcaaccaacttagttgattaaaaatcacattttctccctcattttacatacgataaattaattattttggataatttgttttaataagaatatgcacacattttctaatttcaataaaagtcaccttcaataccgccagttctctccaaatgagcatcattccaggcagatatacctgctgtgcctcttggccgacaccagcaaatctaagcattataacgaaataaatccagccagatttcatggtaggtatcaaataagactttggctcttaaagaacatcgttagaaattttgatagctcattccagagtttcagaatgtcatttaaaacagtctgataaatggaacaaccatctaccatcacactcatagagtagctcaaattgcattttacccaaataaatacactgggtcttaatcttaagatgtgacaactaaaaaatttttaacaagtctgtgtttgatcctggatttagtgcagttgcacccaggcacgagctctccagatgattctgaggaaaggagtctacaattttcctagggggtgtatgaacatggtaccaaaaaggtgattaataattataataatggtttatatttatcaactgcttattatgtgcccacactgtacaaaatccttacagatagtaactcattaatccctccagtaacatatgagacaagcactactatcttctccaactcacagataaagaaggctgaggctcagaaaaattgaatggcttgcccaaggtaagtggcctccagaaccaaacctcaggctatctggctccagggttcatgttcttccgacaacatcacaatgccactctcaacccaggagcaaaaccagacaaagtgcctactgcagaccggaagwccctmgtttgaagcctccattagcgtgactatgcagctagaccaacttactgttaagcaacagtaccttttactatgaggtaccctttactattaagtaccttttactaacagtatcttctgttacctattattaagttcatgctatacttcttcaatctgaaagctttctgttaaaaaaaaaaatgttaacatcgttctaaattaatattgagaccttagaaatttttcctgtgcaagataacgtaattatttgccccttcccttccatggcttgttagcaggtagatgaggggcttctcctagattaatttaacatctcagttaatcaaaagtagccgggcatggtgactcatgcctgtaatcccagccctttgggaggcagaggcgggtggatcacttaaggtcaggagttcaagaccagcctggccagcatggtgaaaccctatctctactaaaaaatacaaaaattagctgggtgtggtggtgcacacctgaaaccccagctactcaggaggctgaggcaggagaatcgcttgaacccaggaggcagagtttgcagtgagccattgcactccagcctgggcaacagagcaagactccgtcaaaaaaaaaaaaaaaaaaaagaaagaaaaggaaatttatgaactccagagtacccattcactaccaaaccaactgaggggagagaaaactgagggagaaagtggggtggggtctcaaagggtttgcgctgtgctttgctataaatcattcaaaggggcaaattctaaaggatctctaagtagttgctgattttgtaaaggtagcccataaatctgtttacgtgtagctgccttaaacatgagtcaacagggtaagtcacaccaacaggaaacccaagcactaaaaaagccacctaccttttctgtttaccaaatactaagaataataatctaataatctggctacatctttcataaagacctccatcttctctccttaactgactgttgagatttgataattttcacagtctaatgataaaatgctttcaaaatggttcatctaacacaattaacaattcttttactatatgcaatgtgttacccttactatatttcctattgctaatagattagcccactattgaaaaaattctgcagttgtgaccgtgttcacatgaaagcatatacaagacatggagagacagcaaaaaatggtgggaatgggtgtgtgtatgagggtttcagataagaacttcaattatataatttaagaagagtcagtctataatttaagcagaaataattgagatactcatcaaattaagtaagcggaaaaatttcctctctctcatactatgttgctatcatcacatctatcgttggagggttgctgagcttgatacgcctttgaaccattttatttgactttccacgtgccgtctcattggtagggagatggtgaaaagcgttgggtggtgtaggacgagggaggttttcactctgaagctatgaagatttggagaaaggggcttatagaagcactatgaaaataaactggagactatttttttgctactttttaaaaagctttttctttagagagtactaaagccattctatatctgtcgtacacatgaattcagactattattagagagttatatctgtgttgtcatgcacatgtcaacactgtcctgatgacaaaattttatgtatccccccagataaaaattttaagaaattttaaatgctttttattcacacacacttttcaaaagggataaaagttaatcatgttaaaatattcagtctatggcagatgtcgctcctttgggccctcactgctgaattgcttacagtttctgagctgtaaactaacatttgctttactatgtagttacagagaaatgtgcaacttgtttgtgaaacattcaaataaagcttatctgggatttttaacttgtgtgtttagtcttagaccatctttagtacagtctggtctaaacactgtgacagagcaaagggacctttttttccaatggtgcacagtgtcatgggtgcaactggctggtgccggtgttgtggatggtaaaagaatttaccggcagggcgtggtggctcacgcctgtaatcccagcactttgggaggccaaggcgggcagatcaccggaggtcaggagttcgtgaccagcctagccaaagtggtgaaaccccatctctaccaaaaatacaaaaattagctgggcacagtggcgcatgcctgtaatcccagctactcaggaagctaaggcgggagaatcgcttgaacctgggaggcggaggttgcagtgagccgagatagcgccgctgcactccagcctgggtaacagagtgagactctgtctcaaaaaaaaaaaaaaagaagaagaagaagaagaagaagaatttaccaatttaccaagacagttgtaggtaaagaaaggctgattattcaagggaaagtacgttgcaaggaagcaacaggcagcacagcagagaaggggatgtctggaaagaggcaggggctggagggaagttttatagggttgtgctggaggatgttacacttggagtgaggtagttgtgccagcggcttgtttgtgattagctgtctcttggaacagttgttccctacctgggaccccccttcctcattgttgcttacttatcaggactccacaccaggttagcctatgatgtttaaaaaccaagactaaaaccaagtgctgcctgcttaataattggctctcttctgcttctttcataaaagtcaatcattctgatttggaaaaacagatatatagatgatagaaggatagatggatagatgatagagagagagagatagaaagagagagaagatagcaagaaggttagtgagatcattttgtaaaaaaaggagggggccagatgtggtggctcacgcctgtaattccagcaatttgggaggcagaggtgggccgatcacctgaggtcaggagttcaagaccagcctggccaacatggagaaacctcgtctctaccaaaaatataaaactaagccaggtgtaatggtgggcacctgtaatcccagctactcaggaggctgaggcaggagactctcttgaacctgggagccggaggttgcagtgagccaagatagtgccactgcactccagcctgggcaacagagcagagcaagactccaactcaaaagcgaaaaaaaaaaaaaaaagggaagggggtattcgttaagtgcttcctacgggccggatactttacgtatctatatagatgtgtatatacatattaccttgtagttatatttgtaatttatgtgtaatacataattatatatcatatacataatttatgtaatagacattagcaccattctatagatgaagaaactgaggttcacacagttaaaactatctcacagtaggtctcacgactactaagtgatatgcatggccccaccctggcacttttcttgctatatgctaaggcagcaccaccccatttatctccaggaacaaactgtgtcatcacaaacaatgcatgaaagtgctgaggactaagcaagttgtcaatgatgggggatgaagcagaggaaacccaaacttgcaaatctggtctataagaaaactttccttccccctaggcagtctgtctccaggaaactgctagtttgggtaaataaatagcaaacggatgccttggcagccagtcatagagacgctaatttggaaatttgcctcaaaagaacataagaaacagaaaccaatgcttcaatccgaaagcaagagaacgtgaaattgtcagaacaaccaccgatcacaccattctccccgagaaaagcaattttctaggtttttgtttgtttgtttgttgttgtttgatttttttacaaacaagtcctcaaagagacctcc

SEQ ID NO: 12395 - DNA, 36098 bp, Homo sapiens
aaagtaagagaaggaagaaaattaagctattggaaaatcctaataaatcaacaaaatgtttaacaaaaatagatacaattcatggagaaatccagggagaatatcaaggaagaggtggcatttgagctaagacatatgaaagggaatgacacagaatccactcattcatttagttcaacaaaagagagcatctagcaagtttcaggcaccatgaaaactaataaagaaaactgtcagtcctcaagaagtactatctacaaggagacccagaaaaaccacaattaagagcaacgttaaagatatgtgtacaggccgggcactgtggctcacacctgtaagcctacaattttaggaggctgaggcaggaggattgcttgagcccaggagttcaagaccaacctgggcaacctggcaagaccctgtctctacaaaaataaacaaataagcatgttggtgcacgcctatagttcctggtacacaggaagctgacgcgggaggatcacttgagtccgggaggtccaggctgcagtgagctgtgatcatgccactaccctccagcctgggcaacagagtgagaccctgtctcttaaaaaaaaacaaaaaaagtatacagtattgtatctaacaggtgatggagttagggaacgttaggctaaatcttaaaggatgggcaaggttaacctggcaaggaaagggtagaaagggtatagtggaaaacattttaagaggggtcagtttgctgttactaaagtaaaaaaggaattgataagaaatgataccagagaggcaagcaagggccatataatagagcgtcttatatgtaccgctaagaagcttggacttcattgtgtaagtgaaggggagccactgagtgtgaagcaggaaaatggctaattctaatcataagaataatatgctcagagcagggctttaaaaagaaaaatatggtaataatattatttgactgccaggatgagaagaagctggagtggaagtttcaattgaagggcccaaatagtacttacagagaaagaaatggagacattaatttgggaaatggttatggtaacagatatgggagatgttgtttaatagctgttctcagactttttctgaagaagtttcaaatccacaaccagattgtgaacgccataaaaagaagtatatattatttatatccactttattcctgattatggttcaaaatctcactccttgggcacaaatggagcggatttttcttctctctatatatattcccacttccacctccccacaggtccttccctaccagactgtgagccctccaagtcagagactatattttattcatctttatatccccactgcctattggatacttggtacttagtgggtagaggcttattacatatttgcaaaattaattaaggcttactatagcatcctcctagccagctttgcttttttgagaaaattctgcattaaaatattaagaatggttaggtctttataagtagctaagcaatcctgagagtagaggatatttctcaatcgatttggtagtcaccctggaagttatataattttttcaatgcctttgtttagtctcattttgaaactcctttcagagttgagacatgtccttttcaaatatttataatggtggcaagtctttgtccttttgtagactcacaaatttggaaacaaccaaaaaagtaatttagaaccaaatctattacatttatttattttataaaacaaaaatgtattttcataaactattccaaatggcaactccaagaaagagtcctcaacaatgttttatactatttataatcagtacaacaagcacaaacctgttttttcagtatacttaatttaaagcacaacgctcacttaaatatctatgttctgataaatttcattcattcatattgaatgcttctgtgtcaggcattagtgtaggcatttgtgatacacccataataaaacagagactgccatagtggaattcacattctagcagggggaatcagacaataaaaagtccaataaatacataaattatagaatatattgcaaggtgatgagtgcatattgtccctcttctacttaaaatccttcaatagctcttggttgggtttaggatcaagtccaaaatggcttaacagcacttcagcccctcttgccttttcagcctccttgcccactgtgtgcctgtcatactgactgctgcttctctgttccacaaacacacaaagtctcttcccatttccagtgatgctcttaaggagtttatgcttgtgtgtgtgtgtgtgtgcacgcgtatgtgcatgggccagaggaagtgcatgatagacaacaagtaagcaatagcatatttaaaaatatatatagtatatgagtgctataaaaaaatgaaaaaaatgaattggtatagatgatcaggagttgggaatggggatggtgggcaggttgcagttttacttatttcattcattcattcatttattgagacagggtcttgctctgtcatccaggctggagtgcaatggcacttacatggctcactgcaaccttgacctcctactggacccaggcaatcctcctgtctcagtcccctgtgtagctgggaccacaggcacgcaccatcgtgcccaactgatttttaaattttttgtagagacagggtcttgccatgttgcccaagctggtctcaaacgcctgggctcaaatgaccctcccatcttggcctcccaaagtgctgggattataggcatgaaccaccacacctagccaggttgcaattttaaataaggtggtcagtgtaggagaaagtgagaactgcacaaagatctgaaagatgtgagaatccttaaagaatctagttcactatctacaggtgacaggaaactgaaaggaaacaactcaccaatctttatgttatgttgtgggtgttttcgaatgagctggacaatctggtgggcagcttcttgtcgggaaggaagaaccagggctggattgcaattggtgttgtctaggtataaagtatggatctgtttccccagtgtcagggctggctcctttagcatggatggtgtgtatcgaaaatcacctggaggaatatgtacatgggggcagaaggtcagagacaaaagaatagaagacaagcctctcctacctccaacaatagacaggcgtttgcttactagtctgtgaaaaaactattatgtagcctggcactgaactaggcagtatagctgcatggtttctttgttgtaatgtctccatcctactcctatttttcaattactcttcacaaggttcggacccttaaagagtgggaaatcggccaggcgcagtggctcacacctgtaatcccagcactttggggggccgagccaggtggatcacctgaggtcaggagttcgagaccagcctggccaacatggtgaaaccccgtctctactaatagtaaatacgaaaattagctgggcgtggtggcaggcgcctgtcatcccagctacttgggaggctgaggcaagagaatcacttgaacccagaaggcggaggttgcagtgagccacaatcacgccactgcactccagcctgggtgacaagagtgaaactccgtctcaaaaagaagaaggaaaaaaaaacagtgggaaatcagttgagatggggtcactatgctcatatgtgatgaagttagaaggcctccagcgcctccagacttctattgagttaaggctgctcaagaaaagtctgccaggtgtggtggcttgtgccaataatcctagctactgtggaggctgaagcgggaggattgcttgaggtcaggagtttgagaccagcctcggcaacactgcgaggccccagtctatacattaaaaaaaaaaaaaaaaaaaaaaaaaaaaaacatctagtctggagaagtcactgggattccttgagaggcccacctgtgtagaggatggttccaaaatatccttcaaagagaaacatgacagaaccaggacagtgattggcatcgaggagggttacggtcatggtctcttgtccaatttcatctaggggtaatacatggctctcaccaacctccagggcttggatccattgcttagatacctgagaaaacagttagtcatcccagtgaccactgactcctctccgttacctccccgggtcagggactatcccttacatgaatcaggaaagctgaccaaatcctgagccaccgggagcagaagctgtaatggggattcccaagcaatctgcccttcctccttccacttcccatcccaccctttgtacaatttaagagttcagctggccgggcgtggtggctcacgcctgtaatcccagcactttgggaggctgaggcgggtggatcacgaggtcaggagatcgagaccatcctggctaacacggtgaaaccccgtctctactaaaaaatacaaaaaaaattagccaggcgtggtggcgggcgcctgtagtcccagctactcgggaggctgaggcaggagaatggcgtgaacccgggaggcggagcttgcagtgagccgagtttgcgccactgcactccagcctgggcgacagagcgagactccatctcaaaaaaaaaaaaaaagagttcagcaaacagtctagtcagcaattcccaaacttactcctgatcttaatctcttggagacttaagggtggggtggggagagagctggagaaccacccagcacattaggtggattcttaagatgaggcaagtttaggcggggcgtggtggctcacgcttgtaatcccagcacttggggaggctgaggcgggcggatcacttaaggtcaggagttagagaacagcctggccaacatggtgaaaccccgtctccacaaaaaatacaaaaaattagctgggcgtggtggcgtgcgcctgtaatctcagctactcaggaggccgagacaggagaatcgcttgaacccgggaggcggaggctgcagtgagccgagattgcgccactgcactccagcctgggcaacagagcgagactccgtctcaaaaaaaaaaaaaaaaaaaaaaaaaaggcaagtttgggaaacatcggcctagcttacttataaaggtaggaatagtttccttggctggattaaaatatctcctcaacttatggctaactatctcaagttggtcacttcgaaaacacgttcctattctgggttaaagatgcatttttgggttcaaacaacttccaaatcagttttcgtggcccccattctatgactccaagaatgacaggttgaagtcccaacccagatgcctggaccagctctcggagaccgactccagccccatacctgtaggtgacgatgcaagaggtgggctgtaattggggagcagtagaggggccgggcccaggtgctagacaggcccacggtgtggtccgagtgcatgtgagacaagaagaagagacgtgcggtgccagcccggcgcaggctccagaagtccactgcgatgggcgtatgggggatcaggaccccattcatggtggtagggttggagtcaccagtgggatcttctccacgggggcagggctcctgcgtgaggcttccacaacggcgtcccgataaaagtcatgctggggcaagaacagggccagagaccctaagggaaagagcccagcagagcaataagttaccagagtgggcagaaaaaggaagtcaccctgcccgctggagcccaaatcgcggagggcgctggacactcccaaccgcgcgggagcggaggccgagccgggcactcaaagcgcgcgctgcagggaggagacaggccaaagtagccgatttccgattgcccgccgcagctccaccagagggagccgcgcagctgcgcctggagagtgagaggttgggggaagggcatcctaaggtcggagtcgggactacgcttagcgctcgctcgcggggagaccggcagcgctcttctgtttggtctcttgacaagggggcgggacttccgcagaaagcaagattgggcctatccgcgatgagaacggcgtggagggggaattaaggctggaactggagagggaggggtctgcggtcagtcggacgcggcgctggaaatccggcggaggacctagaagtagcgggagcgatctgtgggcggggcgaacggcctgccggccgayggtagggcctgaagagcctagggtggggctcgcggtgtcgcggagggcgtggaagtgtgtcagggccagcgtgccggccctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtatcacctacctcccttcgcgtgctaactgctccctttgcaatccccatcagggctcactagccccagtctctctgaaagggtgaattagctttcacacgtggcagttatatggttcggtcttcgtcctgctgctttggagtaccatgtcagtctcccctctgcagcatcttttactcagctggrtagtttsctccatatcacgggcttgagcaattactggtgactcttggatctataatatagctagtacagacttccttttttagcttcagacccacgtatcccactgcctgcttggcatttccacgtgcgtggtttatcaaaagtatgtccgaaatagcccggacattcttccgtcttcctcaaacctgttcagcttacatttgtgttgatgaatgccaccagcagccgactatgcgtgggagccaaccttgaggacacctgatctctcacttcttatgtcagatggtttgaattcataattctaaatatccatcctctcttgtttattagcattgttgttctggtccaggccttcatcaataaagcaattgcagcagcttactagtaggccactttgcctcatttgagacagaatttttccattatacatacctgaacacataactcttgcctacagctatggttcacaaactttactatgcataaaaatcccttggggtgctttttgtcatccagtccagggactgattctgatttcagtagggtgggagggaacccaggaatctgtatttttaataaacatttcagttggttccagtaggagaccagtctgagaaacaataaagtccaaacttatcacagcacccaaggaacaagctgttaattcaactacctacagactcttaaaaaaatgtgtgcygctcctgctcatgtctacttacctcatagcatgtatctttaccttgctattacatctgcctagtgagctcctgctcattcagctaaagtattacttcctctgtgaagaaacattttctgacttcctgccagtgtcagacctctgaatcccctctacaccttgtacaatacttctgtttaagtacttatctatcatactgtaattaacggtattctcatctggctcattaatagatttgaagttcctagaggtttgagaccacaccttcttcaagattatgtcccaagagcatgtccctggatgtaaaagttgaatttcaccaaagtactagggattcaataagtgtttgttgaggctgggtgcggtggctcacgctggtaatcccagcactttgggaggccaaggcgggtggatcacctgcagtcaggagttcgagaccagcctggccaacatggagaaaccccgtctctactaaaaatacaaaaattagctgggcgtggtggcacgcacctgtagtcccagctactcgggaggctgaggcaggagaatcgcttgaacctgggaagcggagcttataatgagccgagattgtgccactgcactctagcctgggtaacagagcaagactctgtctcaaaaataataataagtgtttgttgaatgaatagaagaataatgtttattgtaggcctatggtatgaagtactgtgtgatataatagacaaggtaatcctggctgctaccctctaagagatcacaatctagttgggtaatcaggagatatgtaagtaaaactccctccattgtaagttggggattttgcattttacttccttctgtcatgtgcgttgttcaggtacatgactcaaggcttggacatgtctggtgtttttatggaaatggtgaaggccagtgccactgtagatattgtccagaagaagttggtttatctgtacatgtgcacatatgctcccctgaaaccrgatctggctctcctggccatcaatacgctgtgcaaagactgctcagaccccaatccaatggtgcgagggctggcgttacggagcatgtgtagcctcaggtgagtaccctcttctctgtctggtcctaaatggctgatgaattcaagtgatcacagggtaggtttttaaagaggataatttatttgagctccttaatactggggaaaacattattgtaccctgaactcagattttcagccactgctttggcttaataacctgtatcatataattttattagagggagtttttgattctcactctaagtaaaatagtcctcagttttggttaaatatctctaaacaattatgtgtatatctttttttgctgcctgtgcatcattattccaaatgaaaagtcaaattaggctgggcacagtggctcatgcctgtagacccagcactttgggaggcttagacaggaagattgcttgagcccaggaatttgagaccagctgggcaagatggtgagagcctatatctacaaaaaattaaatgggcatggtgacacgcacctgtagtctcagctactaggaaggctgaggcaggaggatggcttgggcccgggaattcaaggcagcagtgagctatgatcgggccactgggtgacaaagtgagaccccatcttgaaaaaaacaagaaaaaaacagaaaagtcaaattatggctttttaagcttgatagaggctttctgcaattcttcatgatctgatgggtgcagcatctactaaaccatctgttaggtgaacaggggctgaggtatgtcaaaattagtatttcagaatctggctaactccaggatgtgttgcttaggatgcctggtgtgcaggagtatatacaacagcctattctcaatggtctgcgggataaggcttcmtatgtcaggagagtggcagtccttggatgtgccaagatgcataatcttcatggagactctgaagtaggtaagttcagtgtaatccatcatggtcaatgtgcctccattatgtataactttaaaaaagatkgtgtggctttggtagaaaataataatgtggccccagttctgtacatatctctttaagtaggatgcagggcttggtatcttctggagatgagaagtcctttctctggggccccaatgagatcctttgtattagctgcttagaacagtctggacatggcagttttttttttgccttgcactttagtgtggcctttgtcatttttgtagcagagaagttcaactttgtctacctggmgctattactctggctacatccttgttactctgaagctttccttctttatctaagaactttgttcttttttatagatggtgccctggtaaatgaattatacagtttgctgcgtgaccaggatccaattgtagttgtgaactgcttgaggtctctagaggaaattctgaaacaggaaggaggygttgtcatcaataagcccattgctcaccatctcttaaatcggtttggatgcctcagcactctttttattatgagatctgctaccttgtgggatcttgttgatgtattaaagtattgaacaacttatgtggggtagaaaagaaagttaaccattattattattattatttgagacggagttttgctcttgttgtctaagctggagtgcaatggcgctatctcggcttaccgcaacctccgcctcctgggttcaagcaattctcctgcctcagcctcccgagtagctgggattataggcatgcgccaccatgcccggctaattttgtatttttagtagagacagggtttcaccatgttggtcaggctggtcccaaacttctgacctcaggtgatccgcccgcctcagcctcccaaagtgctgggattacagacgtgagccactgcgcccggccagttaaccactattaactccctcacattccactgagagaatttcttttatttgccttactttcccttattgatatagggaaatagaaatatactgtgggaataggttctacccttctctagtcatgtcccccaaactaagccatttatagtgtcttaaaatgtaaggaacctggacccagtgtatgctgatcatgtctttggtcttagaggagtgtgcatttgtattaacaactcatcttggaattttaagccttttttgtgtaaactttaaatagtacatgaaaagtgacttaattatggcacagcctatttttaagaattctccctttgctatgatgaacaaccacctggtcatatggcagtggcatggaaatggtcctaattttgttgctaaaatagctcttttgttttsttttttggatagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtaggtgtctgctccttttccttcttgagaacctagaccagccagcaagaaaaytgtggttagaggaaccatagagagcaaagggcatgaatcttgcttcagaagcaaagtactatgcactaaataattgggtcagtgactacaaacacgggggaagagagtttttttttgttttttgtttttttttggtcaagattggtgttgctgtatcttccaggatggagaatacaggtaacacaaactacaatacttaaaattgttgttgtcttctatccaaaatgctttcctatacatcatcttaccacagtatcgtgagacagtcaggaaaagtagacaaatgtcattaacttcattttaaagatgaagaaactcaggcacaaaaacagttatcaaattgccaaaagggcacatagttttagaaatgggactgaaatccagctttcctgactcaaagtcctatgttaatccaccagtcatttattgagcttctgctatgggctatgtattgtgctgaatgtagaccaacacagaataattcctaaatcttacagactttttcatagtaccctgtctggaatttgaaaggctggagtgactcaaaaactgaaaacagctgttgagccaagttttgaaggatttcaagtacaggaggaggagcaaccctcatatttggaataaagcatggttattttaggggcagagaagagggagcaaagaggagacaagaaatccttaggagactgctgtcaagtgtcccccacaaaaatactccattgcaggtgtgctgcaacaaaaagggtacctcatatctggctgccatgtaaatacctttgttactataagttttcaaccttgtttaatggggaattgttttgctatgagctttcagttttctagtagtcagtgagaaaaaatgatttttaccaaagttccctttatagtaaacttatattcttagttcatcaagtaaggagtgaatttttttcttttttttttttttagataattctgtttcttttgtctttcactggtgggagatgattttagattgaggtgctaatatttcacttagcagttttctctgctttcccttcttttgtaggtggcattgccaggacttacacagatcaatgtgttcagattttaacagagttgctgggtcttcgacaagagcacattaccacaggtaatgcctgcctttttaggatttttgttttttttgtcaggtgcctggcctatagtagttgctcaaaacatgtttgttgttgaatgagtaatatagagatttgaacttttccttgcatcatcatctgttgctgttagagaagcataaagtctatagatctaataggatattgagtcttcaggctgccatgatctataaggctgtactatagataatgaaggctactaggatgaccttgcttgatatttcaccatctttacttctctttttgttttatggcagtatgccataggcagtggcttccagggttgggacaagggtaagtcaagcaagatgcctaggatgcaaaatttaagaaggcactcactcttaggttcctgcaagagccaatcctgcatgtcttcttcaattttgaaccctaggcacctcacttgtgttatcattttcccaggcctggtggttctatttatactgtctttagtgtttcattcaacagcaatactaccccacatttgcatacagctttatgttttacaaagtgctttttcatacattagttcatttatcctcatgtcaatctgataagagcaatatgcattcaagaaattattgcttatttcattacatttcttagataaccattgaccacacctccaaaacccattttacagaaatccagccagaatcatgagtctgaatacatgactgttcttaagattcctgcctacctggaggctctaatcctgtgctcttgtaccctggcctgtattgtagtggtggtgcagactttccgagacctggtttggttgtgtcctcagtgtactgaagctgtatgtcaggccctgcccggctgtgaagagaacattcaagatagtgaggtagactgtaattctcctttacttctaggtagggggagaatgcttgaaaccctgccctttgaaatggaatctaattattctctctaccctgtgtttgaagtgggcactcttcgaattgattgccaccttagattctcttttggatatagatggcatataaattataaaaacaagatttatccgacgggttttattacaaaactstgataccattgttctcttgaacagttctgttttgttttgttttgctttgcttgagatagagttgcccaggctggagtgcagtggcgtgatctcggcccactgcaacctctacctcccaaactcaagtgattctcttgcctcagcctcctgagtagagtagctgtgattacaggtgtgcaccaccacgcccagctaatttttgtatttttagtagagagggttttgctatgttgtctaggctggtctagaattcctagcctcaagtgatcacccacctcagcatcccagagagctaggattacaggcataagccactgtgccccgcttctcttgaacagttttgagtcagagatttagaccatggagtttttagctagaatgaaaattataatcatttgtgaaatttttacaaagatttggacgtaatcacaggtctactgacttaaatattcaggggtgttggacctagacagataactttttttttttttttttttttttgaaacagagtctagctctgttgcccaggctggagtgcagtaatgccatcttagctcactgcaacttccgcctcctggtttcaagcaattctcctgcctcaggctcccgagtagctggaactacaggtgtgcaccaccacgcctggctaatttttgtatttttaatagagacgggtttcaccatattggccaggctggtctcgaactcctgacctcaggtgatccaccctcctcggcctcccaragtgctgggattacagacgtaagccaccgtgcccggctgacagatacatttttaagaagcttcacagatgactctgatgtgcactctaggttagtaaccatttttgtgaaaaatttagagaaattctttgagcagcttccactgaaacactaaaacccaatagggccaaaggccccaaacctgaggaaaccttatttattgcttaatccaacataggctatgaaagttttgagtttcctcttgtgtattagaatttcattcctatttgttgtagagagtatagtacggggaatcagtaaattaaatgaagtaaactaaagattacaccttttctgctggcactaagcgaaaagcaaaaccagtggctgtctattatctcctgtgttttagacagtcaagtgttgagcacttgctcttattcctttattctctaggggaagcaagcacttatttggctacttggtgtccatggggaaagaattcctaatgctccttatgtgttagaggactttgttgagaatgtgaagtcggaaacatttccagctgttaagatggagctgctcactgcttygctgcgccttttcctctcccgacctgctgagtgccaggacatgctaggacgtttgttgtattactgcataggtgggtttttcagaaggaaatagtatttgccatgacccatagtaaaaattcttaatagctttcattgtttggtgagtcacgtctgggacccgagaagaaaatgtgaatgcttcctaggttttcctctctccttcatttttttctcctattatggttggcacaagagtaggaggaaagtggttttgtttttaatgaagtcaatctgttgtcttacctcagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatytctaaatgccagggggcagagcgttgtgacccagagcttcctaaaacttcatcctttgccgcatcaggtaaaaacagtccttaccttaaatcttgtcatgataaatctttaccttttcaatgattggtggaaagtagagtatcttagcactaaacctcagactgttgcctgaatttgaagcatttgtgagcaagaaagaggttcgtcactggttatttcagccatttgtccaaaaataaaagtcacattgtgtacatttgggaatttggataaaaaacttagctcctacagattaagaacatctttcacacaagttttctgtctcttttaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttwtttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaactgataggggtcatcatttgtgggggtcatcttttcttccctggattattatagtaaattcctaactgttctcatatttccaatcatgcttttaggccagattccaaagtccttaatgtcatctaaagtacctctttggtgtcaagtcttgccactcccaaaatgacttcttttctggcagaagcaaaccatttgcattgcagttccctttatacacctgcttctttcacctctgtgttaacttaaacctgcttttatttattgcctggaacattttctcaccctcatatcttcttgaattaacacctcgtctatctttcagtgttcagctcactcataagctccttcaggaagtttcctttaaccctcactgccttcattaggggcctccctcaagctrtcaaagtagccagagcatacctctagcagtagtattgtaattgttttcttgttgcttgtcctcaatttttattctgttcttatctgaccasattttgtacattgaagcaacttatggcaagaacaaatctaataaaatgatggtaaaatataaatagcgaatccagaatgggaaaaattaaaataccagttaagaccagctaggttggggatggggaaatatacaaatgttcaggctgtatgggcctattaggtgatatagttgagccttgatttgtctctataggtgatttagcagtcagagttaagggaaacagttataattgtcatcagagaggaagaaacattgatttctaaaagaaatgtacatgtagtttcacataggtggtactaagatatgtgcaagatcctatgagaagttagtaatgggtttcacatgactttcttaacagtattcttcaacgaaagcagagagcatgactttaatayagagcttagactgggtgcagttgctcacacctgtaacccagcactttcggaggccagggagggaggattgcttgatgccaggagttcaagatcagcctgggcagcatagtgagaccctrtctgtaaaaaaattgacttagccaggcatggtggcacatgcctgaaatcccagctgctcaagaggctaaggcaggaggattgcttgagcccaggagtttgaggttacagagagtagtgatcacaccactgcactccagcctgggtgacaggagaccctgtcaaaaaaaaagaacataaaaaaagtaggctagatatggtggcttacgcctttaatctcagtactttgggagaccaaggtgggtggatcacttgaggctaggagtttgagaccagcctgggcaatgtagtgagatccccatctctacaaaagtaaaacattaaccaggtgtggcagcgtgtgcttgtagtcccagctacttgggaggctgaggtgggagcattgcttgagcctaggaggtcaaggctgcaataagctatgctcatgccaccgaactccagcctgggctacagagcaagaccctgtctccataataataataataataataacatggtgcttaatgaaggcatttcttcaaggacttaagataacatgatccaagtatatagcctttatcatccagcttaattcaaggatttttactacctagatatagataagcacataccttcagataatttttcacctatcacttctctcaaatagccttttttttttttttttttaaatctgagacggagtcttgctgtgtcacccaggctgtagtgcagtggtgtgatctcagctcactgcaacttctacattgcagattcaagccatcctcctgcctcagcctcccaagtagctgggactacaggcatgcaccaccacgcctggctaatttttgtatttttagtagagatgggatttcgtcatgatggccaggctggtaactcctgacttcaagtgttacccagcctcaactaagctcttaataggagtagataacagacagtattgaattttctggtaagagcctgggttttgtgagttgtttattgaatggacttccccattgaacaaccttttttttttttttttttttttaggtggagttttgctcttgttgcccaggctggagtgcaatggcgtggttttgggtcactgcaatctccacctcccgggttcaagcagttctcctgcctcagcctcccaagtagctgggattacaggtgcccgcaccacacccagttaattttttgtatttttaatagagatgggttttcaccatgttggtcaggctggtctcaaattcctgacctcaggtgatccacctgcctcggcctcccaaagtgctgggattacaggcatgagctaccgtgcctcgcctgaacaacttttaagaatgattctttctttccttttatttccatagtgcctgccacatagtattactcagtaaatctttactgaatgaatggctgtatataattagattctgatgtgttttgggattgatgtttgaaatgggttttatgatattgtatcaactatatggaaaatgatggaacttattctagaccaggatttcttaaaagtggcaatactgacatttgaggccagataattctttgttgtgakggrytttcctctgcactgtagaatgattattagcagtatctctggcctctgtctacccactggatgccagtagaaccctcagttgtgacaactaaaaatgtctctagacattgtcaaaggtcccctgggacaggcggcaaaattgctgttacttgagaaccactgatttagaccatggatcctcagggacaggaaagggagggattagaacagcttcagaattgcattttctgtatttttatggttcagttaaatggtgaatgtttaattaggtactaagagaaataaaattgaagtgctgccaattcaaagtgtagcaaggggccgggygtggtggctcacgcttgcaatcacagcactttgggaggctgaggcgggtggatcacaagttgaggagtttgagaccagccggccaacatggtgaaaccccgtctccactaaaaatacaaagaattagctgggtgtagtggcgggtacctgtaatcccagctactcgagaggctgaggcaggagaatcgcttgaacttgggaggcggaggctgcagtgagccgagattgtgccactgcactccagcccaggtggcggagtgagactccatctcaaaaaaaaaaaaaaaaaaaaaargcgtagcaagggaacaggatgcaggtggtagaaattgagtaaacttattgactttttaaaattaaagactataactgaaatgttgatctaaagaaaattaggtatgactaagcaactgaataaataataatactaaagtgatcccaactattggagcttttagaagactatgttctacttggttgcttttctataatgtaagaggmatacatagaatatgaaattgttgyttttggaaaatatacttttaagattatctcaatgaagaactgatttctcctgtagcctggttttactaatttataagcaaaatgactaaagctcaggtatactatgaagttaattctttaatatttcccctgctaggaactctgtatagcttctgcagacatggggtttgatgatgtgatataagtagatgtttatattttacaatccatgaaggtagtctatactgtgctcttagaacagcagccatctaatgtcattcttagttgacaggtaaacagtatgttaygtatgtaatgaggttccacaaagacaatagtgttttggaacactgcagaggcaataatttgcatattaccatcattttatagttatgaatcagtgactgtgatgtgtttccattacccctatttttgaacaggcgttctgttaaaagtattctattcctttcttagatatgggatgtttaggggagaggggacacattacttgttttcttagttacaagtctccatgttgagaggagttacactcaaggatcttcatccacatgcacatctggtacagatgacaagatcctggactttaagccaatgatatgagacaaagcattttggggagggatgtaatttgttgtggtcagagggtggcaagagaaacaagtgacggtgaaaaaattctggcctcgtgatttttcagtaataattaagagcacaatattacaactgcaagggtgaaggtatgtgggctgagggaaagggatagttttggagggtgctatattgaaggcccagaagaagtaaacaaacttggaaaaaatttactccacattgctaatgacagcctgtactctgtttctatagctttacaacattgattatacaagacaatgcaaaggagttgaaattagattttttttttttttttttttttgagacagagtctcattttgtcatccaggctggagtgcagtggtgtgatcatggctcagtgaagccttgatctgggctcaagtgatcctcctgcttcagcctcctgagtagctgggactataggtgcgtgctaccacccctggactcaaaattcgatttcaaagatggcataagcgtattgatagtgaaatgaggaacgtggtttattactgtgggaaaagcttgagtttaatgtaagacagacttggtttaaaatttatattctgccacttactgatgtgtgaacttgggcaagctatttaataccagctggatggtctcataaatatttttattttttatatattgttttgggagtatgtcacaaatgtattttttagaatccttcaactgtcagtggctagctctaatgtgaaaggaggttagcctagaattttctctgagtgcccgcccttctgatgttaaaagtctgaagcctacttagtaataatgaggtttcagcccttttgcctctagagagaatgagcgacagataatgacaaatgaaaatagcactttagctacatgggaacataatttgtgttcttactccaaaagcaatttatgatcatttttaaaaattaagactttttaagagcagttttaggttcaaagcaaaattgaaacaaaggtacagagatttcccatataccctctgccccaacacaagcatagtcttctctgttatcaacatcctcaatcaaagtggtacaatttgttgtaactgatgaacttacctcatcaattattacccaaagtccaattaccacccaaattcctcctcatcttttcatggcctgatctttttttttgagacacagtcttgctctgtcacccaggttggagtgccatggtgccctctcagctcactgcaaactccgcctcccaggttcaagcaattctcctgcctcagcctcctgagtagctggaattacaggcgtgagccaccgcgcccagccagctcatttctttttagcactaaataatgtctattgtctgtatgtatcacagtttatttattcatttacctactgaaggacatattggttgcttccaagtttgggcagttatgaataaagctgctataaacaaccatgtgcaagtttttgtgtagataagttttcagctcctttgggtagataccaaggagtataattgctaaatcatatggtaagaggatgtttagttttgtgagaaactgctaaactcttccaaagtggctgtaccattttgcattcctaccagcaatgaatgacagttcctgacccacatcctcaccagcatttggttttgccagtgttctggattttggccattttaataggtgtgcagtggttgtatgtgttttagaatggaacagaaaacacaagattggctttgatattttgcaagatagaaattccattctgaacaactgacttactgtttatgcttgaatctttttttgttttttttttttttggagacagagtcttgctctgtcacccaggctggagtgcagtggcgtaatmtcgactcatcgcaacctccgcctcccaggttcaagcgattctcatgcctcagcctccttagtagctgggattacaggcatgcaccaccacgcccagttcatttttgtattttttagtagagatgggttttgccatgttggccaggctggtcgtgaactcctgacctccggttatctgcccgcctcagcctcccaaaagtgctgggattacaggtatgagccaccatgcccggcctatgcttgactcttttattagttggagctgttaatattaataacttcaccaggtcagacaggttgagtggtaagtttgctgataggtttgatggctgcttctgagacccagacccaaaatctaggtttagctacgttaagaaggcaaccactacagataagtgtccaatcatgagatctcttaaaacaatgatggagtccaaccctgttaggaaaatccttttgctagacagagaatctcagatctctttcctcctggtcattatgtcttgggctaaaaggaggacatttaacatttattgtatgccaaacagtgctaggccattccgcatgttatcttatttaatcctcataatttatctatgaaatattttctgttgtccccatttataattccaagttgtttttttttaaccttcccagactttatatctgctacctctccgcctagaatagtgttatgcctcctttttgcataatgaatgcctacttattcctcagagctcatgtcagatggtactattttaaggaagccttcccagtcccctaggtttgtttccctattaaactgatcaaaggcttgattccctgttacacttcactgatcaaagtgmactgatctcaatagcacaaataacaatgcgattactcatttaatatctgtcatttctgctgaagtgtaagcttcatgagcacagtaactgtgcctgtatcatttttctatgttacttgtagtgccaactatagttccttgttcagtaagtaattattatatgattatggcaaataaattccataaacagaagttgaacgctggtccactgtaacttcaaaaccttccttcaaattataccatgtgcaggacctaagaagtcraggaagtatttcttaataaaattactccagaggctcttcctgaactctatttcagttctaggttggctacctaacgataaaagttaagcattaattttatgtggttagggtgtggtctgagatagagaacctaaagtctttaaagtctccccagttccaagtaggtaatccttctgagaagtcccacctttctgagcagctgtgtttgaagaaagctagtgggaaaagttccaggattacatgtcaggaaactacaagaggtagaaacatttgttgatttaccagtgtttttaacttcctgctgggctgaaaactgcttgtttcgtggaaaagcaaaacttgacagcaaacatctaaaatgaagagctcccaaacttttgaggaacaaacggaatgcattgtgaacactctactcatggacttcttgagcccaacattgcaggttgccagccggaacctatgctgtgtagatgaagtagattcaggtaaggttcctgccctaggcggtgattgcaggtcaataagagtatgttttcagccgggcgcagtgactgattcccgtaatcccagcactttgggaggccaaggtgggtggatcacctgaagtcaggggtttgagatccgcctggccaacgtggtgaaaccccatctctactaaaagtagaaaaattagccaggtgtggtggctcatgcctgcagtcccagctacatgggagactgaggcatgagaattgcttgaacctgggaggcggaggttgcagtgagctgagatcacgccactgcactccagtctgggcgacagagactcggtctcaaaaaaaaaaaaacagtatattttatktatttcctttaagtttcaaaaggcaaactctaagctttcagtaacacctaaagygaaagaggttctcaatgaagggaaactttctgactattggtgttgacagaacatttaagctcttgggagatcatgatatgaaaattatttaaaagacaagacaaatttttctcattgcccrgattcctgggacttgccattgcttcaagcattgtaacaaatgtgttccctctgtcataggagagccttgttcttttgatgtggctatcattgctggtcgccttcggatgttgggtgaccagttcaacggagaattggaagcttctgccaaaaacgtcattgcagaaaccattaagggacaggtcaagtttctacttcatgctattgtttgctgcttttttttctatttcaaacttccttttcttactactcccatactacagtgactaggaatgttctatgaaaatatttgggtgcttatatttcaaggaagtatagcaagaattctccaattgctaaaacctaagtggtacagagatggaaaattttgggcataggctgatgaaccttcagtttgtctctacttggtcttcatcacagctgttgtgcttagtgtgcacagagcacatttataacactttattcttggcaaagtatagtatctttttttttttttttttttcagacagggtcttactgtgtcacccaggctcaagtgcagtggtgtgatctcagctcactgcagcctccacctcctgggctcaagcgatcctcccactgcagcctcctgagtagctgggacttcaggcaagtgctaccatgcccatctattttttttatttttttatttttagtaaagatgggtttttgccatgttgcccgggctggtcttgaatgcctaagctcaggtgatccactcacctcggcctcccaaagtgctgggattataggcgtgagctaccacacccagcctatgctttttttttttgagatggagtctcactctgtcacacccaggctggagtgcagtggcgcgatctcggctcactgcaacctccacccaccgggttcaagcaattctcctgcctcagcctcccaagtacctgggactacaggggtgagccaccgcgcctggcccatctgggcggatcacctgaggtcaggagttccagaccagcatggccaaaatggtgaaaccccgtctctacctaaaaatacaaaaattagccgggcggatcacttgatgtgaggagttcaacaccagcctggccaacatggagaatccctgtctctaccaaaaatacaaaacttagctgggtgtgatggcccatgcctgtaatcccagctacttgagagactgaggcaggagaatcgcttgaacccgggaggtggaggttgcagcgagccaagatcacaccactgttctccagcctkggcgacagagcaagactctgtctcaaaaaaagaaccaccctcttaaccgttatgctttattcgtcctactatacacagcttgggcagtgtgcctacactatgttcaggcagagctggacctgttactcccagttgcttgccctgaggctgtcctaggtagttgatagctgagttgactttttttctcattaaacatatttttttttttggctgggtgctgtggctcatgcctgtaatcccagcactttgggaggccgagaggggcggactgcttgaggccaggagtttgagaccagcctggccaacatagtgaaaccccatctctactaataatacaaaaattagttgggcatggtggcacacacctgtaatcccagctactcgggaggctgaggtaggagaattgcttgaacccaggaggcagaaggaggttgcagtgaactgagatctcgccactgcactccaacctgggcaacagagcgagaccctctctcaaaataaataaataaatacaaatacaaaaattagccaggcatggtggcacacaactgtaatcctagctacctgggaggctgagacaggagaattgcttgacagggagggggagtttgcagtgagccgagatggtgccattgyactccaatctgggcgacagagcaagactctgtctccaaaaaaaaaacataaataaataaataaataatttgacttgaacttgttttaataaaaaaaaatatattttgaaacagccctaaactcagggaaaggttgcaaggatagtacaaataatttmtctcttgaatcatttgacagtaaggagttgacatatttcatcaacccctaatacttttatacttccctcaaacaagaacattctgtaatgtaaccacaatctaaccatcaaaaccaggaaattaacattgattcattatcatctaatccttagatctcattcaagttttgccatttgtcccgataatgtaatttatagtaaaaagttgtaggccagaatcacatactgcatttagttgtgatttctctttagtttccttcaatctggaatttttccttagtctttccttgattttcatgaccttgacacttgaagactatggtctatcttgttgaatgtcccttaactggggtttgcttgatgtttcttcttgaataaattaaggatatatacctttggcaggaatatcacagaagtattgctgtgttctcagtgcattgcatcaattggcacaagatttcattttatmccagtattgatgttgttaactttaatcacttaagatggtgtctgtaaagcttctcctctataaagttactcttttcccctttgtaattaataagtgttttatggagaggtactttgaaactatgtaaatatcccacatctcatcaaaatttcattgcattcatttcttatcagcattggacccatgaattcctactttattctgtggattataatctgttaacatcattattaatttagatgctcaaatcatcctagttttagctagtgggagtcctttcactctagactgcatctctttgatgtgtctctattattatttgagtacttccttaatttctgacagaatatcttatacttccctagccccaaactgaaatcaaccattctccagagagctctggtttcttttattttttgagacggggtctcactctgttgtccaggctggagtgcagtggcacgatctccgctcactgcaacccctgcctctcggattcaagcaattcttctgcctcagcctcctgagtagctgggactacaggcacacactgccacgcctggctaattttttttttttttttgtattttagtagagacggggttttaccatgttgctcaggctggtcgcgaactcctgagctcaggcaatccgcccaccttggcctcccaaagtgctaggattacaggtgtgagccaccgcccgcctttttttttttttgagacggagtcttgcgctgtcgcccaggcaggagagcaatggcgcaatctcggctctcttcaacctctgcctccccggttcacctgattctcctgcctcagcytcctgagtagctgggattacaggtgcataccaccacacccagctaattttttgtatttttagtagagacggggtttcactatgttggccagactggtcttgaactcctgacctcgtgatctgcctgctttggcctcccaaagtactgggattacaggcctgagccactgcgcccggcctctggtttcttttaatggagaatgatatttagaaatcaagatctaggtgctctcccacatggatgtccttttcagcttgtttgggctctgatattcagctctgaccacccttggcccccctaaatccccacagatcttgcttggacccacctaatggattttagattccatttttgaaaaagaaagaggaaaaggaagagctactcaattattttaatgaattattattattttattattaattctaattaactactatttttgagacagtctttctctgttgcctaggctggagtgtagtggctcaatgatagctcactctagcctcaatctcataggcttaagtgatcctccmacctcagcctcataagtagttgggactacaggcatgtgctaccatgcctagctactttttaaaatttttcatagagacagggtctcaatatgttgcccaggctagtcttgaactcctgacctcatgtgatcctcccactttcgcctcccaaagtgttgggattacgggtgtgaaccactgcattcggtcttttttttatttgagatggagtctcgctctgtcgcccaggctggagtgcagtggcgtgatctcggctcacttcaaccttcgcctcccaggttcaagtgatgctgctgcctcagcctcctgagtagctgggattacaggcctgtaccaccatgcctggctaatttttgtatttttagtagagacagggtttcagcatgttggccaggctggtcttgaactcctgacctcaggtgatctcccagtctcagcctcccaaagtgctgggattacaggcatgagccactgcscccggcctttactttagagtctcccagacatttcctagtcattcaagcaatacctttacaatttaaccagctggactatcacatacttaatatttttctttcaaatcatttttcattcattttgtttaacctaagcaataatacctgaagtcatgggtttgatggactacttatgtattttcaagtgcccattaagataacaaaatattaaaatgagaaaagattattcatctactctctaagatttccttagttaccaccagttgcacatttggcactctaagaaacaattgctttactggattcctgcacctgcagcctcctgcactttttgagtgatactctgttgatgtttcctttgtctttcctcagacaggagctatactccagracactgtggaatctctcagcaagacctggtgtgctcaggattccagcttagcttatgagagagcttttctggcagtgtcagtgaaacttcttgagtacatggctcacattgctcctgaagtagtgggacaggtggctatccccatgacgggtatgatcaatgggaaccaagccatccgggagttcatccagggccagggaggttgggtaagtttgttggggctcctggttttgctaggtatttgcactgtttttgtactaatacctgggattccaattcatgaccctttttgtaaattggaaaccaacaggaaaacaggcttccctattttgctgaaaatgcctagattttcttgccatggaaaaatggagcagacagaagctcagcctgtggatgttggactcgagtcatgctaccttaaatattgactgctgactactgtaaagctaatcttcatttcctacacataatcatctataaagtatattcatgatagagttctaatttcagcctggcttcactcsgttcctttgtaaatttctgggtctttttttcctaacttctctatgtgtgtgttagggaagtcagaatcaccttaatagtatctaagaaaaaacagtctttgctgtagtggtaactatataaggtattctaagcccatgttttagtaatcatcagaacttatgctgtcatagagcactcctttccatttacagggtcagtgaaagccttaataagagctacatttcctggagctatctgcagatcatttcctggtttcttaggaagttcctgaaagcaattcctttgactgtaggattttctctgtcttccctaggaaaatctggagagctgaagagttggagctattcacgagactgaacatcacttccttgttgactgattgggtgattgattcctgggaattcaaacaaacaaataaaaaarcacttttttcattttatcagaactgaacttagctgaataagttattttttactgattgttaaagttgggagcagctgccagaggcctgcagagttggtttttgttttttttgttttgtcaacttaatgcaaaccacagagattttctactttctgttttcacatgagttttaatgaggttctgttgaagcaaagacccctagacacaaagtaatgacttgttagtagtggaattataagcaacagggcaggcctttgctggaggtattttgagagaaagggagaacaatggaaactatttcttcagatgtagccctgtcttttggtaagaattgtgcctactaattttgcaatttaaaggatttcaggaagctttttggttgaaaaatcttgtttttttttttttagacgtagtctcactctgtcacccaggctggagtgcagtggtgcgatctcagctcactgcaagctccacctcccggtttcactccattctcctgcctcagcctcctgagtagctgggactacaggagcccgccatcacgcccggctaattttttgtatttttagtagagatgaggtttcgccgtgttagccaggatggtctggatctcctgacctcgtgattcgcccgccttggcctcccaaagtgctgggattacaggcgtgagccacctcgcccggcctaaaatcttgttattttaagttgagcattttcattcaaaatcatccctaaacttcatgttaatttcacctgagaaggactattttatgcattttagaggttggaagcaaaaaacaaacaaacaaacaaaaacagttgtttctactaggaaggtcaaagaaaataaaagttactccatttttactgccacaggatgcaggaagtgctggcccacatctaggacagcaaggccaccccagcttagatgaagctagctgcataacacaaagctttaaaagtgtggttcacacaccacttgtggaccttattgaattgctgattcgcattcctagagattctgattctgtaggggtaggctggagcctaggaacctaccttttaaactagttccataggtgattctgatgtacatatagagtgtgacagccatcactatagagaatagattgataaattacaacccacgcgtcaaatctggcttgctgtcttattttgtaaataaagttttattggaatagagcaacattcacttgtttacatattgtccatggccgcttttgtgctacaatggcagagttgaatgattatagaagaccatatggctggttaagtccaaaatatttactagctggccctttacagaaaaagttggctgaccccttctctaaatcaacatttctccttggtaactgaaactctattacagtcctgacaattccagcaaacacagctgtagatagggtttaaactcaaagatatttaactcttctttgggaacttagtctccatatgtttgttagttcttgcataatccacagtttctctgggtcttcagccaatcagagagctctgtagctcctgagtagtccatttctctggccctacaagtgagagtgattggaagcaaagcttatgatttgtatgatcttgtatctcaaaatagtccttaatgatctaatagattagtaggcagtcatcaggtagagactccaaaaaccagactactttcctaaatatcaagaagaaaggcattgctacagtgattcatgaaaagcagcattaataactttggctaaagtttaacaaagctaaccacttcccctctatcagccagccatctatgtatctcctctaaatgcagagaagtaaatatgtagtgctgttaatacatttttgctttttaaagttatgctttgtcctggcgcagtggctcatgcctgtaatcccagcactttgggaggccaaggcgggtggatcacctgaggttaggagtttgagaccagcctggccaacatggtgaaaccctgtctctgctaaaaatacaaaaaattagccaggcttggtggcacgtgcctgtaatgccagctactcaggaggctgaggcaggagaatcacttgaacctgggaggcggaggttgctgtgagctgagttcgcgccattgcactccagcctgggctacaaaagcgaaactgtctaaaaaaaaaaaaagaaaataaataaagttatgctttttcctctattcctagttaaatcacaacaagttagtaatccataaatgatgtgtcctgtttctctttagtagaaattatatttttggctaccagttaagaaacttgtactcctttgtcccttatgttactataaactcaagatgatgagttttgtggtatttgacttcataggcaaaatcaaaatttttactttgttgctattctgttttatgaaataaacttctgtctatgcatttgaactaagtttcagcaaattcaatctaaattgaataattccagctcccagttttatcctatgttgctcataaaacagttccaagtatactgcattatcttgagatttgaagatatggtgcccacggggattatactaggcaaatgcgttaagcagctctggcctaggtgttgtgtattttaagagactctatcttaggagagcttaagtgattgggctgcaggaagaagacattgtaacccaggaattaaaaatggattcagattgcctgattttaacactttagtttcaccataggctaattatgtgacattgggcaagagacataattcttctgtaccttagtttctacatttgtaaaatagagatgatttggtaacttattaataagatttttgtgagagataaataaaacaaatacattttgtaaagggtgagtacttggaatattttaaacactgtgccattagcaatttggaattctgtgttatgcagttcataaggttctagcttgacttttttctctctccattaaccctgtctctcacagatgcaaaccactcttaatggctttactttcacatcaatgtgagtgattcctaaatatgatttatttcccttctcaattccatacccacagatgcttattatttatttatgtgtacctttcttatccccatactctccctgtttgcgatacaactagctcaaaacctcagtcatttttaccttgtctctctctctccagtccaactcacccaactagtttttctcatttgttacttcatttttgtcctggttcttctaccagatttattagcaactgcctggactattaataaagcctcctacttaggctttcaatagattgttctgttcctgctccattccagtctgtcctatatactgccatcagattgatcaaagctgtggtttctttgtctattattttgattcatttttagatatggtatcattcatttttaaatttaacataccaatgaagattacaagacttaaacatcttatcagaagggggcatttattttttaaatcaagaaataactttccaaaagcattgctttgaatgccattctcttaaagtccttcagtggaacttttgagtgtgattagacatgttcattatcttgattgtagtgattttatgggtgatgatttcacaccaacttatcaaactgcatactttgaaatgtgtagtttattgtacatcagcactaccttaataaggttgtttttttttaaaaaaaaaaaaaaaccttcagctgctccctactgttcatcaaataacagtctgatattcaaattcccccagtatctggccctaactgccctatatagccttaatcaatcatgattctcctctacaatcccaatgctctagtataaccgagccagtcactaaagctgccctcctcctactgttccctatgtttcatattgctttttctgaggctctacctgtagacatcttcaagacccaacccaactgtcatgaagccttctccatgaaggctatccatataaccagaataagaagtggtctttgcctccttgaacttttgtttgtaccacttttatgtttcttatccaaaaaatggccttaagttgtaattatctgtatagtcatcttccccactaggataaaggattgctgaatgatacaatttgttgtatacttctgtaacacccctcctcttcattatctggcatgtacatcgatattaaaaatattcattaaatgaatgaatagctgattgactcagatgagacttcaagtttgattatatttgaaaaggatgctaagctttaagagtcctgatgctctttattttaaaaaaaaaatgcttcaggctgggctcggtggctcacgcctgtaatctcagcacttttgggaggccaaggcgggtggatcacctgaggtcaggagttcaagaccagcttggccaacatggtgaaaccccatctctactaataatacaaaaattagctgggcgtggtggcacatgcctgtcatcccagccactcaggaggctgacgcagaagaattgcttgaacccaggaggcggaggttgcagtgagccgagatagcaccattgcacaccagcctgggtgacaacagcaaaactctgtctccaaaaaaaaaaaaaaaacttcaattgcaagttattggttgacctttgcttcttgaggattttgaaaccaaaggcagagtatgcttccctgtgtagtgggaggttgactatgaagtctgcagcaggtgaactgaaggacttagtgaagtctcagaatgctgtagtgacaagcagtagattgaaagatgggtagggggacttttcctacccgggatgatgtgaaaacatgagaaaatcaaacaagcttcgttaaaggtattttataagcctcttctgtgttcatttataaaaggaaaaacaagcctactctagagataaaggaggtcatttatttctggccattgcagttcttcagagatggactctgaagctcagtattgacaccattcctttcataataatagccctgctgcttgggcagcagcattcaggaaagtaccctttgccaggttcctgtgcctccatgtaggaaggcccatctgctcctggcataatgaaagtgcctagctagagacaagaagcacagactgtgccagacaagagacttggagtaattgatataatgagtaaccaagtgagagtagatccctcaccaaagcgtaaccacattagctactttatcacaacagacttatttttaggtatactcaagaccatgttaagcactgtgggttatacaaacgcatagaatacactatcattgcctttgataaatctgaaaatacaggggacatcttttgaataaactcttaaataaacttataggagacaaggaaattgaataaatgaaaacttctatagctgaatatacagatttatattgaagagattcagactaagggaagatcatggcgaaacagaggtaggggcaagatttttgaagaaaaattgagctttatggttttattttcattgtggtgaaacttaggggtaaaggtgagaagtagaaaaaagtggtagtagaacgaacgaggtctgtaggtgatgtgcttggataggttgggtggggatagttgacagggaggggcttggtgacaagctaaggaatctggacttgttcccgtagatcatcaataactattctgattctttagcattaaagtgcagttttaagaactttcatccagccttggttaacaggagatactagaatggaaacatatagataggaagatactctaagtttattgctataggaatccgggtgtgaaagtgggaatggggctaagtgggaatggaaaagacaggttgaatctaaaagacattgaggagaaatttccaataggccttggtgatcaaaagaatgcttacaaaggactgaatgtttcacagacagtatatatatcccatatcaaatcaatgaccctggaatgtagggaaaggcaagagtagtgaaactaaagctaaggttgggtaagtatcttctccagggt

SEQ ID NO: 12396 - DNA, 20866 bp, Homo sapiens
taaccatgctttattccaaatatgagggttgctcctcctcctgtacttgaaatccttcaaaacttggctcaacagctgttttcagtttttgagtcactccagcctttcaaattccagacagggtactatgaaaaagtctgtaagatttaggaattattctgtgttggtctacattcagcacaatacatagcccatagcagaagctcaataaatgactggtggattaacataggactttgagtcaggaaagctggatttcagtcccatttctaaaactatgtgcccttttggcaatttgataactgtttttgtgcctgagtttcttcatctttaaaatgaagttaatgacatttgtctacttttcctgactgtctcacgatactgtggtaagatgatgtataggaaagcattttggatagaagacaacaacaattttaagtattgtagtttgtgttacctgtattctccatcctggaagatacagcaacaccaatcttgaccaaaaaaaaacaaaaaacaaaaaaaaactctcttcccccgtgtttgtagtcactgacccaattatttagtgcatagtactttgcttctgaagcaagattcatgccctttgctctctatggttcctctaaccacagttttcttgctggctggtctaggttctcaagaaggaaaaggagcagacacctacctatggcaaagatggcagcctgtgcaaagtccgcagacacatccgtgcagtaccctcgaagctcctctagcacctgctgcacattctcatcgttcaccagttcacacagcacctccactttctgtagtttgatgtagtggggctccgagtaggagcaaaaaaactttttgtagtggctgctaaagtgacctggtaaactatgcaagatctggcgtacatgacaaagagcaacaaaacagagctcacggctctctgaagaacaggcagctagcaaaggtcccttgacccgcacaaggacatcagtttgtacgtggggaaacatttttgccaagatcagaaaaagtttggtagctcccatcaccacacctgggctactgctcttgaggaaactatccaacagattgagaatgtcaaatagttcttcctcactgcggggttggtagcgtagcagaaagttcaatacttcagcctggccccattggtccagttttgacattctatccaaaaaasaaaacaaaagagctattttagcaacaaaattaggaccatttccatgccactgccatatgaccaggtggttgttcatcatagcaaagggagaattcttaaaaataggctgtgccataattaagtcacttttcatgtactatttaaagtttacacaaaaaaggcttaaaattccaagatgagttgttaatacaaatgcacactcctctaagaccaaagacatgatcagcatacactgggtccaggttccttacattttaagacactataaatggcttagtttgggggacatgactagagaagggtagaacctattcccacagtatatttctatttccctatatcaataagggaaagtaaggcaaataaaagaaattctctcagtggaatgtgagggagttaatagtggttaactggccgggcgcagtggctcacgtctgtaatcccagcactttgggaggctgaggcgggcggatcacctgaggtcagaagtttgggaccagcctgaccaacatggtgaaaccctgtctctactaaaaatacaaaattagccgggcatggtggcgcatgcctataatcccagctactcgggaggctgaggcaggagaattgcttgaacccaggaggcggaggttgcggtaagccgagatagcgccattgcactccagcttagacaacaagagcaaaactccgtctcaaataataataataataatggttaactttcttttctaccccacataagttgttcaatactttaatacatcaacaagatcccacaaggtagcagatctcataataaaaagagtgctgaggcatccaaaccgatttaagagatggtgagcaatgggcttattgatgacaacrcctccttcctgtttcagaatttcctctagagacctcaagcagttcacaactacaattggatcctggtcacgcagcaaactgtataattcatttaccagggcaccatctataaaaaagaacaaagttcttagataaagaaggaaagcttcagagtaacaaggatgtagccagagtaatagctccaggtagacaaagttgaacttctctgctacaaaaatgacaaaggccacactaaagtgcaaggcaaaaaaaaaactgccatgtccagactgttctaagcagctaatacaaaggatctcattggggccccagagaaaggacttctcatctccagaagataccaagccctgcatcctacttaaagagatatgtacagaactggggccacattattattttctaccaaagccacacaatcttttttaaagttatacataatggaggcacattgaccatgatggattacactgaacttacctacttcagagtctccatgaagattatgcatcttggcacatccaaggactgccactctcctgacatakgaagccttatcccgcagaccattgagaataggctgttgtatatactcctgcacaccaggcatcctaagcaacacatcctggagttagccagattctgaaatactaattttgacatacctcagcccctgttcacctaacagatggtttagtagatgctgcacccatcagatcatgaagaattgcagaaagcctctatcaagcttaaaaagccataatttgacttttctgtttttttcttgtttttttcaagatggggtctcactttgtcacccagtggcccgatcatagctcactgctgccttgaattcccgggcccaagccatcctcctgcctcagccttcctagtagctgagactacaggtgcgtgtcaccatgcccatttaattttttgtagatataggctctcaccatcttgcccagctggtctcaaattcctgggctcaagcaatcttcctgtctaagcctcccaaagtgctgggtctacaggcatgagccactgtgcccagcctaatttgacttttcatttggaataatgatgcacaggcagcaaaaaaagatatacacataattgtttagagatatttaaccaaaactgaggactattttacttagagtgagaatcaaaaactccctctaataaaattatatgatacaggttattaagccaaagcagtggctgaaaatctgagttcagggtacaataatgttttccccagtattaaggagctcaaataaattatcctctttaaaaacctaccctgtgatcacttgaattcatcagccatttaggaccagacagagaagagggtactcacctgaggctacacatgctccgtaacgccagccctcgcaccattggattggggtctgagcagtctttgcacagcgtattgatggccaggagagccagatcyggtttcaggggagcatatgtgcacatgtacagataaaccaacttcttctggacaatatctacagtggcactggccttcaccatttccataaaaacaccagacatgtccaagccttgagtcatgtacctgaacaacgcacatgacagaaggaagtaaaatgcaaaatccccaacttacaatggagggagttttacttacatatctcctgattacccaactagattgtgatctcttagagggtagcagccaggattaccttgtctattatatcacacagtacttcataccataggcctacaataaacattattcttctattcattcaacaaacacttattattatttttgagacagagtcttgctctgttacccaggctagagtgcagtggcacaatctcggctcattataagctccgcttcccaggttcaagcgattctcctgcctcagcctcccgagtagctgggactacaggtgcgtgccaccacgcccagctaatttttgtatttttagtagagacggggtttctccatgttggccaggctggtctcgaactcctgactgcaggtgatccacccgccttggcctcccaaagtgctgggattaccagcgtgagccaccgcacccagcctcaacaaacacttattgaatccctagtactttggtgaaattcaacttttacatccagggacatgctcttgggacataatcttgaagaaggtgtggtctcaaacctctaggaacttcaaatctattaatgagccagatgagaataccgttaattacagtatgatagataagtacttaaacagaagtattgtacaaggtgtagaggggattcagaggtctgacactggcaggaagtcagaaaatgtttcttcacagaggaagtaatactttagctgaatgagcaggagctcactaggcagatgtaatagcaaggtaaagatacatgctatgaggtaagtagacatgagcaggagcagcacacatttttttaagagtctgtaggtagttgaattaacagcttgttccttgggtgctgtgataagtttggactttattgtttctcagactggtctcctactggaaccaactgaaatgtttattaaaaatacagattcctgggttccctcccaccctactgaaatcagaatcagtccctggactggatgacaaaaagcaccccaagggatttttatgcatagtaaagtttgtgaaccatagctgtaggcaagagttatgtgttcaggtatgtataatggaaaaattctgtctcaaatgaggcaaagtggcctactagtaagctgctgcaattgctttattgatgaaggcctggaccagaacaacaatgctaataaacaagagaggatggatatttagaattatgaattcaaaccatctgacataagaagtgagagatcaggtgtcctcaaggttggctcccacgcatagtcggctgctggtggcattcatcaacacaaatgtaagctgaacaggtttgaggaagacggaagaatgtccgggctatttcggacatacttttgataaaccacgcacgtggaaatgccaagcaggcagtgggatacgtgggtctgaagctaaaaaaggaagtctgtactagctatattatagatccaagagtcaccagtaattgctcaagcccgtgatatggaggaaactayccagctgagtaaaagatgctgcagaggggagactgacatggtactccaaagcagcaggacgaagaccgaaccatataactgccacgtgtgaaagctaattcaccctttcagagagactggggctagtgagccctgatggggattgcaaagggagcagttagcacgcgaagggaggtaggtgatacctaatcactcgctggatgacattccggtagcgcagcctatcagcttgaatgtgaggattgcacagagccttcttcagctccttcaccacgtcctcggagccaaggtacggcatcttcctaagagtcacagggcagctcccacagctcccacggtaactcgagggctccttctcgtcctgatgtgggagcctgagtaaaggaaatatgagtcagtgaaaatacaaaaggcgagatctcgcctcaggctcggcttccgtagggccggcacgctggccctgacacacttccacgccctccgcgacaccgcgagccccaccctaggctcttcaggccctaccgtcggccggcaggccgttcgccccgcccacagatcgctcccgctacttctaggtcctccgccggatttccagcgccgcgtccgactgaccgcagacccctccctctccagttccagccttaattccccctccacgccgttctcatcgcggataggcccaatcttgctttctgcggaagtcccgcccccttgtcaagagaccaaacagaagagcgctgccggtctccccgcgagcgagcgctaagcgtagtcccgactccgaccttaggatgcccttcccccaacctctcactctccaggcgcagctgcgcggctccctctggtggagctgcggcgggcaatcggaaatckgctactttggcctgtctcctccctgcagcgcgcgctttgagtgcccggctcggcctccgctcccgcgcggttgggagtgtccagcgccctccgcgatttgggctccagcgggcagggtgacttcctttttctgcccactctggtaacttattgctctgctgggctctttcccttagggtctctggccctgttcttgccccagcatgacttttatcgggacgccgttgtggaagcctcacgcaggagccctgcccccgtggagaagatcccactggtgactccraccctaccaccatgaatggggtyctgatcccccatacgcccatcgcagtggacttctggagcctgcgccgggctggcaccgcacgtctcttcttcttgtctcacatgcactcggaccacaccgtgggcctgtctagcacctgggccckgcccctctactgctccccaattacagcccacctcttgcatcgtyacctacaggtatggggctggagtcggtctccgagagctggtccaggcatctgggttgggacttcaacctgtcattcttggagtcatagaatgggggccacgaaaactgatttggaagttgtttgaacccaaaaatgcatctttaacccagaataggaacgtgttttcgaagtgaccaacttgagatagttagccataagttgagragatattttaatccagccaaggaaactattcctacctttataagtaagctaggccgatgtttcccaaacttgccttttttttttttttttttttttttttgagacggagtctcgytctgttgcccaggctggagtgcagtggcgcaatctcggctyactgcagcctccgcctcccgggttcaagcgattctcctgtctcggcctcctgagtagctgagattacaggcgcacgccaccacgcccagctaattttttgtattttttgtggagacggggtttcaccatgttggccaggctgttctctaactcctgaccttaagtgatccgcccgcctcagcctccccaagtgctgggattacaagcgtgagccaccacgccccgcctaaacttgcctcatcttaagaatccacctaatgtgctgggtggttctccagctctctccccaccccacccttaagtctccaagagattaagatcaggagtaagtttgggaattgctgactagactgtttgctgaactctttttttttttttttgagatggagtctcgctctgtcgcccaggctggagtgcagtggcgcaaactcggctcactgcaagctccgcctcccgggttcacgccattctcctgcctcagcctcccgagtagctgggactacaggcgcccgccaccacgcctggctaattttttttgtattttttagtagagacggggtttcaccgtgttagccaggatggtctcgatctcctgacctcgtgatccacccgcctcagcctcccaaagtgctgggattacaggcgtgagccaccacgcccggccagctgaactcttaaattgtacaaagggtgggatgggaagtggaaggaggaagggcagattgcttgggaatccccattacagcttctgctcccggtggctcaggatttggtcagctttcctgattcatgtaagggatagtccctgacccggggaggtaacggagaggagtcagtggtcactgggatgactaactgttttctcaggtatctaagcaatggatccaagccctggaggttggtgagagccaygtattacccctagatgaaattggacaagagaccatgaccgtaaccctcctcgatgccaatcactgtcctggttctgtcatgtttctctttgaaggatattttggaaccatcctctacacaggtgggcctctcaaggaatcccagtgacttctccagactagatgtwttttttwtttttttttttttttttttttaatgtatagactggggcctcgcagtgttgcygaggctggtctcaaactcctgacctcaagcartcctcccgcttcagcctccacagtagctaggattattggcacaagccaccacacctggcagacttttcttgagcagccttaactcaatagaagtctggaggcgctggaggccttctaacttcatcacatatgagcatagtgaccccatctcaactgatttcccactgtttttttttccttcttctttttgagacggagtttcactcttgtcacccaggctggagtgcagtggcgtgattgtggctcactgcaacctccrccttctgggttcaagtgattctcttgcctcagcctcccaagtagctgggatgacaggcgcctgccaccacgcccagctaattttcgtatttactattagtagagacggggtttcaccatgttggccaggctggtctcgaactcctgacctcaggtgatccacctggctcggccccccaaagtgctgggattacaggtgtgagccactgcgcctggccgatttcccactctttaagggtccgaaccttgtgaagagtaattgaaaaataggagtaggatggagacattacaacaaagaaaccatgcagctatactgcctagttcagtgccaggctacataatagttttttcacagactagtaagcaaacgcctgtctattgttggaggtaggagaggcttgtcttctattcttttgtctctgaccttctgcccccatgtacatattcctccaggtgattttcgatacacaccatccatgctaaaggagccagccctgacactggggaaacagatccatactttatacctagacaacaccaattgcaatccagccctggttcttccttcccgacaagaagctgcccaccagattgtccagctcattcgaaaacacccacaacataacataaagattggtgagttgtttcctttcagtttcctgtcacctgtagatagtgaactagattctttaaggattctcacatctttcagatctttgtgcagttctcactttctcctacactgaccaccttatttaaaattgcaacctggctaggtgtggtggttcatgcctataatcccagcactttgggaggccaagatgggagggtcatttgagcccaggcgtttgagaccagcttgggcaacatggcaagaccctgtctctacaaaaaatttaaaaatcagttgggcacgatggtgcgtgcctgtggtcccagctacacaggggactgagacaggaggattgcctgggtccagtaggaggtcaaggttgcagtgagccatgtaagtgccattgcactccagcctggatgacagagcaagaccctgtctcaataaatgaatgaatgaatgaaataagtaaaactgcaacctgcccaccatccccattcccaactcctgatcatcyataccaattcatttttttcatttttttatagcactcatatactatatatatttttaaatatgctattgcttacttgttgtctatcatgcacttcctctggcccatgcacatacgcgtgcacacacacacacacacaagcataaactccttaagagcatcactggaaatgggaagagactttgtgtgtttgtggaacagagaagcagcagtcagtatgacaggcacacagtgggcaaggaggctgaaaaggcaagaggggctgaagtgctgttaagccattttggacttgatcctaaacccaaccaagagctattgaaggattttaagtagaagagggacaatatgcactcatcaccttgcaatatattctataatttatgtatttattggactttttattgtctgattccccctgctagaatgtgaattccactatggcagkctctgttttattatgggtgtatcacaaatgcctacactaatgcctgacacagaagcattcaatatgaatgaatgaaatttatcagaacatagatatttaagtgagcgttgtgctttaaattaagtatactgaaaaaacaggtttgtgcttgttgtactgattataaatagtataaaacattgttgaggactctttcttggagttgccatttggaatagtttatgaaaatacatttttgttttataaaataaataaatgtaatagatttggttctaaattacttttttggttgtttccaaatttgtgagyctacaaaaggacaaagacttgccaccattataaatatttgaaaaggacatgtctcaactctgaaaggagtttcaaaatgagactaaacaaaggcattgaaaaaattatataacttccagggtgactaccaaatcgattgagaaatatcctctactctcaggattgcttagctacttataaagacctaaccattcttaatattttaatgcagaattttctcaaaaaagcaaagctggctaggaggatgctatagtaagccttaattaattttgcaaatatgtaataagcctctacccactaagtaccaagtatccaataggcagtggggatataaagatgaataaaatatagtctctgacttggagggctcacagtctggtagggaaggacctgtggggaggtggaagtgggaatatatatagagagaagaaaaatccgctccatttgtgcccaaggagtgagattttgaaccataatcaggaataaagtggatataaataatatatacttctttttatggcgttcacaatctggttgtggatttgaaacttcttcagaaaaagtctgagaacagctattaaacaacatctcccatatctgttaccataaccatttcccaaattaatgtctccatttctttctctgtaagtactatttgggcccttcaattgaaacttccactccagcttcttctcatcctggcagtcaaataatattattaccatatttttctttttaaagccctgctctgagcatattattcttatgattagaattagccattttcctgcttcacactcagtggctccccttcacttacacaatgaagtccaagcttcttagcggtacatataagacgctctattatatggcccttgcttgcctctctggtatcatttcttatcaattccttttttactttagtaacagcaaactgacccctcttaaaatgttttccactataccctttctaccctttccttgccaggttaaccttgcccatcctttaagatttagcctaacgttccctaactccatcacctgttagatacaatactgtatactttttttgtttttttttaagagacagggtctcactctgttgcccaggctggagggtagtggcatgatcacagctcactgcagcctggacctcccggactcaagtgatcctcccgcgtcagcttcctgtgtaccaggaactataggcgtgcaccaacatgcttatttgtttatttttgtagagacagggtcttgccaggttgcccaggttggtcttgaactcctgggctcaagcaatcctcctgcctcagcctcctaaaattgtaggcttacaggtgtgagccacagtgcccggcctgtacacatatctttaacgttgctcttaattgtggtttttctgggtctccttgtagatagtacttcttgaggactgacagttttctttattagttttcatggtgcctgaaacttgctagatgctctcttttgttgaactaaatgaatgagtggattctgtgtcattccctttcatatgtcttagctcaaatgccacctcttccttgatattctccctggatttctccatgaattgtatctatttttgttaaacattttgttgatttattaggattttccaatagcttaattttcttccttctcttactttccccaatacattgaacattatttaggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattccggactctgtacagcaatacatgagttcttcctctagaaaaccaagccttctctggctgttagaaaggaggctaaagaggccgagaacccaaggtgttgtgtttgaatcccctgaggaaagtgctgatcaatctcaagctgacagagactcaaagaaggccaagaaagagaaactttctccctggcctgcggaccttgaaaagcagccttcccaccatcctttgcggatcaagaagcagttgttcccagatctctatagcaaagaatggaacaaggcagtgcctttctgtgagtctcaaaagagggtgactatgttgacggccccactgggattttcagtgcacttaaggtctacagatgaggagtttatttctcaaaaaaccagggaggaaattggtttagggtcccccttggtacccatgggaratgatgatggaggtccagaagccacagggaatcagagtgcctggatgggccatggttctcccctgtcccacagcagcaagggcacccctcttctagctactgaattcaggggtctagcactcaaatatcttctgactccagtgwactttttccaggcagggtattcttccaggagatttgaccagcaagtggaaaaataccataaaccctgctgaagacaggagagtacagaatgacaacattgagcccacactgcagttttgaagatagtaactgatggctggtgggaaagagtttgtttttggggcctacttttctatctttacaagactcttatgggcccaccgtggagcagcacttcccaaaacttgttcactggggtcctcgtgcctatggaatccttctttttataactaagtttaagaaatactttttttataaaatctttggagtatgcgtgagcaaattaaaagttctttgaagtcctacagtaacttaatctgtttaaccttgtttaacccagtatttctcaaacttttgtgaacatgcaatcatcttatgtgggtacagaaagaggtaaagagtctgaatcaaaaaggaccaggttattgctgttgctgttttgtggtgtcatgagccattctccatgtccccttctccctcttctcagatcaaaatccctagggagttctatttttaaaattatgaactatggcgctgcatgcttcaatcctgaacgtcactgacttgctgtgaccatccaaataattttcctgtctctgcctctgggagggaacaggaagcgatgaagaggtcttggaacagtagtgaaaattctacctctatgtccttcatgaggatgtgcagtatcccagtatcactgggatccatgtggaacagagccagctggggggttgggcagctctctccaaggcagtacctagagcccagctgaacaacaaggctttgggtgtgaagggactccccagcctggagaccctatttggctgaaacagttacaaaatatcaaatgtgttgtcagatattcctccaattgttcacatagctgggatatttgttgctcccctcaccccttggattatgtagggagccagtgcacacagcctgtttgttttagtatccaaggaagagaccaaggagccagctggcgggaaggggtgggggtgtgcagtctgccctgtccttctgctcataacctgacaaaatgccaaactagtaagcaggatagctgataccacggctatgagggagtaggctctgagagggcacagacttgtggagctgggcrtctggatcaaaactgctttgggatggaacctcgagccctagcagtgaagaagattccatttcttgtccaggggatttaaaagagttttctgctttgagagagaaatagagagtttagaaagcaattgctcttgggaaagctatacacagctctgttttgtcaatgacctttgttgtaagtctcccaacgtcctattaggagccacagcaggtgaggcatttggtgcagcaggaaacatggggactgcctaggctcgaatctgtggcaccctgagcaattacttaaattgtggagcctagttcctcatctgtaagatggacttgagattcctacctctcatgattactatggagattgaataattggtaaaattctcctagctcagtgactgccacakgatgggtctttcagattttggttctctttagcttctggttcttgaaagaaattaatctgtatataacataagaaactttgaaagtmaaaaaaamaaaaaattttaattcctcgtagattaattgatttgctatcttttagtttttttttctatgcatgtagatgtattaaatatgtaaatgtttttcaaagttgaggtaatattgtatagaattttatagcctacattttaatttcttgatatcttaagcatttcacttattagatattgttcaaaaatgccatttttaatatttgtataataccctatcatgtgagtataccttaactaagccattcccatattcaacattttgtgtactgtttttctaattacatatattacaatgaacaaccttatgcatatattttgcatttttatttccttaaagtaaattactggagttagattatagttttaagttcttgataccaattgtgctgaattgccctccagaaaggtttcctgaccatcttttctgcagacaggatagcattaaaataccttgaagactcattagtttaaatgagatcacaagaacggtacatgttaacacatggaaaatcatctcatgtgttaacttaataaatagctactaaactgtgtgggcaaatttagctggacttcctctagcatcctctagctgtctgacttctaggcggccgaaggtggctgggagagataaggtagttctcagtacaggggttcccatattggcgttatcttctagcaacaagggagcccgtctactcttggcacatgctgtgtcacacctgttccttcaagtgggttctatatgcattcagataggggaggggaagcaaaagactttgaggaatttagttgttggtagcatgtttgcatttgtttgtttggcttttttttggagacaggttttagctctgtcactcaggctggagtgcagtggcacagccataactcactgcagcctcgacctcccaggctcaagagattctcccacctgagcctcttgagtacctgggactataggcatgcaccaccatgcccaactaatttttttttttttttttttttgtagagatgaagtttcactatgttgcccaggctggtcttggtgttgaactcctggcctcaagtgatcccccctaccttggcctcccaaagtgctgggattacaggcatgagcccgtgtgcccagccatgtttgtgttttcataatgggaaaattccatactattctaaaagaaaaaatgtctgccttcttatactagagattagcagttgtttgattttccaatagtccctcatataaaaatgctgcattgcatatactttacatagccaatttaaattatttttagaatctaaagatgatcctatagatgtatgaagatattgcaattaggcttgaaggtgctgggaaaaaggaggttccctagagatmcattagttatttaatggatgatctgtgggagaacttgtacttttccacaaggtgactgacaatggcttaagtccccttacagaaaaaaaatctgcctggctggtgttgggaggccatctcttactcttgacccagattgccctttgtggtaggaaacagatgagtgactccacttgttcttctcttttctttttctttcttcctttctttttttttttttttttttttgaggagtctcactctgttgcccaggctggatgcaatggcactgtcttggctcaccacaacctctgcctcctgggttcaattctcttgcctcagcctcccaagtagctgcgattacaggcgtgcactgccacacctggctaatttttgtatttttagtagagatggggtttcaccatgttggccaggctggtctcgaactcctgacctcaggtgatccgcccacctaggcctcccaaagtgcagggatcacaggtgtgagccaccgtgcccagcccagcccatgtgcatatattttcgatgttaccatcagtgagcacctgtcagtgtattagctgcctcccacccctcatgctcctcagccaccaccaaccaccacaagctgttttgtcttagactcatggtgctttcccttttctcttccccaggggatcccacctatacctgaacagaatgatgctgctctcccttataaacatctgagtctaacagctgcctgtgagggattctcagaatggttaagcttgtctttatcttgaccacaatgcctacccttcatttagctctacccttccatcttgactgtctcattcctgggtaactttgtcttctttgaacatagccttgacctactggatcacaaaaagctcccaggattctgggcttggttcttctggataaatagcttattgaatcatctttcaatcacacaaaatttctggctagccttgggttcgcctgtgtcttacattatttacactattgtattatggctatcttaccagtcctgtctcctctggttaatttataacaactttggagagtgtgggatgaaaaattggtcccctgtgctactccatcctcaatgtgctcattgaaatgtgtgtttttgaggagcgaaggaaattgggttaagctcactcaccctactaattaggctttgtggagacaaagcaccagagcaagagcagatgcctgctgtttagggagtcagggatacaaagtttggagaaaacatgtcttcaggaggaaaggaaagctttgatcagctgaatttcttcaaattcccacccatcttccaggctcataccatctgctttctaatttccctctcaatggtgggataaaaatccttcaatcacctcttactaagaacattttctctgctcatacacattcaagaacccaaactattcagaacattttaggtccacatgatacaaggcccaacctatccttccagccttatctcccaggattctcccagtgcacacaatagtaggccatagtggaaaagatggattttcaagttagatgtcttgggttggaatcgtgatcctgtgacttactagctgtgtatataatctctagcaagctactcagctttccagcttaaagttcctttttgtagagtgggaataataatgcctacctcatagggtttggaggagaatgaaatagaataaagcaactaaagcacttcataagagtatccaatacattaaaaaaaaaaaaaagaaagaaaagaaaaagtttttgcctttggctgggtgcagtggctcatgcctgtaatcccagcactttgggaggccaaggtgggcagatcacctgaggtcaggagttcaagaccagcatggccaatatagtgaaaccccatctctactaaaaatacaaaagttagccgggagtggtggcatgtgcctgtcgtcccagctacttgggaggctaaggcaggagaattgcttgaaccagggaggcaggttgcagtgagccgagatcacaccactgcactccggcatgggcaacacagcaagaccctatcgcagaaaaaaaaaatgtttggcctcaaactccctgacataccttaaatcctgtttacagaggagtgactgacatgtccagtgcatgccctggatagtgccattggctaatcctatctttcaggcccagaaaaatctgagagattggctgatgaaggtacttcctgggggagaggttcctggagtcaagtctaaccaaaagggcagttacctgaagcatccaaggatgcatttgtacagatggaaaaagagtagggtgaaatcatgataagcttcagatgctgtgctgagtaaatttaactgtaaaatcctaaggcaaagccaaaacacctcagaagaataagtagttaatcagaggctcagagaatccaaagaggtgtgcagagcagagcagtctgggctgtgcatttcaaaacattgtgggtaaactaagggccagacactatgcttggtctggttctagattcttctgccacaccagctgtataaaccaacaaccttggatcagtcctggaattctccttttcaactcctacagaaggaaggcagagccactggagaaaagaaccatacaactggtatcactacagatttcagcctctggtattttcaaagctgcttctcatctctttaagtccttgattcacctcctctcccatgtacatcagtggttatgacaaagctttatgactcaaactcttacaacatatgaagccttaggaagacacctttgagcatcaaggataccaagctgcaacaccctggggcaacttccctggaccataagaacaggtctggtcacccagcctcaccctaaaggtggcagaatgaatcccccataccctgtttaaaccgcagtcactgtcaggagttcaagtctttaaggccggattctcagccttccctcccctctttcactaggctctcaagtctcctgctctgtgatcagcaaattcctctatgtcctcagcatcttttctgaaagtatccatcaccctccttgcctaaattgaagactggctctcctctgagcacactgctttccagccagcttctcacatagaggctctttttctctccccccacctcaaggtaagaaggtgacattgatgttctccttattctccttgctgcctcctaaccattattgccatttcttcctgtgaccatctctcctaccatgaagtgcatactatctagctataccatcccctccttcccatcctcacttatcaagacttgagtcattgactcacagccttctcctccttcacaaccctgtcatcattctggatgatttcaataccctggccattcagcttccttgacctcatcttcaaagaccttattctccctctacctcaccaccctgtcattaccagaaattgtactacatctgaagcctcaattttaaactttttctcctggcttatttgctcaagtgcatctgtgggactgacaacaaaatgagacctgagtgatgagccagccaggtgaagacctggtggggaggtctaatttaaaaattgtttttgtagagacgaggtctcactgtgttgccgagagtagggaataggtagagggttcaggcagaatcagcccctgggataggatgggaatgagctttgtgcctaaggaacatgaagaagtgagtgtagagaaatgcaaatcaaaaccacaatgtggtaccatctcacacctgtcagaatggctattattaagaagtcaaaatggtcaggtgcagtggctcacacctgtgatcccagcactttgggagcccaaggcagaaggatcacgaggttaggagttcgagaccagcctggccaaaatagtgaaaccctgtctctactaaaaatacaaaaaatagccaggcatggcggcgggcacctgtagtcccagctactcgggagggtgaggcaggagaattgcttgaatccgggaggcagaggttgcagtgagctgagatcgggccacactgcactccagcctggacaacagagcaagactccgtctcaaaaaaaaaaaaaagtcaaaaaacaacagacgctggtgaggctgcagagaaaagggaacgcttatacactgttggtrggaatgtaaattagttcatccactgtggaaaagagaactactatttgacccagcaatcccattctgggcatatattcaaaggaaaataaatcatcctactaaaaacacacctgcactcatctgtccatcccagcactattcacaatagcaaagacatggaagcaacctaggtgcccatcaacagtggattggttaatggtaacttgtgatgtgtaaaataaaaaaataaaataacccagtggattggataaagaatatgtggtacatatatgccagggaatactatgcagccacacaaagaaagaaatcatgtcctttgcagcaacaatgatgcagctggaggccattatcctaagcaaattaacacggcaacagaaaatcaaatactgcatgcttttatttgtaagtggaagctagacattgggtggtcacagacagaaagatagcaataagagccactggggacaactgggtgggggacaagggttgaaaaactattaggtactatgcttactacctgggtgatgggaatcaatcatacccaaaacctcagtattatgcaatatacctatgaaacaaacctgttatgtgtacctcctgaatctaaaattaaaagttgaaatatatatatttcacacacacacacacacacacacacacacacacacacacacacgggccaggcacggtggctcatgcttgtaatcccagcactttggaagccaaggtgggcagatcacctgaggtcaggagttcgagaccagcctggtcaacgtgatgaaaccctgtctctactaa

SEQ ID NO: 12397 - DNA, 82222 bp, Homo sapiens
  misc_feature (1)...(82222): n = A,T,C or G, or insertion/deletion polymorphism (see Tables 1-2)
ttcctagatgggatggcggccgggcagagacgctcctcacttcccagactgggcagccgggcagaggggctcctcacatcccagacgatgggcagccaggcagagacgctcctcacttcccagacggggtggcagtcgggctgaggctacaatctcggcactttgggaggccaaggcgggcggctgggaggtggaggttgtagctagcgagatcacgccactgcactccagcctgggcaccattgagcactgagtgaacaagactccgtctgccatcccggcacctcgggaggccgaggctggcggatcactcgcggttaggagctggagaccagcccggccaacacagcgaaaccccgtctccaccaaaaaaatacgagaaccagtcaggcgtggcggcgcgcgcctgcaatcgcaggcactcggcaggctgaggcgggagaatcaggcagggaggttgcagtgagccgagatggcggcagtacagtccagcttcggctcggcatcagagggagaccgtggaaagagagggagagggagaccgtggggagagggagagggagaccgtgggggggggagggggagggggagggcgagggctttttttgtttgttttttttgaaatggggtctcactatgttgcccaggctggtctcaaactcctgggatcaaaagcaatactctcacatcatcagcctcctgagtagctggaattacatgcatgtgccactgcacctggcagggatagcttctttcctgcctccgttctggaaaataccatggactgctaaggctgggcctgcctgaatctgttttggcctctggaatccagcccccagcacattgccttgacccttcctcttggcttgctgccttctccagggctgagaataggaagcaacatgctctctctgagcttggtacttcttcacaagtccctttagagaggacactgtttgccagacaatggggttttctcacagggcaggctccgcaggcctttgttaggaggacttcctttaagggcagctggagctggaagacaacccgggccaggggctggccggctgttagggtactgagctcagagctgactgctaggagggacctggggcctggggatggagctgtgggtgtgaagggacacggtggattggaacaggagactgactgagatagagaagatgaggctggagcaaagactggagtcaagataggatgaggtcaggagctggggcagtattagaggaacaagcccgggactgggagaaggcttgagggtcagaactggtcctgggggggcatgtcacacactgctcaggagcccaggcatcagacacaggcagcccgggttccatccctccttcttccctggctatctgggtggtcttcatctcagcccctacttccctcatcttcaatcccctcaccttcgctccactgaacaccctatttaatgccacagtctgctccgctttggtgctcctgtcccccttatctgctccaactccttatccatactcttattgtctttttaaatttttttatttatttatttgtttatttttaagacaacagagtctcgctctgtcacccaggctggagtgcagtggcagaatctcagctcactgcaacctccacctcctgagttcaagcaattctcctgcctcagactcccgagtagctgggactacaggggcgcgccaccatgcccagctaatttttttgtatttttagtagagacagggtttcaccatgttagccaggatgatctggatctcttgacctcgtgatccgcccacctcggtctccaaaagtgctgggattacaggcgtgaacaccctcgcccggcctatttatttatttatttatttatttagagacagagtctccctctgttgcccaggctggagtgtagtggcaccatctcggctcactgcaacctctgcctcccaggttcaagtgattctcccgcctcagcctcctgagtagctgggaatataggtgtgcaccaccaaccccagctaatttttttttttttttttggtatttttagtagatacggggtttctctacgttggccaggctggtctcgaactcctgacctcaagtgatctgcgcaccttggcctcccaaagtactgggattacaggcgtgtgccactgtgcccggcccctgttatcttactaacttacttattaatgtttgttgtttattatctaccttcccaactaaagtgtcagttccgtgaggataaacattctgttttgttcactggtatgtccagttcctagaagggtgcctgctgcagagcaggcatccaataaacatttgttgaatgaataaggttgccaagtctgcctgggataacagcctgctcactggaaaggtgacgatgacaacagtgatggtgctttggtgttgcagggaggagcaagttaaatctcacctataaagatctttccatcaggctgcagacacagagggagtccccagcaacaatagctcatatatgcttcagtttcctcatccgtgaagagagaataaaagtccctacttttattagcgtccaattgccctggccacggcagcattgtcggtttaatgatgctgcttcggctgtcgtagtctcttccacctcatgccttttggttcattttttaactgagttaaaggtggggctgtaggtggcactgggaatcaaatggctgaacttgtgctcaggcctgggcttgagataaaatgacccctttagtccaagcatcaaaacagaccaaggtttcaggcccccttgcctttaaatagatttcagggattattttctccagccctagaccacagctgactcctcaccgcctctccacgaacagacctcagagttttgttttctctgtctctctcctttctttctcctttatctctgtctactgaggtcctggctgtccccctgccccaccctaccctatgctcttgggcttctggcctcatctctaacttagcttctaattttttctcttcttttcctttctttttttgaaacagagtctcactctgtcacccaggctggagtgtagtggcgtgatctcagctcactgcaacctctgcctccagggttcaagcgtttctcgtgcctcagcctcccaagtagctgggactacaggtgtgcgtcaccttgctcggctaatttttatgttttcagtagagacggggtttcaccgtgttggccaggctggtctcaaactccggacctcaggtgatccacctgcctagcctcccaaagtgctgggattacaggcatgagccaccacgcccggcctaacttagcttctaattctaatgcctggtgaacctcttaaatttttttttcccaagacaaagtctcactctgttggccaggctggagtgcaggggtgtgatcatagctcactgcagactctaactcctggacacaagagaccctcccatcttggcctcccaaagtgctgggattacaggcgtgagccaccatgcctggcctgcctagtgaacttgaaggtctagcttgcggcacaggctcatggcatgcacttaacagatacggaataaatggatgaatggaaaaagccctggactgggaatagtaaacctggtaaccaaacccagctctgaccctgacctgtaagtaactactatctctggccttggtgtaccccatgtatagtggggattgtaaacacctgccctgcccaccttatgatactgctgtgagactcaaaagacatcattagctcttaggcacagggagcttggaggttaaatccaatttgcttagttttcaacaaggaagtggtgccccagggacaatgatggagagaaatcgaatgtaatgagctgttgccaccagctgagtggtcctgaaatcatggcatctgggttgcacttagagattgtccagttcaaaaggccagaaggaatctgaacctcgatgggaaaagtgacttgctcagctccccagcaagccagggcagagctggaggatggactggagtctcctggttccaggtccaggacttctttccgctgtgttgacagagccaggaggaggggcacccggggagcaggggaggcaagggctgctggatgccccatctcagttgaattctccttgagggacccagcccaggagcagagtaagagggtttgagggtggaaggtggcagggctggccaagcagtatagtccctgctgctgataaccaatccctgaaatcccgaggtggagggacttgagggcaaatcacagacatgggggacctaatgctggccatgtggctcaaccagaagtgcccgtccctcatagctttggggagatcagaagtcagggatagggtcgggtgtggtggctcatgcctgtaatcccatcactttgggataaggaggcagggggatcacttgagcttaggagttcgagaccagcctgagcaacatagcaaaaccctgttctttacaaaaaaatacaaaaattagccgggcgtggtggtgcacacctgtagtcctggctgctggggaggctgaggtgggaagatcacttgagcccgggaggtcgaggctgcagtgagctgacatcatgctactgcattccagcctaggcaatagagtgggaccctgtctcaaaaaaaaaaaaaaaaaaaagtcaggggtgctggccccatgataggtgcaatgggtgcctccaattccctctggctctgcctcccagcctctgtccaagcaacaggcagattttccatgcctggggacttgcccctggctcactgatgatgataccatcttaagtctcctggaatccttaaacccttccttggcatttgtgagcaagtattgagcccctcccatgttttaggcccagtgctgggtgctttcacctgcaatttcttacagaggatggtatttcctaaactccattcatttgctacctccatgatttttgccatatcacccaacccatgaaatacataaataaatagtatttactcaatattttgactcacttttaaaaaacataaacttatctgaaaagggaacctatgtcacgcctctaaataaacagtatcaaccaaaaatacaaaagaaacaaaaataaatacaaagacattcttggtttctggcaccaggccccagttctggctccaaccttactgagaagtcacatgatctctctgggcctcagttttctcctctggaaaatggagcttttggaagttaatgcatgcacagtgcctggccctgagactggcatggagtgagtggaagagaggttgcctgacctggctaaaattggttctctgggcagacattttcccaagggccactgagaagaccctcctgttaggagtcagtgagctctgtcgctggaggcattcaaacagagcctgcggacttctcactgcgaagttgcccagagaattcagtgctcagaggaaagggagtggttattccatcagagctggttccccaggagcgggagcagggcctgtagcacccagcctctgtccctggctcccgtctatccgggattttagcgtttcctctgtagttttcaagcactgtctcatatgactctcgcaccagcgagaggccaggggagatggtgtctgcctgttaaagaggggcaggctggtccacataggtcaagtgacttggccaaggtcaccagagcagagttttgaacttgagctgtctgactcaactgcctgggaagtgcctgcccctcctctggcatccagggagcatgtcctggggctctggctgggacatagccggacacctgcgggccctttacgtctctaaagagagaaagagggaagggcccctgtctagggggtggtttccctccagatgccacccctccgaggtccccttctgcttcttcttgcggtagccagggaggcagcccacgggcagggaagcgggggtgggggtgcagagtcagaggtgcacgtggacagagacagagagacagggacacgtgggcagagacggataaagacagagacccagagaaagccagatatgttgacagacacagagacagacgccagagaggaaggcagacaaagagacgggtggagacaaagactcccaccaagagacgcagaaggaagatgccgacggtaaagacaaaacaggagacgcgcgcaaggagcaggtcagagcccaggctcgctgagagaggaagggctgggctggggcagcccggaggcagagagaccgagagtgcggggcgggcgagggacgccagggccgcgtcaccccagcccgttcctagctccgctcccggcagggggcgccctggcctcgtggcacgaccggcccgcggggcgcggggctcgggccgggggcggggccggggccgggctggggaggggttggggccgggggcgggggagggggcgggctgcccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcagggggagccccgcgcccccacgcacacccaggcccccggcgcccggagcccggccccggggccgggaaccgcgaccggacgggggaggggtagggcccgggggcggggggggggcgggctgcccgggcctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggtaaggattcgacgctgccccgcgccctggttccccagggccccagcggacgtggtccatccccttctgcatcctccgctggccccgtggttgaactttaatggcagggccggggtctccagcgccacgccgcccacagcagcccattcgggacgccctgcaattggtcctgcccctgtcctcccgcgcatcccaagctcccggcgcgcgctctgggcgggacaggagattggacgtggcgcccgcggagccggcgaactcaggggaccgcgctcgggaccgccctgcagtcccagggtctcctacctcccgagccgctgcctgggaccctgcgctctgtctgggcacctgcccttggtgccccgtgactgagcccctcctggtgcctccttagccgtagctctagagacctgggctgccaaccccaaggcctcgtggcctggcgccctcccaggcgtcccacctgacccggtggggtctaaagcagtttggtttgggaggaggagagggcaggaggcgcttggaatggggggcgtggcgggaggagacagaggacacccgcgtgggtgtcaaagtgtgggcacccactgtgggcaccgcagctgtggggcaaagctctggagcccgcgaagccgaaggagcctgccgccccctttaggctttgcgaggtgggcctcccagggctgcttccctgcccagtcttggtaagaaagggttaaacgcaggtctcagcagaaaggcaggaggccgaggaaagcctcccccactccccattgtgccttatgactctttttcaacacataatggggtcgaaggcggggcctttacaaaggcctctgggtggagggtgaaattccttgagatcaaaagagggggcgattcttgggccaggaagggctttgggccctgggaaaaagtcagaccgctcaggtgggcccagctgcccagggaggcaggggttgggtcccagcctcagtgtagatactgcaactgttttttgaaggcctaccgtgcgtagagggacctgctctgacatctcatgtacatcatttcattttacaaatggggaaactgaggcttagacaatttaagtaagtggtgggaccagggtttgaatccagactccaaactctgcagccctagcgtcctgctcccactgtgttgcctaagagatagggggctgagccttggttttgtcttccggctcctcctgggctcagcccgctcttcctccactctccagtcttgctctttccaactgtttagtcctccccacctgtgggtgtccccacgctgtcctgccccagccatcccactccctggccccatgcatcttgttcctgtgtcacctttttctttctttaactgaatacctgtgaattccctcagaagaggcccctggacacagcttctcaacatcccaactggtgaagactaggctgagtgatgatcccggtccatgtgcccatttgtaaaaaggggtgtattcccctttcgggactattgtgaggaataaaactgaactgaggccagaacaagatgctatcttcattcagcaaatacttaagcatccgccgtgtgccaagctctgttctaggtgccgggaatgccacagtaaatcagccaaaagccctcttctggattggatgtttgcataacaaaattctttcaggctttgaaactgtcagaattcacagtgtagacttgaaatcaagctattcataaggaaggagattaagacgcaatcacctgtaaaatggattggccaacctttggccctcactttagcaaaggcagccttgctgtgggacctgggatcagttctgttccctctctgtgcctcggcctcctcccataagctgtggagatcaatagtgcctaccagtggtgaggtctagatatgatgaatgcttgcgaagggtttaagctggtacctgtgcttaagaaaatcctggctatcctcagctctcttctcagcagaaaatgcaatgcggagactggaagttgggttatgtgcctaccctgcctctgaacctgttacccacttctgcccaggcccttcccatcctgttgggctacacatgtggggtggcatggtgccctctttgctcacactcagatgccaccttctgtcgccatcctaaacacagcctgggctgggagcgcagagctccatgatgagatcagccctggagccatcatctctgcagcgcttcctgccctctgcctgttcttgtgcctcaccgtgtcctagctcaggaccaaactcagccctgttctgtcccatgacttacatacccaacattccctgcaagctggatatgatcttggaaaggggaagtgagttgcccagaggcacacagatgctacctgaggagctggggctggagcctgcgtatctagaattccaaatctagcaatctccatgctgtacccatctctgggcatatgaggccttttaatccagggagtaggatccagtagcagagcccgagttctcaccttgaaatcagtctgacttggctttttaatacaaaacccagagctctgagagaacattgctgggagagtgagcaagctgggctgagaaccagcactcagaaatctccatgtggccacaggaatgctgacttggcttcccagcaccatgtcgtcgtccttggcaggctggagctgggctttgtggtatgttagatttgttttttttcttctggagatgtcctcactttcagagggcagttaggggcagtagactgaaggttcattcccagcactgccatgcgaccctggacaagtcaccttccctttcgaagcctcagttttctcatctgcaatatgggttaaaattatatactttgcagggtcgcaagatcataaatggttttccaactttgggctgaaccagcattgatgttattaagacattcatatttcctgtggagcaatttcaaaagcagttaactttatccctaccaggtgatcctgagggcctgagggaagtccacgtttaggtcacaaaagcctacacagcagggaaaacactggtttgggggctggtgtcttggattccaatcgccagctgtgtgacctgaggcaagtcactttacctctctgagtgtcaagctcataggaggcccccaacatcaagatatgatgctcagtgtctgaagaacatagtctccgtatttttctgcctccttgtaccagctcccaacccccccgccaacacttcgttaattgctcccagaaaaactctatgcttaaagttttccatgcttaaattctcagcckcactgtggcatgaaatcaattgtttgcattgaatttgacttctcaaattaaggggtaaaatttgagatgagagtagggggttagggaggagatgaggacgaagttaaaccagatgtgcttttgtttaattgtaggatggtggttaagctgctcaagtattaccatcgttctttctgaattccagtaaccaggagtcaggtttcacaaaaagtcgtagtgttctttcctggctggtgtggactcgccctctctattattattattattattattattactattttgtattcatctgaggccacagagtactggccagagaggagacatagatccccagaatttcagttggaaggcctttagaagctggctcggtcaactgggctcttggygcaccagggagactgaggcccagagaggagaagaggcttrcccagggtcacacaattgcttagggcagagtggactgggaattcagtctcctggccttaagctacatgatctttccaaaggcaaccactctcctgaatttggtgtgtttcatttctacagtatattcttagcatatctgttttttgaaaatcattgtttaagggaggatgcagatgatgtgggttggtggaaaaagatattaagctcaggagagctgagctgaagtccttgaatacctctgtgaccttgggcaagtcacttcccctgtctgagtctcagattcttcatctgtaaaccaatatatctgaggagtaggagtggagagatgagacttccctaagacttggaatgggtctaatgtattcaactggtcctcagatatttatagcctgctgtgtrctgggttatgggagatccatcacaaactgccttcctaaggctgcagggggtgggggattgttgacttttgcggtgattaaacaactttwatttagttgctggtgtttttaaaccaggcaatttcattttatataaagataaggatttctggcttctcttgaaagatcagaagatgtggccatatggggctatgtccctgcctggccacagtggctggagctgattagcagctgctccatccactttaccacagtctccaccacgccccactgcctcacacttgcccacctgcctccctgacattacctacctaccttctgagcttgcggtttctgggctagatgcagtgaggccatgtaagaggggctyaaattccacttgaatgattgtgtggggcttgggccagccctcagggggctcagggtgagaatatgggacacgtggacactagcccctcttccatagcctggcaacatctacaaaacatgtcagctaggcgaaggagcttttttcctgcttyggtggtcctcaggaagagtctgagggctctggaggtttgggggtgatagagcatctacckgtcaaggctcagcgagttgagcccagggtctagctggggacaggcatcgctgggtacttcattctaaagattgcacagcccctgcagggaagagactcccttgacagcttccaccttaccccttgctccccaagagccctgtgcattggtgcgccacttcaccctgtgctccctaayagccctgtgcatcagtgcataaccacttctcagacaggaaacacgatcttgcactctgaacccacagctctctgttccaccccctttgctgggagccagggcctggtgatgacaggcaggtaccatggtggctgcagcaagcatcttagaatcgccatgtctgagccagagggtagcacaggaggctgtgaagcctgatggttacatgcggggggctctggaggcagctgctgtgatgtgagattctaggtctccacgaatcaactgctccaggggttatgagatggacaagggagactgattgattgtcgattgctgatactaacctcacatcccctggtccttacacctgcagacgacttcagaaatgtgccctgtgtgggaagtggcattttgtgagcaccattgggtaccaggcactttcgcacattacctttgatactcacctaccccctacyctccagcattttgcagttmaggagactgaggctcagagggcagacaccttaggattactcctcccctaggtctctatgcctctctgctttgacccagggaagggaggagaggacaggctggaaggtcatttctggaaataaggccgtggagaccctgtagtgaggccctgaccctccagactttctaagccaccccctcctcctccactccagcttgtttcagagatgcttcttcatccttccagagctcagtttgtcattcaggtgcatgaactttacctggccaggtctgcaaactgctgggcagagctcagcaaatattttatgttctttaaaaaagtttttaggtggcygaagcaaattgcttttactggaaaaaccagaagtgtgacctttattttatttttgcagagatggggccctgctatgttgctcagcctgggttcaagaagtctacccaccttggccccygaaagtgctgagattataggcatgaaccattgtgcctggcccacaagtgcaccctttaaaaagatctaccaggtgacccttttttagactgagtatcgctctgttccccaggctggagtgcagtggcgtgatctcggctcactacaacctccgcctccygggttccagagattctcctgcctcagcctcccatgtagctgggattacaggcacatgccaccacacccagctaatttttgtatttttagtagagacatggttttgccatgtcggccaggttgatcttgaactcctgacctcaggtgatccaccctcctcggcctcgcaaagtgctgggattacaggcatgggccaccacacctggccccagtgactttttgttgggtcaacctcttgccttctttagtgcacctttactaggtcagtaaagccacagggtgggtaccacttagctctcaggctgacgttctcaggcctcttgctggctgtcactgaagtgtctcaggcttgttgtttttttgtttgtttgtctgttttgtttgtttgttttgttgttgttgttttttgagacagggtctagtggctctgttgcccaggctggagtgcagtggcacgatcatggctcactacagtgcagccttgacttcctggactcaagcaatcctcctaccccaacctctcaagtagctgggaccacaggcattcgccaccacgccccgctaattttttttattacttgtagtgatgaggtcttgcaatgttgcccaggctggtttcgaactcctgggctcaagtgatcctcccacctcatcctcccaaagtgctgggattacaggtgtgagccactgcatctggccagcctggccttttggaggatctcatccccctccacctgtctccacctgtctccaccttgacttacctgtctctcagcatacaggagttactaactgacccgtctgccgccattctggtgagaaaatgtctcatctgaggcccatttcccctcctccactccttctgagcccttctatagctcctcttctttctctgcctcattcygctggtccctgccatgccactactaactaaaagtccatagactataagcccaacatgcacgtactaggcatggtgctcagtgccttgcctgtaattactatttggtcctacagcagcgctgggtggcaggtgctattatccccacattacagatgaggaaacggaaacacaaactcccccagctgggaagtgagaagtagacatgtttgttccctgyggtgacccatccatccattcaaggctactgctttctccgtaatgcaaatgacataacccatcttcctagaagagtcagttccctatttatcttaaaaccatccaatatagaaattcatattctaggtctgttagcctatcaagatatcagagataagcaggtttcctctcaacagcttgtccaagcccttaatcacctaagtgatttttttgtgtgtgaaaatgctgtttttttgcttttccccatgacctaatccttatacagatgctccttgatttaccaaaggtttttgtcctggaattgtaagttgaaaaatatcataagtagaaaatggttataacacctaacctgtcaaacatggtagcttagcctgacttaccctaaatgtgttcagaacagttacattagcctatagttgggcaaatcatctaacacgaggcctatttcataataaagtgttgactatctcatgtcaatttcttggctatactgtattgaatgtgaaaaacagaayggctggttgggtactcgaggtgtggtttccactgaacactgtagcttttgcatcatcgtaaagaaaaaaatcttaagtgtaagttggggacagtctgtaatgaacatttaagggcttactctgtgtcagaaactgagctaatcactttgaatgaccttattgtattgagctcataattctttccattttgcaaacaaggaaacggaagctcagagagattgagtaatgttctcaaagtttggaaagtgcaggtgagactcaaatccagggttgcccaatcagattggcatctggattcaaatttgcatgtttggagaagagctctcagggcaccttgtggtacacatttgtttttcagtgagtgtttgcaaatgacatgggggtgggaggccccagggggaggagacagaacatagacacacctggtggggcaccagcgtctgttctcccagacagtgtttcttagcctgttcaccccctcataggaaatgacaagcctagaaggaagcatcctgagaaacccagaggggcctgggtttgaatcccagccctgccatttcaagctgtgtgaccttcgccaagtccctttccctctcttagcttctggctaccctccctaccacgcatggtttatttgaatgaggcaaggccttaggatttttcgatttgtggatggcgaatagccagcrtgtctccttcctctctcctgccctgcacccacatcagacatcactagtcaaccactgcttgctttccttcccagattccttctaagtacagtgctccagacagccattagcaactaatatagagttggcacacaagataaaaggacatcccagaaccagattagatttggtcattgtgtgggtgggggtagggaagggataggcccaggtggcacccagttcagtgtcacggtgctccttggtcttcttttccttgtctttggaggaactaagctagactgtaccagggcccaccccaggtgtggggtaggaaccttttatgaggcacagagctgtgcccgtgttcagtcccaagggagaggcaggtttctgggcctcatcactgtctaggcttaaagtaagagtgacgagaaagaggctggtttcaggtcctcctggaaagagttaggcctgcccctctccaccctttgtaataacatccatagtagtaataagagttctcgacactgacggaccacttgttacgcaccaagccactctgcgaaatgctttgtatacatttacacatttaatccttataccagcccatttttcaggtgaggagaatgactcagagtaattagcctgggtttgcccagctggtaagtgtcggagctacgatttgaattcatatctgtcaaaccccgaataaataactcttattactacgatggatattattacaaaggatggggaggggccagcctaactctttccaggaggacctgaaactgagctctttcttttttttatggtattcagaacatcactttataaactgttgtcagattaccatttaaacattaatacccaaatacagaatttagacaattactttaaattgtaactgtaccatccccaagctctcagctatgaatttggtttggggagagggctccgtaataggccactgaagtcccccgtcccaccccttttttctcccctgaaaactagctgcctgactgctctgccagacttgggctagaacttggcttcactgtgacagtgggaccacctgggccctacagtgtggcaaaaccgacccgcccacaaactccatcccaggtgttgagatgctaacacactgaagctgaaagaccccacttggttttgccacagatcaagttgcatctgactagagagcctgtcctctaccctatttcctgcacaagtctttttctttgtaatgcaacaagcgctactcagctcagatycagtgggacacagggaaaggggctgtagtgtagcccagccttgctgagggagacccctgcctcgccaaagcacttcgctcacaaaggctgaaactggcctctttctcgtcactcttactttaagcctaggcagtgatgaggcccagaaacctgcctctcccttgggactgaacatgggcacagctctgtgcctcataaaaggttcctaccccacacctggggygggccctggtacagtctagcttagttcctcctgctttcctccaccgcaggctcagtgcggggcccgcggcctctgcgtctttctctcagcttaccatgatcatttctcattgatgagtgcgatacgtctttgcccgtggaaagtgctttaccatcggcagagccttccacgtttacacatgcgcagcacagcaaagggcatctctttttaaaagggagaaaactgaagctcagaggctgggcacaagggctcacgcatgtaatcccagcactttgggaggccaaggcgggcagatcacttaaggtcaggagttcaagaacagcctggccaacatggtgaaaccctatctgtactaagaatacaaaaactagctgggcgtggtggtgtatgcctgtaattccagctatgtgggaggctgaggcatgagaatcacttgaatccgggaggcggaggttgcagtgagcagagatcgtgccactgcactccaacctgagtgacagagtgagactgcatttcaagaaaacaaaaagaagattgaggctcagggagggagggtggtgggccccggaccacacagcgaataaacggtaaaccctgcaccaaggaattaggtaccccacctgttccctaggccttctggaacaaattgcctaggggaacctgaggtcagtgctgggaacgcaggagtggtggctcagcagaggcaggggttgtgctgccccccgcatcccacccagatacaccctatcctgttttaatcagccattgaccttggacaagtcactttaacactgccaacctcagtttccaggcacttattctatttttcaggttttttttgttgttgttgtttgtttgttttttgagacaaggtcttgccctgtcacccaggctggagttcaggcacgatcatagttgactgcggccttgacttcctgggctcaagtgatctcctgcctcagcctcccgagtagctggaactgcaggcttgtgccaccatgcccagctaattttttttattttttattttgtgagatgaggtcttgcttatgttgatgaggctggtcttgaactcctgggctcaggcaatcctcccacctcagcttcccaaaatgttgggattaacaggcggtgagccaccaggcctggcatatttttcagtttttaaagccatttcttttttctctttttttttttttttttttgagayggagtctcgccctgtcgcccaggatggagtgcagtggcttgatcttggctcactgcagcctcccaggttcaagtgattctcctgcctcagcctctggagtagctgggactacaggggtgtgccaccacgcccggctaattttttgtacttatagtagacacggggtttcaccgtgttagccaggatgttctcgatctcctgaccttgtgatccgcccaccttagccttccaaagtgctgggagccacggtgcccggccgaaagccatttcttattcatgaactcaccgaaccatcaaagcaacccaataaagtattcacatcattttgcaaagtgggagactgaggcttggggaggcaagcaacttgcctgaggtaaaattgatggtaaaaccaggcctcaaactcaggtcaggatcccaggctgaaggtctttccccagctgtgtctccagtctctctcatcgttgcctttgtacctgccatcccctcccctgcagcaacctctccctgtttgtgttgccagttggcatcatggctgtttttctagagcttgctttggatatcytgaaccctttgtaatctgatcatccacatagcatctggctctgagtttcagttcctggagggtaggagccccatctgagtcactcgtgaattcccatgcctaataagatgcctgctttcagcaagcgtttaatgacttttttttttttgagacggagtctgctctgtcgcccaggctgtagtacaacggcgcgatctcggctcactgcaacctgcgcctcccgggttcaagcgattctcctgccttggcctcctgagtagctgggattacaggtgcctgacagcacgcctggctaatttttgtatttttaggagagacagggtttcatcatgttggccaggctggtctcaaactcctgacctcaggtgatccacttgccttggcctcccaaagtgctgggattacaacagcccatttaatgacttttgagttcatgaaaggctgccccactcggcaagggtttccacagctggcctggctttgttaccatggggaagcctgggagggatgccccactgggtgtgactcttgagccactcaatgcgaagcctggccaccctccccagaccttcactggtgtccttgcacgaatgccaccagctcataaatggttagtgattggcagcaggacaagccagtgtctctgggtccagttttcctgttggcagttcaggcctttagtctcactcaggtatgaggtgcccagtgtcatacctctggccaatgtctttgtccattttgttcacagatgtacccccaatcccaaacagccttaatttctttaataataataatagtcatagctgtaaatttgctgaatctgcatgtaccatgcttcctggtgcatagtaggcacttaatacatatttgttgaatgaatgaatactcgcagcgagttaacatttcttagagactgagagtccctaagtgaaaggtcacttgcatgacctctgtgcctcagtttcatgtgtcgactccgtgagaggtactcagaggagtaaccaatacatatgtccatttttttttttttttttgagatggagtctcgctctgtcgcccaggctggagtgcagtggcgcaatctcggctcactacaagctccacctcctgggttcacgccattctcctgcctcaacctccccagtagctgggactacaggcacacaccaccacgcccagctaatttttgttgtattttttagtagagacagggtttcaccatgttagccaggatggtctccatctcctgacttcatgatccgcccgccttggcctcccaaagtgctgggattacaggcgtgagccactgcacccggccaggtttgtttaaaatatatcatgaaccaggctgtgttctaagcagctcacatgtattttttcatttatccttgcacctgaggctcagagagattawgttcatgtctcctaggtcacctggttggtgtcacgtgcaaatattttaatatctcccaggacatgtgtgttccaaataacataatatgggaaccacctcccctaccagcctcctcccataacacacacctcacgccccagatcctaggcttagaacaaacgggaacagtagtaggcgagtcaagcggtcatgttgtccctgactataaaatgcctcatccagtgtcgggcacacaataggtcttctgatcaccatctgtgggataggcgccaatcatgatctgagcagaagctggcaggagggagccccgaatctgctggaggaaactcggtgctggggggactttagagaagaaatgacagcggtcatraatcattgtaacagtaacagctcatattaactgagtggcaggcactgttcaagcaagtcagatacattaatcatttaatcctcatatcagccctaggaggtagatattattgtcattgtccccactcacggatggggagccaggctcagaaataagctcatttgggctgggcgcagtggcccctgcctgtaatcccagcactttgggaggccgaggtgggtggatcacctgaggtcaggagtttgagaccagcatggccaacatgatgaaaccctatctttactaaaaatacaaaacattatagccagatgtggtggcaggtgcctgtaatccctcaagattacaggtactcaggaggatgagacaggagaatcacttgaacccgggaggcggaggttgcagccagctgagattgtcccactgtactccagactgggcgacagagcgagactccatctcaaaaacaaaaaacaaaaacaaaaatggggaataagctcatttgtccagtaaatggctagtaaatgatagctctggagtgtgaacaccagcactcaggctgtggcatcttgctgtcctgcctccttctgtaaagactcgtgaagcttcctgctgggtagttcctggtacctctgctccaggttggccactggcagcaggcctgtgccagggtgcatgctggcgctatatgatccgtggggcggaggggagtatccccatctcctcaggggcctcccctatgtcacaccctgaggctgggcccagaccggtattcaggaaaggaaactgatctgtcacctcacccctgcctggggcagcccagcatgtgtcagccccctaatccccgggtactgcccaggacaarcagtaacagggacaaccaccctccaacatggggaggcctgcaacagctctggggcagaaggaggctcagggaggtagcaacttaccacccagcagctcgtggagctagtgggtggttgagctgggatttggacccagggcttggctctggtgaggggggatgtgtctgccatggggttgtctggtccagagatccaggcctagctcttttatgaaaccttaatttgttcactgataatagcaagagttgtcatttcctgaatctaacctccccaaagggtagatactcaaatctctgcttttttttttttttttttttttgacatggagtctcgctctgtcgcccaggctggagtgcagtggcgtgatctcggctcactgccacctccacctcccaggttcaagcaattctcctgcctcagcctactgagtagctgggattacaggcgcgtgccaccacacctggctaatttttgtatttttagtagagacggggtttcaccatgttgctcaggctggtctcaaactcctgacctcatgatctgcccgcctcagcctcccaaagtgctggaattacaggcatgagctactgcgcccggcccaaatctctgcttttacaggtaaagaatggaagcacaggctgggagtggtggcacatgcctgtgtcctagctacttgggagactgaggcaggaggattgcttgagccaaggacttcaaggctgcagtgagatatcattgcacctgtgaatagctaccgcactccagcctgggcaacatagcaagatcccatctctaaaaataaaaaatataagaaaaaaaaatgaatagaagcacaaaggaagggaagggatcacccaaggtcctatagctcatacatgggttaatccagaattggaaccygggcagccttgctccagagtccggtctcacttaatgagtactagataattctctgcatgtcagatgggtacactcttcttgaacctgctagttcttttggagccagatctggggagggggagcaaggcaggagttgagcaaatagcaggaacagactgtgtgacacttgctgggaggctccgaggctccagctccctgagcttagaagtgcggagtktatctatcccctgcgcgattcctgggggaagggaaggacaggcgaaggggcatggcggggcagtcctggtgtctccaggaccagggtcagggggaggccagagcaattagcctggctgaggcctctgctaactcagaaacgtaagtgggggattggtccaggcctcactccagggctctggcctcgagcctgaccctcctgagtttctatctgaggcttccagagtcttcctggggcagtgaatctcagagtgctggtttgtgtgagaactttgttctgaaatttcccttttcaacaaccaaatccctgggctggcctgcctgccccacttccccctcttggaggaaacggatgctttcctcttgggcggccacatgatttgaataatcaagtgtttcccagctggcctctggccaaacggagctcagctgggcaaggcccccagttggggcactgaggcaagcctgccaacctcctcatcccgccacacgctccagccaccgagggtaaaatacaggaaaaatgcatggcccatagacttggctgggccaggccccagactattcctgtgatggaggcagcgcttgtcttgggctttgtcccatctacctggagaaagctgagtggaggaagaaaaaggctgcccctgctcaggaaattcctgatggagcggcctctcctggcgtgctcacctgggtgctggcgtcttggcacttgtcagggtggagagaggaggaagccagtcaagaaggggaaagacgggtgygggaggacattcactgattcaacaaacatctcattagcccaactgcctgtgaggcccagggttaggtgctggaatcacagatggatctgccctggattttgccttcaaagagtgtgtgtaggctgggctccgcrgctcacgcctgtagtcccagcactttgggaggccaaggccagtggatcacctgaggtcaggagttcgagaccagcctgaccaacatggtgaaacctygtctctactaaaaatacaaaaattagccgggcatggtggcgcgtgcctgtaatcccagctactccggaggctgaggcaggagaattgcttgaacctgggaggcagaggtggcagtgagccaagatggcaccattgcactccagcctgggcaacaagagcaaaactctgtctcaaacaaacgaacaaaaagagtgtgtacagaaatggtcttgtaagcagactcccccacagagccctaggtggtagaggatgagggaaagcatgagaggccacctagctaagccttgggcagaatggccgcaaaggatttctggagacagcagatttcatttatttattttttttgagatggagtctctgtctcccaggctggagtgccatagcgccatctcggctcactgcaacctccgcctcccaggttcaagctattctcctgcatcagcctctggagtagctgggactacaggcatgyaccaccatacctggctaatttttgtatttttagtagaratggggtttcaccatgttggccaggctggtctcaaactcctgacctcaggtgatctgcctgcctcggcctcccaaagtgctgggattacaggtgtgagctaccacgcccggcctactttattaatttttaaccttttttgcygcattatataatttttgatatgtggtgtttttaatcattcagttctaagtaattttaagtttctactatgacttttctttgatccttgaaatttttagggactttttttcatttctaagtgtaggggtaatgatttatacttgtaaacgcttagcttctcacttaattgatggtcacaggatgtggtctatgtgaaaacttattatttgaactgtgagacttactttttggcctggtaggtgatgaattatttaaatgtttgcatgttcctgaaaagaaagtgtgtttatgtattttgtttctaccatcctacatttttatttcaatttgttctgctttttctgttttatcactttaaaaaattatctgtggcttttccctacaaagacaagattagcattttctcatgtcccttgctcccctgcctctcttcagtttccacacccttcactgacatgctcccctcagcccccatgatgtcacatgaaaattgtctagatttttaaaaaattgtctaattctgagttacagatctatgttattcttgttcttttcttttcttttctttcttgagatggagtttcactcttgttgcccaggctggagtgcaatggtgcgatctcagctctccacaacctctgcctcccgggttcaagcgattctcctgtctcagcctcccgagtagctgggattacaggcatgcaccaccacacccagctaattttgtatttttagtagagacggggtttctccgtgttggtcaggctggtctcraactcccgacctcaggtgatctgcctgcctcagccacccaaagtgctgggattacaggtgtgagccaccacgccyggcccttcttgttcttttctttgaacttgaatttgttttgaaaaactaaactttactaaattatttgctcagtcttcagatatcttgaatacaatctgtggaatttgctcctaattaaatcattcctttaaaattatttgattctttttttggagggggcgaggggctgtctttttgtacaaacctgagcccttgatgctgtaacttttattagcctttaactttttttttttttttttgaggtggagttttggctctgttgctcaggctcaagtgtggtggtgtgatcttggctcaccacaagctctgcctcctgggtttaggcgattctcctgcctcagcttcctgaatagctgggattagtggcacctgccaccacacctggctaatttttgtattttcagtagggacaaggttttaccttgttggctaggctggtctcaaactcccaacctgaagtgatccgtccacctcggcctcccaaagtgctaggattataggcatgaccaccacgcccggscagcctttaacatttgaatggctgtttagctggatagaaaattcccagctcaatctttttttccttctgtagtttggtcaattcgacatttattccatttgtaagtgttctgttttttgctaaacctttaggatgttttcattgtgtgtacgtgttttttttytgttttgtttttttgtttttttgktttttttgagacagtcttgctctgtcacccaggctggagtgtagtggcacgatcactgctcatacagcctcaacctccccaaataaagtgatcctcccacctcagccccctaagtagctgggactgcaggtgcacaacaccacacccaggtaatttttgtattttttgtagagatggggtttccttatgttgcccaggctggtctcgaactcctgggcttaagcgatcctcctgccgtggcctcccaaggtgctgagatttacaggagtgacctattcaggcatgagattacatgcctgacctattcagtttytttttttttttttttttttgaggcggaatctcgctctgtcacccaggctggagtgcagtggtgtgatctcagctcaccgcaacctstgcctcctggattcaagcaattctcctgcctcarcctcccaagtagctgggattacgggcatgtgccaccaygcctggctaatttttttttgtatttttagtagagatgagatttcaccatattggccagactggtctcggactcctgaccttgtgatccacccaccttgacctcccaaartgctgggattacagacgtgagcctccgctcccggccgacctattcagtttcttaatggtatsttttgataacaagaggttttcaattttgatgaagtccaatttaccttttttttcttttatggaattagtattctttgcctaacccaaagtcatgaaaatattatsgagtcagggccgggcgtcgtggctcatacatgtaatcccagcactttgggaggccgaggtgggcggatcacctgaggtcaggagttcgagaccagcctggtcaacatggcgaaaccccgtctctactaaaagtacaaaaattagctgggtgtggtggtgggcgcctgtaatcccagctactcaggaggctgaggcagagaattgcttgaacccaggaggtggaggttgcagtgagccaagattatgccactgcactccagcctgggtgacaagagcgagactccatctcaaaaaaaaaaaaaagaaaatattatggagtcagtattctttgcctaccccaaagtcatgaagatatccttttatattttcttctagaagctttgtgattctgacttacaattaggtttatggttaatctcaaattaatgcagtaagattggggttaatgttcttttaacttttctttcaatgttctgtttctttttttttttctgagacagggtcttactttgtcacccaggctggagtgcagtggcatgaacatggctcacttcagtctcaacccctggccttaagcaacgctcccaccccagcctcccaaatagcagggaccacaggtgcacaccacacttggctaattaaaaaataattttttttgtagagatgaggttcttgccatgtttcctggaccttccaaagtgttggaattccagtcatgagccaccaagcctggccaattttctgtttcttaatccttccctgcttcctcctggaagcgtcctcaagctaataacttagctctctcctccatcgttcagcagctggatacactctgtaatttattcyacttatgtgtttgttatttcaactggtttttcacatagagtgtttccactggggtcttttaaccattcctctttctgttttgctaacatctttgctcatttcttttgcatgtttctcacagtttatggagactttttgtttgcttcattttgtttcgtttttttgagacagggtctccwctgttgcccaggctggagtgcagtggcgtgatctctgctcactgcagcctcgacctcccragctcaagtgatcctcccacttcagcctcctgagtaactgggactatagttgtgcaccaccacggccagctaattttttttgtattttttgtagagatggagtttcattgtgttgcccaggctggtctcaaactcttgggctcaagtaatccacccgccttggcttcctagagtgctgggattacaggtgtgagccmccgcatctggtcctgttaatggtttttctttagaattcattgtgctatggctggtagtggygtggggtgggattcggggagccatgcacttcttgcccttaaaactagcagccagggaaaacgtatggctcctggatcctccctctcaaatcagtcccaaatactgaaaagcaaaacatcactaaacctaggcaattacgatttttgcttattttaaattctcagtaaatctgatctaatacggatgattccagcggtatctctaatcagtttgggtttcttttgaagtcattgtgctccttggatactctgttctttaacttgtgagcttactccgtgggggatttcagctattctgtttgatgctgtgtctttggtaagagtctaaggctgaccctagtcgcccagttccaatgagtccaaggagacgacattgccaggacgggaatccctggacatcagaaccacttggtttctcactaggtgtgacatcaccattctccctcccccagtgactcactccacaggattgggcctctctttcagaccccagggagaaacagtgaggagaaggggctatatgcctaggtcagaattcttcagactggggtctggaaaggaaggggtggtggagtgactgtagaggccccctgtagtgactgtcggtcccctcccaattcctgcagttccacattgtttgctggcaagctttgaatttttttttttttttttttttgagacatggtctcactctgtcacccagactggagagcagtggcatgaacatggctcactggagcctcgacatcctgggttcaagcacacctcctgcctcagtctcctaagtagctgggaccacaggygtgcaccaccacatccagatcatttttgatttttttttttttttttttggagacagagtcttgctctgtcacccaggctggagtgcagtggtgcaatcttggctcaacctctgtctctcaggttcaagcaattctcgtgcctcagcctcccgagtagctgggattacaggcacccaccaccacacccggctaatttttgtatttttagtagagatgagatggggtttcaccatgttggccaggctggtctcgaactcctggtctcaagtgatccacccgccttggcctcccaaagtgcgggattacaggtgtgagccacggcgcccggccaattttttgatttttttgtaagagacagggtctcactttgttgcccaggctgtctcaaggtcctgggctcaagcgagcctcctgccttggctcccaaagtgctggaattatggcccagcccatgctttgactttatctcagtagacacttgtgccatcctcctgggctgctttatgcaagatactttttgtgggtttcatgaaaatgtgggcttagtgataagccataagttaattgaggggcagaacaaaggtgggttggacaatttggggctcacatgtcctgggatagagagccaaaggggctctgggaaagggaggaggattctgggaggacacggagtcagcagagaggaggatggagtttcaacaagcccagagctgaagttggagactgaggtctagggtagcagatgtgggctttgccaggaggcaggtccagagggtggctgtggggctgaactccaaccccacacccagctctgaccttagttgttccaggacagtgggtgtgtgtatgggggcctgggcttggaacagagaggcaagaggagaactcaaaccctgttttcttttctgtaatattctctccaccctaaagaccatgccctgccttttctcctggctgcagcaacccctccccgccaccctacacacactagtttaaactctcttccatctcccaggagattctgtttccccattgttgcctaggcttagtggtattttgttctgttgttacttgggattgatgttgagaaggaggacccaggagccatatgtcttctctctctgttggggcaaggagcgtgtggattccccaatcccctgtcccaccaccagccagagcacaatgaattcaaaagtaaaaccataaactgattagagacaacccagagtcagtggtattagaataaaaagaccaagattttttttttaattttttattttttgaaatggagtcttgctttgtcacccaggctggagtgcaatggtgtgatctcagcttgctgcaacctctgcctcccaggttcaagcgattctcccacctgagcctcccgagtagctgggattacaggcacctgccatcatgccctgctaatttttgtatttttgtagagatggggtttcaccatgttggccaggctgatctcgaactcctgacctcatgtgatccgcccgcctcagcctcctgaagtgctgggattacaggcgtgagctactgcgcccagcccaagaccaatattttaaataaacatcagaaacatgagaaataaggaaacaagagaaataaggaaaaacatttgcagcataaagtagaatgagagagtgtaaaaaataaaagagctgaaarcaaatattcaatatgagaaagcagcctcattctctgccccacccaaacctctgcgtgcaccttacagctccctgttctccaggaaagacgttcacggcttctggacyttggcatgggctgttccagcagcttagacttccttccctccacttctgctgaaacacttcagcacatcctcaagactccttccctgaccatgcctcatggtcaaggtgacactcagtgatggcatagggttctggagtcaggacaccagggtgcctgtcctgattcttcaactaattggctgtgtgactttgggcaggtcatgctacctctctggacctcaggcttctcttggagaaaaagatgaaggtgttgggttagagtattcctagagtccctttcagtttgttgtgataccatggtggggagcacaagctttggagtggggctgcccaccagcccttcctgggtcagcacttaacgctatgtatcatggagcagttctttcaacatggaaagccaccgtttacttaccctaatatatgggttaagagcttgtagtttggagttggacaatttgggctcagaatcccagctctgctgcaggtctgctgtgtgacctcaggcaagttacttaaccyttctgtgcttttttcctcttcataaaatgtgaatgatactaagagtacctacctcaaagtgtaggagcacagtgaatgcagctgtcattctgctggtgacagttgtttcaccactatacagacatctcctttcagtttggtagattcttgatgattatctgccgggctctgctttccaaatacactctctgttgaattttaacttttaacggatgctctccactgcattttatctgtaaaacaaccctgcaaggtgaggatgaccaaccttgttttatggataaggaacctgaaaccccaaagttgctttcaaagctacacagccaggacttaaccccaggtccacttcccacaagaccaaggtctttccaccatgccacactattcagaagattagactgggtctgggcacggtggctcacgcctgtaatcccagcactttgggaggctgaggtgggtggattacctgaggtcaggagttcgagatcagcctggccaacatggtgaaaccgcccatctctactaataatacaaaaattagccaggtgtggtcgtgggcgcctgtaatcctggctactcgggaggctgaggcaggagaatcrcctgaacctcggaggtggagtttgcagtgagccgagatcgtgccatttcactctggcctgggtgacaagagtaaaactcttgtctcaaaaaaaaaaaaagaagaagaagaagaagaagaagaagattagactgggacttgggagattaccaaatacaggcagatgggaaagcacagtgagaagtctcccaggctggagtgcagtggcgcaatctcggatcactgcagcctagacctcctgggctgaagcgatcctccagtctcagcctcctgagtggctgggcctacaggtgtgtgccaccatgcctggctaatttttgtagagacaggatttcgccatgttccccaggctggtcttgaaatcctgggctcaagcagtcctcctgccttggcctcccaaagtgctgggattacacgtgtcagccaccacacctggatcctacatgtatattctgactgtccgcccttggccatatgcaagatgccttttgtagtttcatgcaaatgtgggcttagtgataagccagaagttaattgaggaggcagaacaaaggtgggttggacaatttggggctcataagacctgagatagagagccacaggggctctgggaaagggaggaggattctgggaggacacggagtcagcgaagaggaggattgagtttcaacaaacccagagctgaagctksagactgaagcctagggtagtggatgtgggctttgccaagagataggcccagagggcagctctggggctgaactctagccccccaccrctgtccctcaccctggtgtactcttgagggtctgggtttgtggtttcagtttcttcctctgcaaaagggctgctagtaccccttggtagagttaggggagagggcacgagggagacagkaggccctgggcaagaatccagttgcgctggttgtattgacatgcatggacttgagagttatcctgaaaccctatccctccttatctgtgatttgggaatcacgttctggcctgtgtgggatcattgcaaggccacagtgaaatgatttcttggtgagaccttctctgatctttctatttaaaactgcaaacctccctgtcctcctccctgccttctttttccccgctgtacttaccgccacctggcgttctattgcttttacttacttccttgttgtctgcctgccacactgacagggatttgggctgttatgttcagcacctagaacagcccctggcatattgtggctgctcaataaacagtgttccagcgaatgttggttgaataacatatagggaaagccctaggcatagaaggtgtttagtcaaratcagctggatcttagagacatagggcagacgcctgagaaaggctgggacagctcacttggggtgacgaggtctcccatgaaagcatttggggtctggatttcagggcrgtgctggtttcctctctggccacagcctgcaagcagcgagccatataggagaggaaagtttggctgggtgtggggcctcacccgggagtcccagcactttgggaggctgaggcaggaggattgctggagcttaggaggttgagagtctgggcaacatagcgagaccttgtctctactaaaaataaaatcaccagccgaacgtggtgctgtgcgccggtggtcccagctacttggtctcttgctgaggcaagaggatcgtttgagctcgggaggttgaggctgcagtgagctatgatcgtgtcactgcacttcagcctgaatgacagagcaagaccctgtctcaaaaaaaaaagaaaggagagtgaagctggatgggccaaatactggggcttctgaagaagtcaagaccttcaggcagacaggaagctcatgacacttagctttctcgttttctttagctttttaaaccactctgactgctcctgagtggaacaaactctcaaagaaatgatagcctcagcccactccactccaatgactaggagaaaaagcagtagcactgggcccaggcagatctggagacatggcttggccctgcccctgtttagcagagggacctagggcaagtcacttcaccttgctgagtctctactttctcctctgaaatgggtgtagtggtattctccctccgaggccttttgtgtaaaacctactagaaaggtgaattataaccagtcattaccaaactgaagggcctggaaggcagagcttgtacctgcaagtcctgtcacagggctggcacacaatagatgcatggaacctggtggtcaaagggttgtaaacttcaatggacaacaacytgtcagaaagtgaggatctgagtcctgcagggctattagacaagtccagccccaaaactttctgtaattctagaagtttatagattccaagtagaaagtgacttgtaggaagttggactcttacattaccacatacttgaaacttgtcagctttagcttgtttgcaagatttttcctctggcagaaacagctggcagaatatgaatgacctgatttggttgctcacaatctaaagcgctgagaaaaactggctgagctgcagttctgaggtcagactctgtgttccaagtaacagaaaagccaagacgcacaatggggaaattaattggctcatgtagccaggatgttcagaggaaggcttcaggcatggctgcmtctaggagcccaagtgatgctatcaaagactcaaggtctctacctttctctagtccatctctgagaggttgcttcctcttcaggctatacaaagtgcccttccccaccacttcacaccctcataacccagcargcagacagagtcttccagctggagccagtcagggtccacctggagctggaggcgggatcagtcccacccaaaccaggctgaaagggggagggtcacttcccaaggaaacttggtggtattgttaggaaggggaaacagactctgggtggccaaaaatgacagtagatgtccactccactcaccagagggagtgcagtggagagccgtagaaacttctgcattgtaccttttgatttgcaaggttccttccctttttttttttttttttttttttgagacggagtcttgctctgtcacccaggctggagtgcagtggcgcgatcttggctcactacaacctccacctcccaggttcaagcgattctcctgccttagcctcctgagtagctgggattattggcgcccgccaccacgcctggctaattttttgtatttttagtagagacagggtttcactgtgttagccaggatggtcttgatctcctgaccttgtgatcygcccgcctcggcctcccaaaatgctgggattaaaggcgtgagccaccgtgcccggccagkttccttcccttctaagacgctgatactggaggcagaatggagtttattatccctgctctacagccaaggaaacagcccttgaatattcagcgaggactctgacttgtaaccctgggctgcccccactgatctcagcctctctgtgcaaaattataagcccagaggagctgacccaggagggagaggccaacgtgactgaagcccctcmctttgtggagcgggcactctgtctagatacaagaggcccccaggaagctgcgatcaygggaaagtacacagggagctgagagagcagcatgacatgaggaccagccacagggcagcagccaggcatggcttcctgcagctctcattgccagaaccaccccccccaccgccatccccctacaccccagcagagtgagctcatgcagccccactgaggcagggctccctgtgcctgggatggctgaggcacgagctctgccattggtgaccgaggttgtcctggcatgtgactgagatgggggtggcaygtacactggacatggagctggacggacctggcctgaatcccagcgctcccacgtggttgctttgtgaccctgaacctccctcctgttctgagccttggtttttcctcctgagccggagctgatcatttgcacttcactggaattcgaagactgggtgaaaagcccccggcgcgtagtagttgctccatagagtttctccctcttcctctttgggtcctgttagtagctatgtgaccttggcccagttccttgacttttctgtacactgggagcaatgagggcgttggtgtgaggaccagatggctttgcgtgtaaagtgcttagagcagtgcccggcacactcgtgatcactgttacttctggctaacacctattgtttaatgcgtaccaggccctgggtctttctctccttgtttattgtctcactgaattcttgttcctccagtgacgtaggctctcaccaggatggtccccatttgacgggtgaggtggtgtgcccaaggtcaatgggggcctgctgagctgcatgcccttgggtgggacctcacctccataggccccagtttcctgtctggggctctcggcgtcagccctgccctactatgtcccaaggtcgccgcggagatcaaacgcaaaagccaccggagccttctgtggccggctggagcgtcctctgggaatgcgaggaacgctgttatctggagcccagctgccctgagcactgtctctgggaacacccgcgtccttcctcctctgatctgagccctctgcgcccgccacccagggattcggcttgtgctggccgctgcccagcaagctacaagttcattgtcccttttcccacagcccggcgcctcctcagcctcctctcacagggcctgcgtggggccatctgcacaatggacacatcctctgctagggggaggggagtggggagagccgggattggccaatgccctgtcttgaggatgagttgaaggaggggattatgggtgggggtggccagggtgcgcccacctggccrggggcagagccaggtcttgaatgccaggtcttgaatctgggatcctcccctccctgccactgcaagccccaagtgagttgcactgcagggctggctacaagataccgtgcaaagatcagaagagacttggaccctagatgtgacattctcttgctgtgtgacctctggcaagtcacctcacctctcctgtaaagttatgattataggaagccctcccactgggaaccgtggtgcagatacaatgaaataacatttgggaacagartgtagtgagtgtgaatcaaatagcagctgcacgcaatcccttcatctgcaaaagtataatgtgtctgtgtaatgtacatattgcagagagggcaaatggtggtttgtttccagtcttgcctcctgtttgaggagtttatgcttagtcctgggagacagaaacatccccaagtaaggctgaattctggctcgctcacttactggctgtgtgaccttgggcatgctccttaatctctctgtgcttctgttttgtcatctgtaaaatggggataataatagtgcttaccttgaaggttgttgtggggatcaagtgagttaatataggtaaagtgtttagaacaatgcctggcacataataaggtctatgaaaaggtttgttattattaatcttatgaatacgatgacaaaatatgtaaaataggatttttctaaaatagtctcagtttgaaatattttcatcagttgccgcaaatcactaatgtacggaagtccaagacattggcatccaagctgcgccttgaacactgccttgcctttccagtaattgccccccaaatcctcagctggttagtggggagacctatccctgcccctgatgtgctgtgtgacactggggaggttgtgtaccctctctgtgtcttccttttctttttccttttttttttttttttgagatggagtctcactctgtcacccaggctggagtgcagtggcacgatcacagctcattgcaagctccacctcccgagttcacaccattctcctgcctcagcctcccgagtagctgggactacaggtgcccgccacccagcccagctaattttttgtatatttttagtagagacagggtttcaccgtgttagtcaggatggtctcgatctcctgacctcgtgatctgcccacctctgcctcccaaagtgctgggattacaggcttgagccaccgcrcccggcctgtgccttccttttcttgttgtttgtgagagcaaggatgggccggccatgtctcctagtaccagggaggctccccctgcagagggctgagggaagtgctggaggaggtggttggcgaacaccgcagatgtagtgcgtgcgccaccctcccccaccgctttctgtacttggcatctaggcttggcacagagtgaggtggcctggggcagaacatgtcctttccatggcatggcagaaggctgtgtgcctgcaaagcagccatgctccgcccccgacccctgcctgggcactgcaggccccaggcatggtgtctctgggccctgctatctccctcccctgcgatctccctactgcgcctccctgctgcttctctcctgccacyagtcctctggcttcagtcctctgcccacagagttggtttggggcatcatgaccgtcctggagcctcagggacccccagagaagctttggcttctctgaacccagaccctcagggtttctgattccagctctgctgtgtggccttgagtaagtgacagtcagagcctcaccctcctcacctgtaaaatggagctggcaatggggcatgtagtgagatgaggcatgcagagggcctgctctccaccaggccgtgcttggggagcagagccctttgtggtgggtccaggctgcccctctgtcctgaatgcaagccgcctgctcgtgcctttctccctgaaccccaaactccacacattcctgcctccttgcctttaaacactcaggtcctgttgggagtgtcctctctctctctctgctcatctcaaccccatcatccttccagcctggtgctcgacccacccccacggacacttctggcccataccctgtcctagactttctctctctccccttcaagatggaaaggaagtgtcaggctacctggcaggttactcctttcttcccaagtgagtgtgtgagggagagagagatctggttctctttggagatgggagccctttgactgtaagaataggacctctgccgcttaagaacaggccctttgaagggaaagtactcagcaggcaggtgagcttctgggttctagagtctcagagctggaaggactgtctgcagccatccaggtgaacaggtctctgggaaatcccaaagyayatggtggcttgatcgagtgggcggggaagggtccatccgttctctgctccagcccctcatctgccccacttgcccatctctgccccgcagtccatccacctcatttgctccccctccccataaccctagctcctgactgacattcactcagcacctaccacatcccagcctccgttttacacccttgtgtgtatgaaggcatccttacaacaacgcagtggcttctattaggtgtggaggggtgaggtcacctgctctgagctgcccagctggtgaggggcagaggcaggatcagaatccaggcagcctggctccagcatccatcttcactgctgctgagctgtctcttcagccacccaccctctgaccccatcatccttccacctagcgacattccctggccacccggcctgtgccggcctctgccagccacggggctgctgccatcagcagagcaggattccagctccctaggagctcaccacggtgagagggtgacaacctatgattctctaaggctctgattaatttcaccaagggcttcatggcactgggtkctgggagcttggggaggagccgaaactgctgtctgggctggggtagggtagggagagggcagggggagggattcattggttggacagcatgggacattctagtctgggaagcacagagtgcagaggtgttgaggctgggagcgctcaggggacagctgggttctcatcaaagccctaaagatgcagtggcttggcaccaggcctctggggtacttccacgtctgtttcctgccaggatggggtgctgtcaatggctagaagtctgagccttactataatccccagcactggcccactgccctctagggaagtccttccttggatctgacctgcagcccactctgaaaccaccacacattcctgcrcaagcacttcatccagctcttcatgacagccataaataacttcctccagtaatgaatacagtcctggccagcaaggcttgccagagatgctgggcttggcggagagaggaattccatgtcccttccctatgactctgcagctgaaatgttactgggctggtcttcagcagggctccctccctaggcagctatgcaggtgccccccagcccctgcctcattcctcatgcccaccagggacacaagggcaactcagcactcctctctagccacagctccttggaagagcccagaaggcccagctgacaggctaggggatgctggctccaagctgactcagttccctatgtgtgcctctggtggggagcagctgagagatgcagggtctgcttatagtggttcctctcaccgggcaaggctttcctcctctttaggcctcagtcttcccatttggacaatgggatgatctctaagacaaagtttcccaaatgaatctgctcagaaaatgacttgttaaaaatatagcttccagccaggcgcagtggctcacgcctgtaatcccggtgctttgggaggccgaggcgggcggatcacgtgaggccaggagttcaagatcagcctggccaacatggtgaaaccctgtctctactaaaaacaaaaattagccgggcatggtggtgggcctgcaatcccagctactagggaggctaaggcatgagaatcgcttgaactctgaaggcggaggttgcagtgagccgagattgcgctactgcactccagcttgggtgacagagcaagactccatccccccaatccccccaccaaaaaaatacagcttccagctgggcacagcggcttatacctgtaatccaagcattttgggaggctgaggcaggaggatcacttgaacccaggagttcgagactagcctgggcagcatagtgagaccccacctctattttaaaaatgtaaacattaaccaaatgtggtaatgtgtgcctgtagtcccagctacttgggaggctgaggcaggaggatcgcttaaggctgcagtgaactatgatcgtgccactgcactccagcctgggcgacagagtaagaccctgtctcaaaacaaaaaataaaaaaacagcttcccaggccctgacctgggagattctgaccgagtaggtctggaataggagaagtaggaatttatttagggggctgttatgtctttctaatctgtccttttaaacttgcatatagtcacatccctccactaaaccctttttttccccaacactccctttattgaaatctcatcagctcctccccaaaaacctcacgatatagacagggtagggacgattagcccctcgacaacttttcacaaatatacacacgtttaactacttctcaggtcatgataaagaccggccgggcagaaacactgtaatcccagctactcgggagcctgaggcatgagaatcacttgaacctgggaggtggaggttgccatgagccgagatcacgccattgcactacagccttggcgacaagagtgaaactccatctgaaaaaaaacaaaacaaaacatttccattgccccaggaagttccttcatgcaccgcctagtcaatcctcctcccaaggtaaccacttgggaataagactttttccataagcacctcaagtgatttttgtggctcggggcatttgggaaatcgcaaaagaccttcccagcctggacagtctggggctgcgtgctctagaccgggggctccctaagggcaaatacctgaccctgtgagtcctgccaggtacaagctggggcataccagctgatgctccctggaggcacatcagtttattaggctgcttggtagagccttggagggtgtccttggagcaggcctgggagctgggtgggcttggatggggaaggcccccggctgagctgaggtggagagagcttggcacaggggtgtccctgggtaggtcccacatggaggcctgtgcagggcctggcccagtacctgccatcgatgtgacctcttcaccatggccaagtggacctccattttctcacctgtaaagggggacagctctgtctcactctcagggttgttaatgaggacacagcaggtcaggtgtgtcacagtcagcacctggtgcaccgtagttcttgaatgggaaaccaatgttagacgccaaaggaaacagtttcggaggtgcagggactgacccagcaacacacacctgggaagtggtggagcttgggcttggatcagatttgctggctgtgtgacagctcacccagtgacttcattgctaggccttggtttcaaaatgtggtgactgagagtggtgctaaggccctaagtttgggtcacactctcacctaagtgagaacctgaccaaaaagggggaattttaaaacaaaattatgagctgggcgtggtagctcacacctgtaatcctagcactttgggaggccgaggcatgtggattgcctgagctcaggagttcaagaatagcctgggcaacatggtgaaaccccgtctctactaaaaaatacaaaaaaatcagctgggcatggtggcatgcgcctgtagtcccagctactcaggaggctgaggcacgagaattgcttgaacctggaaggcggaggttgcagtgagctaagaccgtgccactgcatgccagcctgggcgacaaagtgaaactgtctcaaaacaaaaacaaaattatgagaggctgttgttttggactaaatgcatacactaggccccaagagaccagacgaaacctaaatagagtcacttgtgctaaatgtgatatcatcaaactaaaactttaaaaagaacacataaatgctaaaaccaggttttgttttgtttttttttcttgtaaacaggacattccaacattaaaaaaaataccctctaacccttaaaaaaaataacctaaagtctttattcccaccttacaaaacccactgtcctactgtttcccagtgggtttcgagaccaaataagtacatttacaatggtgatagtgacatcagtgactcgttttggtcaatgtctcaaaatttaaaaaataactaaaagaagggaattattaaatcaaatctagcctaatgctgccttcttacatattttaagttcagcctagcagtttctctacattgtaaactataagaaatagaggtgtaaacagactatagcctacacttgtgccaatcaccaagttttgggggtttttttgyttttgtttttgtttttgtttttttttaagacagagtctcactctgtcgcccaggctggagtacagcattgtaatctcagctcactacaacctccgccacccgggttcaagcgattctcctgcctcagccacccaagtagctaggattacaggcgcctgccaccatgcccagctaatttttgtatttttagtagagacagggtttcatcatgttggccaggccggtctcgaactcctgacctcaggtgatccaccctcctcagcctcccaaagtgctgggattacaggagtgagccaccatgcccagccaccaattaccaagttttagccaatcaaatgtcgccaactgttcaaaccgtgttcaaatgacaagtgctaagctgtaaccaatctgactgcacctcactttccttttctgttcataaatcttcttctactaagtggctgcgctggttcctactccggctcaggaggctgcctaatttgcagatcgttcattgctcaattaaactcttttaaatttatttttttatattttattttattttattttgagacagagtctcgctctgttgccaggctggagtacagtggcacgatctcagctcactgcaacctctaactctctarttcaagcgattatcctgcctcagcctcccgagtagctgggattataggcacacaccaccatgcccagctaatttttgtatttttagtagacacggggtttcatcatgttggccaggatggtctcgatttcctgacctcgtgatccacccacctcagcctcccaaagtgctgggattgcaggcaattcttttaaatttaattcagctgaagtttttcttttatcaatagggctaataatccccaccctgccagtatcactaggatgttgtgaggatctgacgcaatttgagttacgggaatgttgagaaagaaaagggcgtaatggagtaacgagattagttttcctgttatggtgaggtcagtggcctttctggggtcaagaagaggggactttccttggcaccaagagggtaaaagtgtctcctcctgaccttgggtattttggaccatgggatctgaggtgtaccaggagacaggaagtgtgatcagaaaaggcctggtctaatggtgcacagctgtgcatatccaagtggcttgacctctctgggccgtttctgaatctgtgagatgggaatcataaccactctcctgacttcacaggatgttttaggagagattggatctgggttggggagacaattttggaagcagaaaaggcccctccgtgctggcaacagctcgtccacctccagcctgtgtgtgctgcctcctgggtgactgctggctttaggccagcgcctggcagggcttcactaaagcctccgtaggctgctgctatctcagttctgaggtacgggccgtggagacccccagatttgggcttaaatcccaactccaccattgcacctctgagcctctgtttctctgcaaatggggatactagtccctagcccagatggggcctggtacacagttggtgctcaataagagcagttcgtcttcttctgagcatgggtgcatccctctggctggggtaagcaccaactcagatttctaggcccatagatgggctggaacagctgctgctgttaggggaaaacctactgtgttactagccaaggggttcccttccatgtttttgccccacagggcacctggcacaatgtctagcatacagtaggtgctttgtccacactggctggtcagttacctccaagctgacagaaactctgtcccgttcccgactgtttccatagaacctagcacagagatactcagcaggtgctctgtaggtgtttgggagtgaggaatgaatgaacaaagttgaatgaasaagcatcgggccctcccccggggctcaaatgggagagaggagcttcgtagcctgctccccctcccaccccagcaccccgtttcatcccttctgactaatccacaaagattaacccagggataaagcgggtcacggccactgacccagggctttggagctagtgtgaccgagtgtgtgcagggcgtggtggctgctcccaggggccctctttgccccaagatggccctcctgtcccccatcctggatgtggtcctcacggtggccctcagcctcctcctcctggggctgatcctgggcctcctttgtttcttcacttgccgcctggccaggccgctcaggtaggggaactcagctggcctgactcsccctgcatcccgccaaattcccygccctaagctcgttcagcttccatttgttctcgtgagatggagcaagmggggcactcatttctcttactcttcatggtggggaaaccaaggcccggagaggttgagccctggcgtcagcctrggcttaaatggcgcatagtcgaagactagccaaaccctctgttgggtttcctaagctacaaaacgggggctcttcatccatattgtgagatcagggatgtaaacagcatggggctgagtggaacatgagggcctaagaaatggtagtgacacgtttgtcccattcttctatcatttgccccagatcttctgagacccagcccaaggctggctttttgccccactccaggatgctcccgggccctctgcctgggttgctgaatcagtcctcagagctaaggcctgcctggctcctcagccccctgcactgaactgccaagtagctgctcctctggcgccacagcctagccggggcttctgcactggccatgcgtaatcaggctacggaggagccgggagcctggcagagaagggagggagggggtggcgatggggctgacacacacccggaggccccattttaagctggcagacattggcagagggtggtgggcagccggggcccccacagccccaaactgggcccctccgcttccagggctgccacagagcagccaggagcctctgcgagggggaggggtcctaggggtggggccagcagggaggctctgggttctgaaggctttcccaggtccccaccctctccttgtcctgagyggaggctatgggagaaggcacctgcctccaggccaagcctatctcaatgcctatccctggggccaaaattcagagcatcccagcctgaactggtggcacttatggaactgctaccatgtgcaagggctcgggatgcagagatgggtaagatgwtggtctttacgttcacagagcttcaggctagcagggaggagagacagaccaataaccggaagaataatcatgtggggctggatgagcctttcagtgctccygggtcactacacttttatttttctttattcgctcacctgttttggaccctcagtgcagagagagtgggatacgttatctcacttagcacatgacatacccaaataagctctcagttcttgttttgtttattcattttttcctttgtccctgctccctgcctccccactgccattcccacagctcaccgaagtccctatgctaatgtacttaatatggccttggagttgtaagtgtccttgtacgttacacagcattctgtccgtgggggtggtttgcacttacatacactgcrtttgattctttacattcatcactcagtcctctgcctttagaccccaccacgctgctgtttggacatctagttttaataccactgccacgcagacattgcctccaccactccttactaattcatttccctagttgtggacgagactgccccggctcctcaccatcataagccagtgttaaaaggagtttgccaaagctttctccagcgagtatgatggtttctgcaggttcttggcataaagcctttatcagattaaggaaattcttttcaatacctggtttgctgagggcttctgtcacatcgttttctgtgaccccattccctctccctaggtgagcacgtcaagtttgatcagggtgttaactgccacccctgtgcctatgattcccaaatttatactctaacccagacttctttttcaaatgccagagccaaatattcagctgcctccttagtgtctccacttctaaaagacatctccaactcaacatatccaaaaacaagttcctgattgtctccacctcaygcctcaaaagaccaccccaaacgccgaaaggctgaatgcttttttctttttcttttttttttttttctgagatggagtctcactctgttgcccaggctggactgcagtgatgcgatctcagctcactgcaaactctgcttcctgggttcaagtgattctcctrcctcagcctctcaggtagctgggactacaggtgcacaccaccatgcccagctaatttttgtagagagagtttcaccatgttggccaggctggtctcaaacacctgaccttaagggatccacccgcctcagcctctcaaagtgctgggattacaggtgtgagccatcgcacttggctcggtagtatatggctcagaaacattgccatttacaatagttccccaaaaagcaaaattcttaggtataaatctggattcagagtccagaatgctaaccattacacgatggaacccgtaggtataaatctaagaaaacatatccaagatctacaggctgaagactacagagtgctgataaaaccgaagaactctgactgaatgagtggagagacgtggtgtcttcatgactgggcaaytccatgtggtatagacgtaaaccctcccacattgatctgtggatttaataccatacctatcaaaaacacagtggtggaggacagatcagggatcgccaggtttagggatggggggattgtgtaactataaagaacgcaagagagatttttggggtggcagagctgttctgggtcctgacggtggcggtggtggttacataaatctatccatgtgtcaaacgtcagaacactcattttacacttgggggcaacagaaatccctccctctggagggggtgactgatggtaacctgattgctaattctggaatcaggagccctgtggtcaggtttctgctctgcaacttcctgttggtaaccttgggcaagtctccgtccagagccttggttttctcatctgtaaaaggagatgataggtccttttctgtccactgcatagctgattagtgaaacatcatggtgaaattctttatgaactatggagtgcagcacatagacttgctttcattttgtcagtatcctttatagattgttcatgtaagctcccaaagagtagtatttattttattgaaataaaatgcaygtagagaaaaatgtgtgtatcatacattgacagctgaacccaccgtgtaaccagcacccacccacccagatcaatcataaaccgaaccgcaccagcaccccagcagcccgttcccgtttccgtaccctccacgtggagcctccgttctgtctcccaacgccctgggttagtttttatactttctgtcatcggaatcacactgtaagtgctcttgggtttagcttcctttgctcaagcttaccttgtgcgattcattcatgttgttgtgaggagctgtggatcatccattctccttgctgtctgtggtggtttctgtgttgtgaacacacacaatgtattatccagcctgccgtagatggaggcagttttgaagccattataaacagggctgatgtgcacattctgctggagagaaacgggtcccagggtacaggtaggatgatcagcttcggtagatcctgccggttttcccatgcgctgtgcctgtctgcactccaccaacggcgagcggaccttccggtagttaaacatcttcacgaactcttggactttcctgcacacacagagaagataattttggatggctcttcccttccccccacaaccttccttagggcactggctttcaactgatgtaaatatttactatgccaagcactaggagggcagagacaaacaagacaaagtcctcacacttagaaactcccggtgtggcagctgagatggcccaggaaagaactatattaccttcaaaaagagaggtacatgcgatgtttgaggtggcatgaagctcagtggtgttatattggaatgagtgagtgaccatcctggagccttcctgaaagaggtgacttcatttttaagtgattttaaataatagtttaatgaattagtatttcgtattcagttaataacatttttctgattttaggatttgctatagaaatatttggaaaccgtaaagtagaacaaaaaaaaaatgtaggaatcatctgaaattccaaattctaccactcacagttaagtgttgttagatgttagatgtgggatattgccttttaatttccactctgcgccgctacccccagcccctaccccagagccgtcacttctggcactggagcgcagcttgcgtggttttttttttttttttttttttttttgagacagagtctcgctgtcgcccaggctggagtgcagtggcgcgatctcggctcactgcaagctccgcctcccgggttcacgccattctcctgcctcagcctcctgagtagctgggactacaggcgcccgctacctctcccggctaattttttgtatttttagtagagacggggtttcactgtgttagccaggatggtctcgatctcctgacttcgtgatccgcccgcctcggcctcccaaagtgctgggattacaggcgtgagccaccgcgcccggccatttgcgtgtttttaaggttgaatcaagatccttcttctggtggtagtggtttctttttctcccttcccttcccttccctttcctcccctcccctcccctccgctgcctcttccctccccgcccggcccggcgcgggcgggggcgttgccttccctcccctcccctcccctccctccttccttttctccttttctttttctctatttttaaattaaaaaaaaaaatcttggatgggcgcggcagctcacacctgtaatcccagcactttgggaggccaaggtgggcagatcacctgaggtcgggagttcgagaccagcctgaccaacatggaccccatctctactaaaaatacaaaattggccgggcatggtggcgcaagcctgtaatcccagccactcgggaggctgaggcaggaaaattgcttgaacccggggggcggaggttgcagtgagccgaggttgtgccattgcactccagcctgggcaacaagaacaaaactccgtctcaaaaaaaaaaaaaagaaaaagaaaaaatctttttcctttgagctggagctgcaaagagaagaatttttaaaaagaaaagaaacttttaaaaaattaaaatacaaaaatttttcttagagacagggtctcgctgtgttgcccaggctggtctccaactccaggcctgaagcgaacttcctccagcctcagcttcccaagtagctgggattacaggcatgttaccaccatgcctggctttttttctttaaacaacttttaaaaaatgttttattttgtttttacttaacatataataattggactagagtggtgtcttatctgtcacaacacttttctaacggtagagtgtgtattactgctgtttcccacaacaaatggtgtcatatcttggttttggctgaagcaataacatttcccagtgaaactcttgccacttaaaattctttgtcttgtaactcatgtgcaacagggttagtacatttctcagctgccagtggggttgttctttgtgatttaacaggaagaccacagtgtaaaaacattcttatgccattaatacatgcttgttttaggctacttggaaaattcaaaaaaataaaaaaaagaggaaataatcattcatagtcctaccacccagagaaaaccacagttaatgttttggtgtatttccttccagttttttttttccacctaaactcttcaattacatccgactttaaatatatatatattttttaaaaattgtaaagataatactgtatctcagcacaaaagaaaattttggaaatgcagaaaagacaatggaaaagaaaaatcagttgtctgtgatgtcaccacccagaaatggccacacttaccagccagttttttcacatatgtgactcctaccatttttatatctcttaccataaacgacaagctctagaagagaatgtagcaaatgtaggggtcctgaaagaaggggtgcactctgttttgtccctgatgttcctgggacacaggtaattaaaaggctgaagaccgagtgctgtagaacagggcttctcaaggtgtggtccgcaaagcagcaaagcagcagcttctcctgggagcttattagaartacaatcggagcctcaccagtgggccgggaatctgttgtaacaagcccttgggggattcagatgcttgctctccttacagtttgagaaacactgcaccaaaagattggactctgggaggtagggggcttcagatgaattgaaagtggaaattcacttaggaaatgggacggaactgctttgcagcatggaactcattgacactgacacagctgtttgtgtggttaagcttcctgagacagggaccagctgggtttggcatcccaatgttgagccccatgcctggtctgtaataggtgctcaccgaatacttgttgaatgaatcaaggaatgaataagtgagtgaaaaaggatctctagagctgtgccccacatgcctctttttctctttttttaatttctaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccaggtatgcttggggacacaggtggaggcataaaaaggtggtgcagatggggtatgatgagggcagtgtctatgttttaaggtcccagaaccatccaaagtatttaagagctgaaaacagtgtwcagagcaggaaacctcagccctgctacttgcatgtgttagttggataggtcactcttttcccatatatatatatatatatacacacatacacatatatgaaatatatatatacaaggaaaatatatatatacaaggaaatatatattttccacatatatatttttccatatatatatttcatatatatatttttccatatatatatttcatatatattatatatattctttcttaatttttttttttttgagacagggtttcgctctgttgcccaagctagagtgcagtggcgccatcttggctcactgcaagctctgcctcctgggttcacgccattctcctgcctcagcctcccaagtagctgggactacaggtgcccgccaccgcgccaggctaattttttgtatttttagtagagatggggtttcaccgtgttagccaggatggtctcgatctcctgacctcatgatccgcctgcctcggcctcccaaagtgctgggattacaggcgtgagccaccgcbcctggcctttctttctttctttctttctttctttctttctttctttctttctttctttctttctttctctctttctttctttttctttctttctttctttctcttttctttctttctttctttcttttctttttctttcctttctttcctttcttttctctcgcatccgagtgaagagaccaccaaacaggctttgagtgagcaacaaggctgtttatttcacctgggtgcaggcgggctaagtccaaaaagagagtcagccaagggagatatgggtggggccgttttataagataggggtaggtaaaggaaaaattacagtcaaaggggggttctctggcgggcaggagtgggggtcacaaggtgctcagtgggggagctttttgagccaggatgagccaggagaaggaatttcacaaggtaatgtcgtcagttaaggcaaggaccggccattttcacttcttttgtggtggaatgtcatcagttaaggtaggaacagaccatttaaatttcacttcttttgtgattcttcagttacttcaggccgtctggatgtatatgtgcaggtcacaggggatatgatggcttagcttgggctcagacgcctgacactttctttttgagacagagacagactctcactctgtttgcccaggatggagtgcagtgacgtgatctcagctcactgcaaccttcgccacccaggttcaagtgatcctcctgcctcagcctcctgagtagctgggattacaggcrtgcgccgcaacaccyggctaattttttgtattcttattagagacggggtttcatcatgttggccaggctgatctcgaactcctgacctcaagtgatccacccgccttggcctcccaaagtgctgggattacaggtgtgagccactgtgcccagcctttttcttgtcatttgtagttctcactagtgaactcatcttcaacaggagttttttgtttttcttttttttgagacagtgtctctctctgtcgcccaggctggagtgcagtggcgcaatcttggctcactgcaagctccatctcccgggttcacgccattctcctgcctcagcctcccaagtagctgggactacaggtgcccgccaccacgcgcagctaatttttttgtacttttagtagagacggggtttcaccatgttagccaggatggtctcgatctcctgacctcaggtgatccgcctgccttggcctcctaaagtgctgggattacaggcatgagccaccgcacccggccgagttttttgtttttctgttggagattcacgcggaagtgtttccacagcatggcatggtgttttcaggacactaggggttcaactaattctaggccagtttttatgttgatttcttggtttacaattcttatactataaattcagatccccacttagacctggctcagatttgacttgaattcacatttcttatgaatgactgtctttctctatcccttccatagctccaaggcaaaatgtgtaccttaaaacarcttcagcagacctggtgtggtggctttagcaggcctggtatggtggctcacgcctgtaatcccagtgcgttgggaggctgaggtgggaggatcgcttgagtccaggagtttgaggacagcctgggcaacatagtgagacctccatctctagaaacaaacaaacaattagctgggcatagtgctgcatgcttgtagtcctagctacttgggaggctaaggtgggagaatcacttgagcccaggatttcaagattacggtgagctataatcaaaccactccagtctgggtgacagagtaagactctgtctcataaaaagaaaccagcttctggccgggaatggtggctcacgcctgtaatcccagcactttgggaggccgaggtaggtggatcacttgaggtcaggagtttgagaccagcctatccaacatggcaaaaactcctctctactaaaaatacaaaaattagctgggcatggtggcgcactcctgtaatgccagctacttgggaggctgaggcaggagaatcacttgaacccaggaggcggaggttgcagtgagctgagattgcgccactgtacttcagcctgggcaacagagcaagactccatctcaaaaaagaaaagaaaccagcttcagcctgaacctgtacctggcttgccgtcgcaggcgttcctctctgcatcagctcctgtgggcccctctggttttagattccctcatcaatgctgcctcctgaggattttccttcccccttttcttcctttttcaagctatgtgctatttttttttccccagcatttctgtatctggagctggagaagagagccttcctcggctcagtccattatgtggctagaagtccccacttgccttccccacactccagtgtctccatctgtccagtggggatgagttcctcccgcttagggtcatcatgggaatcacatgggatagtcacagtgtctggcaaggagtggatgctcagtgaatgttggtctcttctcttaggacggctgtatttcagcagatgaggagatggggtgcagtggggcactgagcctgagctgctgagctctcaggccattgctgcgtctgagacctcgtggtgccatttgcatccctgggggaccaaggtcactctgggacggggtccctgccttctcagcacttacagcccacctgggtgaaagatgaactaatggatgaaaagggaaaaggtgaaaaagtgacaacatgaaaaatcttcaaacgttcagcagttcaactttttgtatctgctgttgccaggctggagtgcagtggcacaatcatggcttactgtagcctcaaactcctggcctcaagcagtcctcccaccatggcctccaaaagtgctgggattacaggatgagccacttcttcagccttcttttttttcttcaattagatataacttacagaaaagggcaccgatcttaaatacatagcctgaaaaaattttgacatatatttatacccrtgtaaccgccacccagatcaagacagaacatttctggttgtgaggcatctgtgggcttccctgtgccaaccccctcccaaagccagaggagatgcccaggcttacattggccaccagagacttgctttgcctgttttgagcctcatataaatggaatcatatagtatgtaccgatcagtgccctttcccyggcattctatcgtgagcattagcacatatcatttagtagtctccaaaaacaatagcctcttggaatccagttgtccagagccattgttgcttaaaccagactccaaacccttctcagggacaggccctgggtggctctggtgaaaaagacaaggactctgcccttgtgggactccagtctagagagaacaagcactcaacggagcaggggacccggtggcagaggctgggctgaacaagggcaacaggtgtggggcgggctgatgtcagcccagccctgggacctccaagctgttaagtcaggtacaggttgtagcgggtcagggtgggtagaaggtcttcaccacccagtggcacccaactggccaaagaggctctatgaccaacagcaccgtggtgtgttttgaggaaggcaggagggaggctggaaccagcctgggcctgggggacctctgaggaaaacctctggccccggccttgcccagactttatctcatgtcatcctagaactgcctgtggatagctacgggtgtcccatttcctggggcagaaactcttgtccaaaggcaccctgtcgggcagaagggccaaggtgctcccaattcccagtgggkactgcgtggggacatctgaaattgatgccctcagcagacacttccagaagagagagggtggacctggggctgtygggatgagggtagtgggctgagggattggggtggtggtgacgtaaggggaggcctcttggggaggggcgtggggtgtgcttgggtccaaagctagaggtgcactgcagcaccctggcggctcctcgcctgtgctctgcgcctatgctaggctggggcagagccacggcgacgcgtgagtttccggttctcccacttggggccctaatctcaggctctccatttcctaatgtggaggagacactggtgcccacctgccaaggcagttgagaggaataagagaagctgtgtggggggtccctggcatctcgcccagagccagtgcgtgtgtgaggaaggagggctgttctttacccacggccactccgagagccaggcacgcgtcggagctgggccaaaagatgagaattgtgtccccagcccacgaacatgctacacggccttggacaagaccctcccattcctgatctctcctcccgttctgtgcagtgggaggccttgaaagaggaaaccgctagggagcctcctctctaggcttctgagcagatctgatagggccctgggacagaggggagccccgcagactctgggagggactccagctcccatagccagggtcctggtccagccctggagacgggataatggggatgggaggcaacttttgagcctctcctgtgggtcaggtgtgtcacttgccttatccggcccagtccttagagcgaccctgaggggatgatgccagcaatgtcatttaacaggggaagagactgaggctgagggaggtgrcagagctagtacttggagcagctgggggttttttgtttgtttgtttttgagayggagtctagctctgtcacccaggctggagtgcagtggtatgatctcagctcactgcaacctccgcctcccgggttcaagcagttctcctgcctcagcctcctgagtagctgggactacaggtgcacactgccacgcccagctaatttttcatatttcagtagagacgggatatcaccgtgttgcccaagttggtcgcgaactcctgagctcaggtgatctgcctgcctcggccttccaaagtgctgggattacaggcatgagccaccatgcccagcagctggggttttaattgaggtctgtctggcactaaagctgtggattggttgctggacacacacacacatgagaaagagggagagagaaagaagtgttcttagttctcattttatctcaaaaccataaagccccagccagaagtcactatcagccaagagggatggagggggcgatgagagatgcagaatgtcgtccttgataactaatcctaacaagagtgagatcacctggctcctttaaatttgacatattaagcaaaaggcaagcttcgctttccagcactgctattaaaccaagtcaggttcctgctgagcctactttaatgaataagctaagcagagttgataattgatggctggctatatcaggggaccccttctgctggaaggagtttgttgaataggttaaacattactctcttaattgtgctagcacaattcatttgctgccttagcagctcatctccctactgggtagaaggaatgagcatgggctttggagcgaaayccagccctgccagtgtctgcctgtgctgtgtggccttaggcaagttgctcgttgtctctgagccttggtttcttcattctgagatgtgaggagaagaccccagggtccacaggcttttctggaggatctggatggcacatatttataaaccacagatgtgttgtctgggtgggcaactattgcacccacctccaagttcaggcattccagcctgagcaatcagaagtggggggatctgtacgtctggagataggaggctatccttaccccgccaagtaactgcctctctctgtgtttagagaaagagaaagaccccaagtactggcgagaccaagcgcaagagacactgaaatatgycctggagcttyagaagctcaacaccaacgtggctaagaatgtcatcatgttcctgggagatggtgaggcccaggggcctgtgggaggggtggaacaggacacctagctaggagmcccgggagccaggctgagttgaaggggkctgtgttgaaggggctagggctctggaggaagggtgtttaaaaggatgaggggccaggctgtggattcaagaggcctgctctgccagacagccccctgaggatctgggggtgaagggagagaggggcygctcactgacatttacagagccatgcccagtgccaactgcccgagcctgccttggtaccgaactagagagcttctgggtacccaagcaggctgattggagaggcaggagcacgagagactgaggcccccactccccactgcagggwtggktgtctccacagtgayggctgcccgcatcctcaagrgtcrgctccaccacaaccctggggaggagaccaggctggagatggacaagttccccttcgtggccctctccaaggtgagccccatccccaagcccagttcaggtctgtatatccagtatccaggtcgagcatctgaacatgacagcagccagaggtcccctgaccccctgagccccctccatgcccaagcccactccccacctggagcagccactgccctgacttctgacaccatagcatcactgtacctgcttgcgggtgtgtgtttagagagagggtcttgctctgttgcccaggctgcagtgcagtggtgcagtcatagctcactgcagcctccaactcctgggctcaagccatcctcccacgttagcctcccgagtagctgggactacaggtgtgtaccaccacatatggataattagagacccccccaaggtctctaattcttgggcttaagcgatcctacagccttggcctcccagtcttgggattacaggcgtgagccaccatgcacggcctatatatgcctttttttttttttttttttgagacagtcttactctgtcttccaggctggagtacagtagcatgacatcagctcactgcaacctctgcctcccgagttcaagtgattcttctgcctcagcctcccaagtagctgggattacaggcatgcgccaccatgcccagctaatttttttatttttagtagagacaaggtttcaccctgttggccaggctggtctcgaactcctgaccccaggtgatctgcccaccttggcctcccaaagtgctaggattacaggcatgagccaccgtgcctggcctgtatacacttttgcatgaagttccagttcattcattctttcccgaggcagttcgtgaagttaattagactataggcatacctcagctatacttcgggtttggttccaggccactgtaataaagcaaatattgcaatgaagcaagtcacacattttttggtttcccagtgcatataaaagttatgtttgcaccctacagtagtcttttaagtgtgggatagcattatgtctaaaraaatgtatataccttaatttaaaaatatgctattgctaaaaaacgctaatgaagtgagctcatgtttttggaaaaaatgatgctgatagacttgcttgacacagggttgccacagatcttcaatttgtaacaaacacagtgtctgtggagtacactaaaatgaggtgtgcctgtactgacctaggttgttcaaggcagtgtrcactgccgggtagctattgctattggtggtggtgatagtggtgttatgtaataacctccagaccctgggtcaggccccaggctcacttctgggggagtagtggggactatggtrccttcygtgccttcaaggtgctctcaggctggtggggaagggagacaggcaaatagttttggggtctctgctaaacatccggatgtagggcaaccctgtgatggtggccgcagggcaggtggcagagaagtcrgcgctggtcttggccccacccttsccttccccagtccccttccccctcactttcactaccctatccccagamcccccactccttcaagaaggcccctccctctcccttctccaggactcccctgctccccaacccctygctggctcctgcagccccaggcccggagagaggcctccgctgaccccacctgagccccratcttccgccggacacttctctgtactttggagagmtaagrtcctgccccagtgctgccagggtgcagggaatgatggcaggaagcaggcagctaggtagtcctgtggctctggggggcttcagtgggcagtgggcctggtcaaggctatggggtcctctctggtycctcacgccccagtccccatggtgtgagtgtaggcggggtgggtgccactggggmgaaggcctggccatctcctgaccctcctctcccacctgcagaygtacaacaccaatgcccaggtccctgacagygccggcaccgscaccrcctacctgtgtrgggtgaaggccartgagggcaccrtgrgggtaagcgyagccamtgagcrttcccggtgcaacaccacccaggggaacgaggtcacctccatcctgcrctgggccaaggacgctggtgagtcgggggagcagtggggagcagggccagcttcgtggcctgtccaggcctcagtctttctgactgtgtcatgggaaggggctagaaaaggcttctctgtggggctcccagctctgatrtgctgggagtctgtaatatccatgggattccttccgtgacaggggaagctgagggtttggggttcactcagtggtgggttctggtcccagttcatttctctgagtcgattcttcatttgactataaaacgggtgggaacgtagccccctcatagggttggtgtgaggagggagaagtcagcccagggctagcctgtggggtgcagtccatggccacgccccttccctcctcagaattgggaggcccagcctgtgcccccagaagctttagtcaggggccaaggccaaaacacaggtgacaaggccaacatacaggtgacagagccacagtccacttgagatccctcaggggtcctgtgggcgccttgatgaaggggaggactccagcccaggtgctcacatctcaagggccttcggggtgaggggagagggttccagaggcagtgttctggctgctcggctacttggaagccactgccagacacctrctgctgtggatggggagactgagacccgggcaatcctcagaactgaagcgggggcctgtctttagcggggagggggargggagggaggaggcctctgggacaccccgatctgtggataaagccaaacccgcccctcctgcaccccagggaaatctgtggkcattgtgaccaccacgagagtgaaccrtgccacccccagcrccrcctacrcccactyggctgacygggactggtactcagacaacrrgatgccccctgaggccttgagccagggctrtaaggacatcgcctaccagctcatgcatracwtcagggacattgacgtgagtgctcgggggcagccgggcagggacggggtgaggcggggcctctggtgggcaggaggcctcaggcccaggctggcccggagaaagcagcctggcctggctccccacacacctgggaggctcccagcccattaggggatttgcggttgggcaggcaggcactgtgggatttctctgcggtggggctgcggggtgaaccctcatgtgaccgccaccacaccccaagaaccaggcatccagggatgattccataaattgaaacctggtgctgtgccctcctctgccccccactacaygggaggtggtgatggccaagtgtcgtctgcctgccctgcgtattcacatggtcacagatgggtacatatctgtacactcaaccaccagcatgcccggcaaagagctggtgtgtacagtggttggctagtgccagctctcgtgtttaaacttccgagttccagaccttgccctgcgtgttgctagctgtgtgaccttgggtcagttacttaacctctctgaggcttccctttcacaactcctttgtgaactgtacctgcctcataagcttatgccaagaactgattaagataatccctgtggagctcagcacaggacccgaggcctagcgagtgcccagaaggtggtggcacttacgcaggagccacatgtccttgccctgaaacacacttcaacaaactgagctgactcatggagacagaagtcatccatgtgacgcttactctctgttcttaagtgagaatgcccggctcgttccttttcaggcttttattgcctactgtgggggactgctgaggcgatctggggacttctgccccttgagcctggaatggggattcggtgaggggcagagaaagcccccctgcccagctacacctcacctctttctctccaccaccagacaaactcacctgccttcagccctccatgcactgccccccacaaatttctgggggctacttggcccctccacagtagagacccacgtctgcccttttcccagcatrgtggattaagtacccgctttcaggacacacagtgctgttggcccctttcactgaacagacatctgaggccaagccactcatcctggcttgccttcacccgacatgtggcctggggcgagttccttcmcctccctatgcctcagtttccccacctgtgcagcagaaacagagagccacacttgcttgctcccagggcygtgggaggccgtgatgaggtcatggatgtgagaacatttgttgtacaggcacagggtataattacatggggactgctcctcagaggggtttgtcagggacagcctgagcaggggacaggaacttgaaggaaattcgaggggagggaagatgtttcaggtgagggggtgggagatgaggagggggggccrcaggggccacgtcaaggggcacaagccagggagtgagtgaggacggaggacctgtgtgaggatccctttctttcctcctcttcctttctctcccagccccacctgcctctccgtcaccacccccccaaaagcctcccagtccccagactgtacatgaaacaaaaatcctggtgtccaccctgaaaataaatactgttgcttaaaaaaaaaaaagaaagaagagaaagaaagaaagaaagacacaaacctaaaccccaaagccaaacagcaagtctgttatttgggagtttaatgagcccgtgtgaagtcgctgccgggctggaaacgatgaggctccctgcaggaagattgggggcttygttttccactctgaagatgccaagaggtcaggttctgtgggaacagttgtggggggcggggcaagggacccgtgacctggggtccccttctccttcttctcccagcccaccctgccccctgagctcctggctgcagctgagagcaaggactctgcctctctgaaccacttgtttccccactccttctggcaatagaaatgccttccagtggcagccaccccctgggtgctggggacttccctgggtgactgcctttcctcctgtgatgggtctgtggatggatgttagttgcattttatttattattattattttgagacggagtctcattctgtctctaaggctggagtgtagtggtgcgatcttggctcactgcagccttcacctcccgggttcaagcgattgtcctgcctcagcctcctgagtagctgggattataggcgcacatcaccacgcccggctaattttttttttttaaatttttagtagagacggggtttcrccatgttggccaggctggtctcaaactctggacctcaggtgatccgcccgttttggcctcccaaagtgctggcattataggcgtgagccatcgcgcccggcctattttattttatttttgagacagggtctcactctgttgcccaggctggagtgcagtggcgtgatcatggctcacttcagtctcagcctcctgggctcaagtgctcctcctggctcagtcccttgaatagctaggagcacaagcctgtaccaccatgcccggctaagtttcgaaacaaattttatttgtatagacagggtcttgccatgttgtccaggctggtctcaaactcctggcatcaagtgatcctcccgcctcagmctcccaaagtgctgggattacaggcatgagccaccgcgcctggccagtcgcattttatggataggaaaactgggctcacagagtttaggtggcaggcccttggtcagtagtcgatagagtcagggttcaaacccaagtctgacttcaaagctcacggccatgaccatggcctggacccaggctggtcctggggcacctttcccacctctccagccatcctgtgttcctggccccctgtgcattccacaaaacctaggatctaaggtgggagacagagtggaggatagagcaagggacctatgagatgcaggcctggaatggtggatctggggccagtgtcagccaggctctgcactcccaaggtgtcagccaggggcagtggcccgggctggcacccgcggtgacaagagaacactagtgtggtggtcaccgcaggcggctgctgttatgctcttggccctactttaaaaatagtcagaacttcaaacatggactcccaaggaaaacaaacagtcccgcgtccgtctgcccgcacacaccagctggtgggtaaaattagcctggtggtgactacagagccgtgaggcccggccccgctgtttgcccaggctgcggtgggctggctcccagctgtgggctgccccaaagacctccctggctggagcctctccctgcacgcattcagccttccaccgtgggagaggaggctctgggagtccctgccctyagctgcacgaatacagcagggccctagtgccayagccggaaaagccctgggtttgaatcctgatgctgccacttcctggctctgtggccttcgggggaaaaaaccaatttctgtgcccatttttttagttggaaaacaggtggccagggtttattgcagccttggtatgaagttgagtcagaatgtatcttaaatgcttagtgcctgacacacagggaacgctctgtaaatggtcygattcttattcgagtgggagttctgtggattccgggaagccaagtaaggtaagttatcagctcctccaatatccctagaagcgccaaaccaccgtcccaatagactcgtgatttcatctccccacgctggacaagtaaggcccagagatgactgaggcctggctcaccaggctgggaaagtgtccacaccatctccagggactccaggagtccaggttccaagccgaggtcactggggcttctgggcatcttggaaccctgcagaagtgatggctcctgtctcttttaggtgatcatggkgggtggcyrgraatacatgtaccccaagaataaaactgatgtggrgtatgagagtgacgagaaagccaggggcacgagkctggacgkcctggacctcgttgacacctggaagagcttcaaaccgagayacaaggtagcctgtgctggggccatgtggctgcagaggtggcctgtgatkgggagaggctgtgtgacccctgctctgaagytctgttgtcctctgtagaaagggcatcggaaatctttcctccatgggctcaaatggcctaagagatatacaagcagtagatagtcagtgactaatcatttccttcccttggaggggataccagagagaggyrgatggtgaggaggaggctgggccagggaataacctgcgtggacattsagtcaccctgagyacctattgtatgtaggcacctggcggggcatgcgtgaggcacagaggctgagycagatggccaaggaaacatggaatgctgtgtgcctgcatgggggacgcctggctctgcaggcgccctggggggacagatgacagggaggagccaagaagctctgggcaagtaggaggatggagggaggaggcagcgctggatggatcaggggaggacatggttggccccagtgtgcaagccatggagggagcggagaagccctccacagtgagtcccccttggctgggggatggaatagattggggaagggaggctggaggamggaatagattggggaagggaggctggagggacctctggaaggaccccaagctccagctccttggagtggcctctggccctttaaatctgagctgctggcctgcgggcctggggcagctggggtctggaaatgactgtggtcasggctgaagacagtggggagtagcctggcagccactttgatgtcactctggggttgggtttctgcaagttccaggactggcccctggggaggcctcgtgggatgaggctgggccaagaacraggtgggggtagggactagggaagggcccccgtggggwtggtgggggtgyggaactgagtggctttgaaccctttccatcccttctgagtcagctcaggctgggccagagccccctccaagctcaagccagagagacaccagcctcagtttctctacgtggcacatggggccagagcttcatcctccttgcccaggcagggtgcttacccaggarctcggtctagacctctaagacggggagagagcgtctacaccatggccccgagcctggccacattgggtatcaggtcccgtgtaggccccacatccctagaaaatcatgccttaagagtgggttttagagtcagtttcacctttaccattcagtggctacgtggtctgtgtgcctyggtgccctcatctgtaaagagggaataacaggaacaaccctggagggagagagcacaggagagccacctccaggaagcaggggctgggagggggggtgcggagccccactttctgagcctctctgccctcctccccacaacagcccctgaggcttgcaaagccactgatcccactgtcattgctaagagaaggcagggggtcttctaagggcacacagcagatccttggtagtgctgggacccctggtccaggcccacatggtgccctctccaggcctggcctagctggcttctttctgtggactttattccctggggaaacagccacgcctttatctcccctcccagatggggtccccaaagcagagctggggctttgcttcctccctggccctccacggcctccagaaaacagcccacacctgtcagcactcaaggcccctggagacctgtgcctggctcttctttgccccatgatccctcctccctggaatagccttcctgaccctaggctgttcaattcccacttgtcctccagggacccattagaacatcacctccaccaggaagccctccctggtcctgtgtctgggctcacggcctccctgggctctatcagaattctcatccccttgcattatacattataatgggctattgattcatcatttcttgaggtcagggatggtgggtcctcagggagagatttttaagtgagggaaggaaacaagtaaaggcctcagactctgatagctgctggggtcagtccttccgactctccctagccccyggcatgtgctgacacagcccttcctcctagcactcccacttcatctrgaaccgcacggaactcctgacccttgacccccacaatgtggactacctattgggtaagtggagggggtggagkggaggatgcatggctcggagcctggtggccrgagctgygtgtggccagcacctggggacaaggccctagcctgacgcccacttaggggcctctgctcttgggcttcaggacctgggagaggcaaggaagggggttctggttcctggaattaggcctgaaatctgctggctgtgcagggggattagcctcattgggcacaagaagaaactgaagctcagagaggggagtggcccgcggcatgyggcacaastgacagcggtacggcccaggcaagtttgagccctggctgggaactgggacttaacagctcctgggctatggagcctgggacctggagtcagctctactgtgtgcatggccagggcagaagccagccaagttatctctgcccatcctgacgattgccctcctccccaggcagtggggagcatgtggtgagggcccaggggcagcttcaggtctggtgggatgcagccctgagcaccaccatgcagctatccgggttttcttttccagctgtctgtagtgccaagcaagtggtggcaaaatctcctgcagacatttcccaaggaacacagctccgcgtcctgggtgtcattagaggttatgggctcagagctgtgcacctggtgggtcctccagacacatgcacacagcctcttgcttgcctgggtcacatggcacacacccagtaccacatgggctgtgcatgcacccgtgtatcatgctggttttgctcatggatcttagagccagagtgctgggttcaaatccagctctaccacctctaagctgtgtgaccttgggcaagtgatttctcctctttctgcctcagtttcctcttctataaagtagggataatgatgctcccataaaatggagatagtgrtggggctggagacaacccctgggttgtcatgagcatgacatgaacttgtgttgtataagttatctgttgctgtataacaaattatctcaaaacttaggccaggtgcaggccgggtgyrgtggctcaygcctgtaatcccagcactttgggaggccgaggtgggcggagcacaaggtcaggagatcgagaccatcctggctaacgaggtgaaaccccatctctactaaaaatacaaaaaattagcctggcgtggtggcgggcgcctgtagtcccagctactcaggaggctgaggcaggagaatggtatgaacccgggaggcggaggttacagtgagccaagatcgcaccactgcactccagcctgggtgacagagcaagactccgtctaaaaacaaaaaacaaagaacaaacacgaaaaaacttaggccrggtgcaatggctcgcgcctgtaatcctagcactttgggaggccaaggcaggttgatcacttgagcccaggagtttgagaccagcctgggaaacatagcgagacctcaattctacaaaaattttttaaaaactggccaggtgtggtggcgcacacctttagtcccagctactcaggaggctgaggtaggaggatccacctgagcccaggaggttgaggctgcagtgagttgtgattatgccactgcactccagcctgggtgacagagcaagaccctatcttaaaaaaaagaaagaaagaaaacattagccaggtgtggtggtgccagccactcaggaagctgacgtgggaggcttgcttgagcccaagagtttgaggctgcagtgagctatgatcatgccactgcaccagtttgggcaacagagtgagaccctgtcacaaaacaaaacttaacagtttaaaacaagagtaaacatttattgcctcactcaatttctttgggtcaggaatctggggacagcttagctgggtctcccatgaggtcacagtcatctgaaggcttgactggggctggtgcttccaggatggttcactcacatggctggcgagttggtcttggctgttggcaggaggcctcagttccttggcacattgctctctatagagcagcttgagtgtcctcattacatggtggctggcttcccacagagatccaagagtatataaacagaagctacaacattttatgccccagccttcgaaatcacacaccatcatttcggtggcattctatggcatacaaaggctagtgtgggaggagaccacacaagcgcgtgaattccagggggcaggggttattgggcaccatcttggaggctggcttttgcctgcttccaaagcgctaacagcatgtggcaccaagtgaaccctgtgtgcatgggagctattgttcggctgtgtacccactcacagaggggcagggtgttctggaaggacaccagaattggaaggacaccagaatcagaagcaccagcatgggacacatggaactttgtgccatgggcaaggaatggatcattctccttatgtcacaagtgagaaaacggagcccagtgagcaggagggacaatgattccaaaccttctgctgtttcgctgcacaggccaccgtgcccttcaaatccaacatgtaaatgcacacacactctagcggccccatcgagtccaggctgtgaccctctgccttggggccacagtgctgtgtgctgagccctgcaggctggaggcaractgactgatggatttgaaccccagatctgccacttctcagctgacaatagcaagttatggaacacctctgggcctcagtgctcctcatctgtgaaacgggcatggtgatcccaccgcgccatagtggtgggaatgaaaatgaaaggaattggggctgggtgcggaggctcacgcctgtaatcccaacactttgggaggccgaggtgggcggatgacctgaggtcaggagttcgagaccagcctggctaacatggtgaaaccctgtctctacttaaaatacaacaaaaattagctgggtgtggtgatgcatgtctgtaatcccagctattcaggaggctaaggcaggagaatcacttgaacccgggaggcagaggttgcagggagccgagatcgcaccactgcactccagcctggacaacagagtgagactctgtstcaaaaaaaaaaaagaaaagaaaagaaaaagaaaaaagaaaaaaaaaggaattgggggcctaattctgggcccacaaaaatcacccagataaggatcctcccagccaccatactctaccccaagctggctgtggggagcctgcattccctgagacaccccagcttccttggagtcctcctagccgggtcacagcctctcagcatccacatcctcctggcgtcctcctcaggtytcttcdagccagggkmcrtgcagtacgagctgaacaggaacaacgtgacggwcccgtcactctccgagatggtggtggtggccatccagatcctgcggaagaaccccaaasgcykcttcttgctggtggaaggtagggaccccgggtctgctgagagggggctgctggaaacacggccctggtgtcaggatggagaagtccagctcttaaagggaactgactggtttgggggtgamkggagaggtccctttaggagaatrggttgtggaaggagacgggtggcrctgtagacactcccagcccagcaagctgctctcctttgggcatggagatgcaagttaggttcagcaatccaggaaggcttcctgggagaggaggcagatttctcccctttggtagtctttcttggggacctggccctgraggggyaagcagcccctcagcctcactgcccagaaaagcaaatccgcaggccccggctttcccacgctgtgtgctgatgttcccaggctctttcagcgccggccaggggccttgcagacagacctgaattcttggcctggcgctgccatctgctggcggtgtgacctctacctgtgcacttctgttatgtgaagccaaaaatagcatctgtctcctggagagtgattcgcctccattgtgttcagagacataaagtacttggaacggggcccagtaaagaataaaccgtgtttctattattagccttrttatggctacacaatagttaaggcgggaacaataggaagtgtgaggaagtgataaagattccagaaaccttccagtgctaacagcccttgcccaccgcagttcctcatgttgccctgctaacatcggtatgtatmcacacacatgcacacacgtgaacatgtttgcacatatgctccccacgcatacacacatgctcagcgcctccgccttccagaggtgagcgtccgccagcccagcttggctgctttcttgccaaaccccggggttcccactcgagcacagcggtcttggcctggccccgaacaggcctctgacgccaaggagccagccagaaaccagcggtggtgagcacgggctcccccgggagcggtttcctttgtgagcraggccaggatgggccgcccaggctagctgctcccagagccacaacaaagggaggacacgccctgccagcctgccgggccaccgcgaggctcagactggtgggaacagagggctgcctggcgcccaggaccctccaagctgggagtgtccaccaggcagcgccctcctgttagcaagggargtgttcctttaaggtcacagagccctcggctgctgggccaagcctccagccaggcccctgcactcacccggaggtgggaagcgggggcggaggctgcgagrgttcaggcttcggcagggctttgtggaacctgccacaggcactgcccaggcactggggactttcactacctctgggagctccgtgctttctttttagaggggatgatttgaggtagagatgaaaaacggggttaggacgagtcacacctgaattcacatcctggcaaatcccaccgtgggcttccccacactaggcctcagttgctccatctgtaaacaggactgatcatattcctctctgcccagcattgctgttcaggggaaaagagacatgggtgtgtcgtgcctggcacattgtagggattccagcgtgcccccttccctacctcccaaaggcttcagtgcctccttcaagcagctagagacagtgctgggaggggcggtgggaggagtacagcttcccggcctggtgaatttgattacacatctggactttgcagcccccatgcatgtgcctttggcaccggggctgtccctctctggcctccgtcaggttgaatggctgcgtaaaatgcctaggctgtggtgctagctcagagtggtgcccggcgaaggttcctgtccttccctagctaacaaaggttaatccascagcagtgttgtggggctggggagcagatcttcctcccctcctccctcaccgaggcctttgccttggtgtcccaaggagrcagaattgaccacrggcaccatgaaggaaaagccaagcagrccctgcatgaggcggtggasatggaccgggccatcgggcaggcaggcagcttgacctcctcggaagacactctgaccgtggtcactgyggwccattcccrcrtcttcacatttggtggatacacccccyrtggcaactctatctttggtaggtgggccttctttggggtggacactcctggggtctcctgtctacccacctgggagcaggagtgggtgggagagccagcaagcccagagcatggtggggactcaatgacaactgggtggggaggaagagttactggggatggggagaaaatgcagggtgaggcaggggagtgagttgagtggtggtcgggtagacaggcaggtgggtggatggatggccacgttgaccatggctgggcgagaacgtggatagatgaatgagagaggatggctggctggatgatggatggatgatggatggatggatggatggatggatggatggatgatggatggatggatgggtggatggatggatggatgggtggatggatgratgggagggacatgggtacaatgaaaactggggaatggttagttggaaataataaggtttagaaggtggcttcttggaggcattgcagggcccttcaaagaagatcccaggggttaccaagccaccaaggagcctaatmtgggggctggggactgtactcctggggccccagcatgacccctgaacaccccctccctgtgcaggtctgkcccccatgctgagtgacacagacaagaagcccttcactgccatcmtgtatggcartgggcctggctacaaggyggtgggcggtgaacgagagaatgtctccatggtggacyatggtgagacctccaggacccagggctgggaggggacagggcacccctyggggatgggcttgggaatagggtgtcagcttgtggtcaaggtcaggggtctcagaatgactggggcttgagtcccagtttgattgttgagtcccaggttgtttgattcaaacaacctcagtttgaatcgccttctacaatctagcagctctgagactttgggcatgtgacttcatctttctctgcttcagtttcctctctaaaagggttctacctttgacggttgtctgaatgaccaaatgggtctgatgagcttagcatagtgcctggcacaagtaggtgctcaatattttatactcatttttcttggccctataatattccagtatacgagactttgcagttagttcatcccatcccatatcattcattcgttcttgatactcccagtggttctagggggtctaaagatgcagcaatggtaagagtctccccgtcaactctccctgctaatccaagcagcccaaatgaggttaattttctctgttgggggttgagaatgcagactcctgtgtcagaacaggctcaggttcaaatcccgtggccttaggcaaaatgactttcccacattgagcctccttttcctcttctgtgaaatgggagcrttcaagscagcctggaagggagatggaaaagctgcgtgcgcagcgccaggcccctggcaggctctcagcaggtgtttcccctggcccacagctcacaacaactaccaggcgcagtctgctgtgcccctgcgccacgagacccacggcrgggaggacrtggccrtcttctccaagggccccatggcgcacctgctgcacrgcgtccacrrgcagawctacgtcccccacgtgatggcgtatgcagcctscwtcrgggccaacctcggccactgtgctcctgccagctcggcaggcagccttgctgcaggccccctgctgctcgckctggccctctaccccctgagcgycctgttctgagggcccagggcccgggcacccacaagcccgtgacagatgccaacttcccacacggcagccccccyctcaaggggcagggaggtgggggcctcctcagcctctgcaactgcaagaaaggggacccargaaaccaaagtctgccgcccacctcgctcccctctggaatcttccccaagggccaaacccacttctggcctccagcctttgctccctccccgctgccctttggccamcagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccytcccactcccatctccttacctctggaaccccccaggccctacartgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggacagagctgagtctttgtggtcagtgagaaaaagactgaaagaagcttatttctctgggaagaactggcctcagggcccggggtacaggtgggttggacagggtggaaaggccttctgctgtcctgggggcttcacactccctacctgtgccactttggacacataggtttgtgtctcagttttcttgtctgtgaaatgggagacaacccccttctgggttgttgtgaggattaaagaggaggctgggtgcaatggctcacacctgtaatcccagcactttgggaggctggggcaggtggatcatttgaggtcagcagttcaagaccatcctggccaacatggtgaaaccctgtctctacaaaaaatacagaaattagccaggcatggtggcgcgcacacctgtagtcccagctcctctggacactgaggcaggagaatcgcttgaacccaagaagcagaggttgtagtgagccgagacagcgccactgcactccagcctgggtgatggagtgagactctgtctcagaaaaacaaaacaaaacaaaaccaaacaaacaaaaaaaaacaagataaaagaggagtgcctgtatgcccagaaacccacagcaaggaggacttcaggggcccagtggcagcccggctgcatgatacccacaaacagcactacataccttggcccatttcattcattcaacaaatacagactacgtgctaggcatggtattaagtcttaagaattgttggccgggtgctgtggctcatgcctgtaatcccagaacttcgggaagctgaggcgggtggatcatctgaggttgggagttcgagaccagcctgggcaacatggagaaaccccgtctctactaaaaatacaaaattaggtgtgcctgtaatcccagctactcgggaggctgaggcaggagaatcgattgaacctgggaggcagaggttgcggtgagccgagattgtgccattgcactccagcctgggcaacaagagtgaaattccatctcagaaaaaaaaaaaaaaaaaaaaagaatttagtggtgaacatgacagacagaaggctgaacagacagagggctccttgccctcacagagcgtcagcccagcttagcaactgtgatctttccatttctcatattcacaccttggtactacactcaggcctgcagccgaccttgttgggatacagacttgtccaagtttgctcctcttgcttcattgaaatgaaaattcctttaataaggataacaatcatgacaattaacactgatcatttacaacatgccaggtctgtgcttgacgctttatgtggattcattgcatttaatcctcattaggaaataggcccccatcatccacatgtataggtgaggaccctgagggtttgggaagtgaggtgattgcccaaatgcccccaagctgtggagctggtatttgaagccaggtgtgtcctattccaaagctcctgtacttaataccatcctttatttggttataacacacttcaaacctcttgtcaaccaggtcctgaagcagacaatactaatgactcatgacatacaccagttaaatataaactcaggaagatgagaaaccgtatgtcagaagtggacttcttcaggattgaaaatgcaaactaagcagatttgtctctgagcttcctagcagtcctgacaaaaaaaagggaagcacagccaagctgacactgggataaaagatgaaactataggccaggcacaacggtgcatacctgtaatcccagcacttcgaaaagctgaggtgggaggattgcttgagggcaggagttcaataccaacctgggcaacatagcgagaccctgtctctacaaaaaataaaaaaattagccaggtatggtgatatgtgcctgtaatctagctacttgggaggctgaggcgggaggatcactagagcccaggagttagaggctgcagtgagctatgatcatgccactgcactccaggctgggtgaaggagcaagaccttgtctctagttaaaaagaaaataaacagggctgggcgtggtggctcatgcctgtaatcccagcactttgggaggctgaggcgggtggatcacgaggtcaggagatcgagaccatcctgggtaacactgtgaaaccccgtctctactaaaaatacaaaaaaaaattagccgggcttggtagcaggcgcctgtagtcccagctactcgggaggctgaggcaggagaatggcgtgaacctgggaggtggagcttgcagtgagccaaggtcgtgccactgcactcactccagcctgggtgacagagcgagactccgtctcaaaaaaaaaaaaagaaagaaaagaaaagaaactgccaggagtggtagctcacacctgtaatcaaactactttgggaggctgaggccggaggatcccttgagcccaagagtttgagaccagcctgagcaacatggcaaaacccatctttatgaaaaatacaataattacgggggcatggtggcaggcacctatagtcccagctacttggagggctgagggggaggatcacttgagcctgggagacaggggtcgcaatgagtcgagatggtgccactgcactccagcctgggcaacaaagtgagaccctgtctcaaaaaataatacatagaaaaagaaaagaaactatatgcatacattctggccaggaccaagaggaaacgcctcatcttgaactgtacaatgcagtgttttccaggtgttattttcacaccaccttcacaattgttgccgtatccatactattatttccttttttttttcttttgagacagagtctcgctctttcgcccaggctggactgcagtggcgcgatctcggctcactgcaagctctgcctcccgggttcatgccattctcctgcctcagcctcccaagtagctgggaccgcaggcaccaccaccgtgcccggctaattttttgcatttttagtagagacggggtttcaccgtgttagccaggatggtctcgatctcctgacctcatgatccacccacctcggcctcccaaagtgctgggattacaggcgtgagccaccgtgcccggccatatactattatttcctaaacactcctttaaattgacatttaagcagtcagtttttaaatgttcccagtaccacctgaagtcaatttacatgtctccagggtgtgcaaaccacactttgttttgttttgtttttatttccataggttttgggggaacaggtggtgtttggttacattagtaagttctttagtggtgagttgtgagattttggtgtatccatcacctgagcagtatacactgaatctaatttgtaatcttttatctctcattcccttgccaccctttcccccagagtccccaaagtccattgtatcatttctatgcctttgcatcctcatagcttagctcccaattatgagtgagaacatacgatgtttgattttccattcctgagttacttcacttagaatagtagtctctaatcccattgctgcaaatgccattaattcattccttctgaatgagtagtattccatcatattcatatatatatatatacacatacacatatacatgtatacacacatacacacagtatatacacatacaccacagtttctttatccactcattgattgatggagatttggactggttccatatttttgtaattgcgaattgtgccgccataaacatgcgtgtgcaagaatcttttccgttgaatgacttcttttcctctgggtagatacccagtagcaggattgctggatcaaatggtagttctactttcagttctttaaggaatctccacactgttttccatagtggttgtactagtttacattcccaacagcagtgcagaagtgttccctgttcactgcatccatgcaacatctattatttttttgattttttgattatggccattcttgcgggagtaaggtggtatcgcattgtgataccaccttgatttgcatttccctgatcattagtgatgttgagcattttttcatatgtctgttggccatttgtgtatcttcttttgagaattgtctgttcatgtccttagcccactttttgacgggattttattttattttttttgagacggagtcttgctctgtcacccaggctggagtgcagtggcgcgatctcggctcactgcaagctccgcctcctgggttcacaccattctcctgcctcagcctccagagtagctgggactacaggcgcccgccaccacgcccagctaattttttgtatttttagtagagacgggatttcaccgtgttagccaggatggtctcgatctcctgaccttgtgatctgcccaccttggcctcccaaagtgctgggattataggcgtgagccaccgcgcctggccgtttgtttttttattgctaatttgtttgagttccttgtagattctgtgtatttatcctttgttggatgtatagattgtgaagattttctccctgtgggttgtctgacaaaccacactttgttatcttgcattgggtttccacggagacagaacctgagacagaactcagcacaagcagtttgtttattagaagaacccagaaagctgcacaaattggggaatgaggaagcaagacaggaaagggaaggatgttgagaaagatgtgtttttaaacaggttgccactgaggctggccagggctcaaccccacgaaggacctctgggagatggtgtgggagcgacacttcagagatatctcacccaaggggcgagggagcaggggtatttattcttcaactctcacctctcattggccgagggctgctcctggggaaattaacactggcactcctgaccttccccatgaagttctgagagaaagcctccaggcctggtgctggaacatcaactgctcaaaggacacaaaccagcagcttctgttgaactttgggatacactgctggggtagaaagcgcaggctgtgagtccgagagatggaggtccacatctctgctccatcactttctcagttctacgaacttgggcaagggattcagcttctctgacgccctgtgcctagcgatgcccagcacgtagtgaggactgagtaccccattaggagccaggagttcctcctgcccacactccaggctgtgggatgacgtgtccttcaagaagcagagattgaggtgctcaggcacccatggcttcagggtctccccacgctcaggctgggccctgggtcactcatcaccttatattttaactgctgtgggccctgagtcctaattggagccggggttcaggcataggtcccagctccattcacaactagggccggtagccatggacctagaccctaaggatgacagtccagacccacagcacagggatttcttttgccctcagatgccttctcccggaggaagaacaaagatgagctgacatgccctcttgtattcactgagataaccctgccttctgttaaaggtaaattcagaaagctcaataacttgacacctgaggatgtattcttacctccaacatcagcgcccctgctcaggtgactgggacccaggatctttccaggggtggctctgccaccccctgtaagttctggatgtccttcctatctggccagcaccttgatggtgggaaccacgcctgctttttaaccacttaatcctggaagtgacatacatcacttccgcccttagtgcattggcaagaaccrgtcctgtgatccttcctggatgcgaggaaagctaggaaatgccgtcttcgcttgggctaccgctgccaccaacaccaacacagcaggttctcatcctgggggcagaatcacccccacatcagttgaaaacctctgctctgtaggaaggaagaggcgtgggagactgggatggtcaacttggctcaggctggagacatcctccaactcacacactccccagccattgctgagcacgggtgccgtgttttaaaacactga

SEQ ID NO: 12398 - DNA, 24092 bp, Homo sapiens
cacacacacaaactataaaacactagtgtgcacctgtagtcccagcgttatgtaccatcagtgccagctactcaggaggctgaggcaggaggattccttaagcctaggagtttgaggacagcctgggcaacatacccagatcccgtctttttaaaaaagcaaataaactataaagcactaagaaatctaaatatccatgctagagcaaacaggtggcaattgaacatcctgggtctatagtatgcttgagggagactgtgactgattagatccccacagtagagagaacatcttcataggcaaacgggggcttacctgtaacagctgttcaagttctctcttctcagcaagaatcatgaaaggtacttaattcaaggtgggtgtacagtctgatgctcttcaggcaggtcaaattctcataatctagaggactgaatggaaagtacttttctttttcaagataggtgtcattggaggcaggaatggagctttttgctttgacagtcttccccgtcatgtgtctagcagagaaagttggttgttcttgttcagggcgtccatttgtctggcagtttttgtttccaaaatacacctaaaatctatctgcttcttttcatgtaggccgccatgatcctcctccaggcccccattcttctcaccttggccagggcgataggttcttaacagaacttcctgcttccattatttctgctttcatccgttctccacagagaagctggagtggtcttttaaaaagttgaacagataatgccatcccatgctcagatcttccaaagatcttctgcttctcctggaataaaacatgaacagtgcactgtaaaaaccctagaatatgccaaattctccagcctcattatttcttaccactttggacttcttttgtttctggaatgtgctaaacaacttttttctgactcagtctctcctgggagaaatatttttcctctccctggaatgcacttcctgctctttttatggctggcttaatttcacgttttggatcccagctataatatcacttcctcacagaaacttttcttgaccactctatttatctgcactagctctcccaacccatgtttactcaccagttattctgtggcctatcccccgtttacttccttcctagaaaaacctatttttttttctccttgtgtattgtctgcctcctgccagaattggaggacttattatcttgctcatggctgtgtctctagaccctcacacatagtgggcactcagtatacatttattaaataattacatttcttatctgatctcctcctgtataatatttggattgttttcaccttttctatattgttacaaatgctgcaaagaccagttatatagatgaatctttgtatatattaccttagggtgaattccttaagttgaatttggggctgactatgtatagtttttaagctttttatcaaatgcttttgactgctatcattatttttttaccctccagttccacctacaattaccttgattgactcaatggaactttttcatatgaaagtattaaaaatactgaaagaagatataagtagcaagaatgttttaaaatactaatttctgataataatgtaaaagatacactctatgttttaccaggaaacctagatcattatattcaatgcacttcactctcatggcatgttatttttagttctttttctagttctagcataaatttcctcaatcaaatactgtgatcgattttttatgtgtgtaacaagataaaaatgttgtgcttcagtctcacattctaatactctttcttcaggttgaccctgtattatgttggaataggtgttgctgccttgatttttggttacatacagatttccttgtggattataaytgcagcacgacagaccaagaggattcgaaaacagttttttcattcagttttggcacaggacatcggctggtttgatagctgtgacatcggtgaacttaacactcgcatgacagagtaagaggatgatattgtagtacgttagctttgttttcatatgtgacatgtaaatgacctaactacatttatttgcttgtttcagtgacattgacaaaatcagtgatggtattggagataagattgctctgttgtttcaaaacatgtctactttttcgattggcctggcagttggtttggtgaagggctggaaactcaccctagtkactctatccacgtctcctcttataatggcttcagcggcagcatgttctagggtaagtgagatggctaatgcaatattgaatggaagcagcagtgtggactaaatgactcactgagtttgttcaaaaatggcttttctattcacttgccatgtcccaaactacaaagggatattatacaccacaaatacttttgattttgttcaccattaatcccctttctatcttcaagttatttggctaagatgaaatgtttttaatagcttactaacattgaaaacatttctcttcatttagcagtctaacacaacttcaagtggtagcatggataaagtatgatgtccttatacatgtgatgtttagttgttgctgttgggacagacttgtttgctctaaattcacagatcaacatggtacgattcatttcactgggtagaatggaataagaaaatcctaaaacaataaacatctttttatatcatcctcttaaagtttatgtatatatgtaaagttttttttttttttgaggcaaggtctcactgtgtcacacaggctggagtgcagtggtgcaaacatggttcactgcagcctcaacttcccaggctcaagtcatcctcccatctcagatcccaagtagctgggactacaggcaaccacgcccagctaacttttgtattttttgtagagacagattttcaccatgttgcccaggctgatctcgaattcttgggctgaagctatccgcccacctcggccccacaaactgctgggattgcaggccagtgagccaccgcacccagccaagtttatacttcagtaaggctttcaattacatttcagatttctgctaatatctatttttatgtactacacaaatatgtttcagttttttaaacaaattatgtactcgcattctaaattacatttttagcactgttttgctgtaagtataacacaaaattgtaatcttatctacagcctggttttgaaaccgatactctgtgaaatctaaaaacaacaaatgtatctgtaatattattcttcaaatcatatcttttggaaattctaccattgtatatactcatcttctagatcggaggcacagtgctttaaatttggcaacactaatcattatttatggaaatccagttcctaaaatttccagagtttatttactaacaatatagtaattcaaccaaacaagaattttcagcaataaaactattctataatggctaatcccttaacaataggcttggagatttggacagcatgtctttacttagtgtgactccgagtgttgactttgtagcctttatcaaaatcttcatcctcaacttatttgaaatgaggaaggaaatctcagtagaaagattgcctgcagtaagttagtaagatcagaaccttaacgtccacagaagagaagtaaatgaggagttgtaaaggaatagcagtgggtagtctaaattctattattgtattcattgatcatggagaggaagcaggtgaaggtcagagttatccagtgaaggtcagagttatccaaaggatgcgataccagagtggatggcttctagcttccttcaattcaacttgacaattatctattaaatacttgctaagtacaaggctttgtgccaggtggtgtttcccctctagtgatctactataggaataattatctttagtaagtgaattcagaaaataatgagtattattccgcttctgctactctctcactttaacagttatccaagcatgtcttatataaaatcagctcctattatgtggaatatattttttaggtggatagacttgctatgcgaataggcaatagttatgaattcacagctctgaaggcagtatccccgctgttcccttttgtggaactgttgtgttaattacaaaattgtaaaaggattattaaatgggacatataatggagaaaagggcatgtgaaatcaggtaaacctgtctagtcaccaatagtgatattttcccttttctctctgaaatcttacctcttagtatttgaagacaaatttttaaaaatacagagataaagtctaaaaaaataccattagtctacttagaattcaaattctgcctgacttaaatgttcagaacattattactacacagagtcattttttaactgtggttgtggkttattacagatggtcatctcattgaccagtaaggaattaagtgcctattccaaagctggggctgtggcagaagaagtcttgtcatcaatccgaacagtcatagcctttarggccmaggagaaagaacttcaaaggtctktccttttaaatataacaagatatgcttggttttattttccccagtggctactaagttgtgttctgtttttgtaaggtatacacagaatctcaaagatgcaaaggattttggcataaaaaggactatagcttcaaaagtgtctcttggtgctgtgtacttctttatgaatggaacctatggacttgctttttggtatggaacctccttgattcttaatggagaacctggatataccatcgggactgttcttgctgtaagtcttgtttgagaacaaggtrtcaggcctggataatctttccttacctagtttagccaaaattcctctttgaagataaatattcaaagatggatgtttttattaaacaaatatttgtttccctcaaattatctgtatacacctttaaattatagttatgaattgacagcatttattcatccagcatgttttagtgtcctcgctgtgtcaagcatctgcattccgcttttggaagaatcataattgaattccccactgggaaatacactgagttttgttaatctagcagtgaaaaaggccattctcttgtgagacttttcctttcatctgggctgagatcagacggagttctgcattcaccttgctaaatgtcttctctctggaaatggtctgtagagtttacactcacctcctcttcctctgtcctttcagcatgtagtaatttaaaaaacagactacatatagctctgtccagtatcacagtttggagacttttaaattcttatgggttatgtgttaaataataatttattcagttatcctcttaagttacaataaacagatcagttcaggattaagaaacatttgtcttgaggaaccaaaatgatctgctctttatactttgatccttgtttggcctttccattcttacagatttctcttctttccattaaattcatcttttgaatttgaggcattcataattaagacttttagctattcatttatttcatataaagtgaaatgtgagcatgaacgatttttcactcatccttgctcctcaatttatgtgtggctgggtatctggcttactaagcctaagcatcctcatctatatgataggagtaagagctcctagcttgagggattcttttcttatttgactttttgcagagatgagtctgtcttaaaatggacagctgtcccctaatacaaaaattcaaaaacggtttgagtgaaaacagtacaatgtctctgagccaataaaatctactgaatttttctttttaaagttcaaggggtcacccaacaaggaggggagtgcaactcaccatggggtttatacatggtcagcacacttcagttagcagatttttctggtcacacatcccagcatgtgataaccacaagactatgagataatcaaaagttgttccttattaggaaaaggccaaggatacttggattaatctgtgtttctattgcttctcggccttttggctaagatcaagtgtaatctrtgttcttttttatttggtcatatcttccattctttcttacctaattcctctaatatctctctgtgagcctaaaccaataattatatattacattctattgtctttcttatataactgcagaaagataaatatcactttgtttgttcctgtaggttttctttagtgtaatccatagyagttattgcattggagcagcagtccctcactttgaaaccttcgcaatagcccgaggagctgcctttcatattttccaggttattgataaggtaagacctcttattgctttgaagaataactatcattactgcaagaaggagacaaaaaaayatacaccctcattttcactaaaacaataggatggacaaatttaatgttggccagttgtttatgggaaagagagactgcctttaattcttttctaagaggagattgtgttgtattgaaaccttcatgtctaactcaatgcacttctaaagcagaaaggaaactgtcatggaagaaaaccatccttatactatttttaaaatgtagagactgtcagtttactcctttgaagatttataacatttcctttgtttttccaagaaacccagtrtagrtaacttttccacagctggatataaacctgaatccatagaaggaactgtggaatttaaaaatgtttctttcaattatccatcaagaccatctatcaaggtaggttaaaacaaattacgcaattgtgcagttttctgatattatcttctactggccaagatcttctctgacatgattacttaggatcacttttttccaagattttggctactttgcttagagacttgaggaggtagataaataatggacaaataactctggatcaactagttatattttgcagcattctttctatattcaactgactaaagcattttcagctccgtgaaattcttctactctgggtttgggaacacacctaaatgtcttgggttgacgctgccacctgttggtggttcctagatgctaccccactcaacatactcattttaaccccctcstctctaacctaggagaattatgcacatgtgcctttcccttcttcctttcctggggcttttactgcascagcaattgcggctagtactttatcrcctttayacacacgcacacacacacrcagtttatcctactccatcattcagtctttgacaagttcttgtgaaaatgtgtgtcttttttattgtcttccccctttcacttcattagtgtatttaccaaaaaagtagttgttgttaaagattgcacaaggcgattactaataaaacactggcttcatagaaaaagacatgattttaartgaaatagataaaattactagtgtgatcaatttctaatgtctgctacagaatttgtataaagacctacctactcctacttccttattttttttctgattaaaactttgaycgaaattctcttttcaaagctctttagttttgaaagttgttacttaattaccgattaccattattggtatagtattgacttccaccatttttcttaactgtacagtatttcaaactacattttgcaactgtatttggattggcttcctagggacttcagcaccaattgtgccattatattgcatgggaaagtgttctttgggttttaaacaactatttttaaaatgaacttttgaaacataaccctttttgttaaactaaagaatgaaattttgggggggtccacctattttaaataaataaattctttcaaggaatgaccagaaaccaaatctagagtaaaagtgcaggtgtgagaagaggtactcctactggtggtccccgatttctcacctccttcagagaacttttctcggcttggccctctgamggttttatgtttggcttatgcaaagggtccattgctttacaaatggtgagatcaaagcaagagaattcaaagggagattcccctgtttagggctaactacatacagatgcaagcaaagataggtgagaatttctcaacaggatcactgttgtcatttcgagagggtaattattgtgaggcttcamtcacattgcaggtccctggcacactaaatgctgtagcaaccccagtcattgagaaaatgtttaaagtgttccctcatgggtcaccatgagcccaccaaggtttctaatgataaactctcatctatcgggagccactaagaaactttgccagctgttttcctttagaatatgctttgcaattatgttagtatgtcctaaggaggagcttcattaaatagcttgtgaaaatatctggcaagatctcatttacttgttacaaattaagactttcattaacttgatagtcaaaattcatataaaatattttagttgaaaatgtgaacagtttactagttaatattctgaagtactcttmatttagttctctttacatagagagataatgatagattcttttactactattttctgaaattattcaggctattaytacacatgtacatgaaacaaacataacaagatctaaatttgtttttagaagaatttgyttttggttataattatgtactcattttctgaaaatgtgtccatcatcttcttattgtggttttatgattttccctccatacattccaatagattctgaaaggtctgaatctcagaattaagtctggagagacagtcgccttggtcggtctcaatggcagtgggaagagtacggtagtccagcttctgcagaggttatatgatccggatgatggctttgtaagtgcagctagcaaaaccatgcacagtccacctratggaatctggaaacaccgcagggctggcagctctgtaacttttcattttcaacagtagagctgggagagaagccatattgttttctttcctttgtatccattcactcagcaaatatttatttagagmcaactatgtgtcakgcactgttttaggttctgagaatacctaggtgaataaaacagataaaaatctgccctcatgaagtttacattctaataatcagaggcagacaataaaaaaataagtaaattatatagtatgttagaagggagggaatgttgtggagaaaaatagcgtattaacatctgtacccagtacctatcaagaatttcaaagtttgttccagaagaatgatgtagaaaayatctccacttttctttttctttttttttttttcttggagcttacagtgttgcacttaactttctcagccttgtaagtggcatagaggataagacagtgatattcaaaagtgattaattcttaatgcttctgttcaaagtttcaacagttatttttaaaagaaaatctactcccctagagcctggctttatttaaattttacttcatagttttcatttggagtatcctagacccatgtgactacataaattattagatgagtgttatgtgtataaaagagttgcatagaatatccatgccctgacagaaaacaagggttggtaagaaatagagactctatgagttagaattaccaaaccctggcttctgtcacgggaatatgttggggtaattggcaatggcaccacccgtggagaagccagaggtcacttattatcatgtagagcaatgaataggagacacttttgtcttttgcagaggtgtgagatgttgaaataatggcggctatttcctagaagaaatgtaagggtcacatccaaaactgaagttttttgtatgtgtctacataataacatttgcggaacctagagtatgtatctttataatatctaacttgtggatcttagaataaagataatcagatgatctggcaaggttttaggccaattattcttttgcagttttgttggtgcccatctaccagaaaaagtctayggacaatatatatgttagaaatattttatcaaaatatagtcagtctttgatttctaaaatatgctacttctcagcttatattttggtctagtatgaaaraccctaaaatcaatacagtaaaaggcatyacaacatggttcattctttggattggcagatcayggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcrtatgattttatcatggagtttcctaatgtgagtacactgtgcagcctgtgyccttagcttatggtggcagcgctgcgacattccaatataaggtaatgaaacaacaactgatgcagaatagtaggggtgtgattaaattctggattgtcctagaacaagcttgtccaaccagtggcacaagatggctttgaatgaggtccaacacaaatttgtaaactttcttaacacattatgagatttttttgtgatttttaaaatcttatcagctattgttaattttagtgtatttaatgtgtggcccaagacaattcttctttcaatgtggcccagggaagccaaaaaattggacactcctgtatgaaacatctgtagagaagaatgcatagtaacaaccaaaagaagaaatgcatcattgaaaggccagattgaaaagaatcatattttgttctgcaattgaaaaagaaaaaaatgaaagatatgttaaagcataacaaagaaatatgaaacaaaatcatcagaccaagctgagaaattatgtctaaaatgtttatttgcgaggccatcttgtggctgagagtgggaaagtcatacacacaatgttcagattggttctgtgacaaaccacaagaaaaactatgatcattttttaaagcacaggaagctaacattgcataagaaatgtgaaatcaggccgggtgcggtggctcacgcgtgtaatcccagcactktgggaggccgaggtgggcagatcacctgaggttaggagtttgagaccagcttcgccaacatggtgaaaattcatctctactaaaaagacaaaaaaattagctgggtgtggtggcgcacacctatagtctcagctactagggaggctgaggcaggagaatcacttgaacctgggaggtggagattgcagtgagctgagatcgcaccactgcgctccaacctgagcaacagagtgagactttatgggaaaaaaaagtgaaatcatatttggaaagcaatatagtccccaaaagagtgaaatcatatttggaaagcaatatagtaagctaaaattattgttaaccagacttacgagatcttaatgggtatttagaattaatggggtgctgtaaagcctttttttaaaaatatttcctgaagtattagatcctcagcatcccctgaaattgttgtgcggagcaccttgtkacatatgaaaggatgagatttgcaattaaaatacatataaaattccaccatcccagagggtcacaataacagaaatgtttattttaatgggcatatttcacaaaccaaacttgacggaytgtaataattttattcttggtttttaatttaaaaaatttgttatgccagtaattgtctcttgtccccattatttaggatcataattaggacatatttaggccaamaaaatcattaaagatttaaggtgcttcttaaatctttgggaacacacatttccttttgttgatgttttgcccctttcaatgacttcctttccttaaaacatcaatgctctcatttcccacttagaattagggagctttctgatgcctcttaaatcataccctgtaagttactacttgcttttaccaaaagccaaatactacacaaagatgtcccttgctataaatctaataataaattcagaagatataaccaaaataaattaaagatagtagcttatcatgatgaaacctaaattccacagccatagctaaccagaaaaatgaggaaacacaataatgaatgaaagttccagaagtggctaatttaggtaggtaaaaaattggggaaagctattgtaaaaaaatgtataacattacttcccttataatatacacagattttaaaattaatgtataataattagctgatactggttagcctttcactcataaacaaccatgaaattggataaaacatatgargccaagggcagtcatttccatgcattggatgagaggtaatgaaagactgattcctaacagagaggaatctcataaaggtactccatgaattctgtctgggaacactgagctgaaaggcaaagctcaaatttcagggcagcttgggcagctggaaaggtgataagaaatcacctgtggcgatgaggcaggggcagaagcccagtctgtatgggcatccctcaggaatccttgtctgaggataagactacctacccaaggctcaccagagagtggcagccataaagctgcaagcggaacactggatagaagtcaggcagtgctgcgggggcgttgaaagtgcagcgcagctggaatggagagatcacattaacacctttttaacvccccaggcaagtagctaaaacaccaaaaaagccacaccttaggagtcaggaccacaccttagagtaagatctacctgccctaacaaaccctgagaccaakccatgacaagatgcccagagaagagaggttttggaggttgtgttctgccaagttatgtggctttctacaaattcaccccaaggaaacctaaaatgaagattgcacaagttcaagatcagtcagtgcttgagttgcctactagagacaaaaatcagcactgttttttttttgtttttgtttttgttttcagaagaaaacagaacttagagtctcttcaacacaacaattacagtactcagtacatcatttacaaaaaccagacatgcaaagaaacagaaaaatatggcctgtatgcaagaaacataatcctaaaagtttattctttaagaaaagggcttcaaaatacatgaagcaaaaactgatacatctgaaaggagaaagacaaatccacaactttagttgaggccttcagtgcttgatagaacaagcaggtggaatatcagtaagaatatagatgaacaatactaacaggcagctagatttcactggcatttatacgacattccagccaacaacagcagaatacattctcaagtgcacacgcaacattctctaaaataaacaatattctgggccatcaaaacaaacaaaacaaaactgtagctctttcaaataatagaaaacatagaaaatatgttctcagaccataatataagtaaactacacaaatatttgaaaaatcacaaaaaacaattctaaagaatatatatctcaaaaaagaaatttcaagaaaaatgaaaaactattctgaactaaatcaaaatgaaattgcaatgtattagtatttgtgagatatagttaaagtattgctctgagagaaacttatagtatttaatgcttattttcggaaaagaaaaaagatctacagtctgcaaacctaattttcacctacagaaactagagaaggaagagcaaattaacccaaaacaagcaagactaagtaaatagaaattacagtagaaatcagtaaaaccaaaaactgaaaaacatcaattactgaaaccaaaagctggttcactgaaaagattaaaaaaaaaaaaagtataactgtagcaaagctgaaaaaagagagagagagagaaaagagatggccagtatcaggaatgaaagaaggtacatgactattgattctaaggacattaaaaggttaataaggaaatataaacagctgggcattttttgacataaagtcctgtaatcccagcactttgggaggctgaggcaggtggatcacttgaggaaaggagtttgttaccagcctggacaacatggcaaaaccctgtctctactaaaaatacaaaaaattagctgggygtggtggtgcacacctgtaatcccagctactcgaaaggctgagacaggagaatcacttgaactcaggaggcaaaggttgcagtgagctgagatagcaccactgcactccagcctgggcaacagagcaagactctgctcccccgcacctccccccagccccccaaaaaaagctagatgtctaaataacggcaacagttacaaatgaaattaaaataaaaagcagtattcacaaagcatcaacagacaaaatgcttaagaataaatttaatgaaagacgtgcaagtcttctagtaaaaactatattatgctgatagacatgaaaagatctaaagaaatagaaagtaccttattcattgatttagaaactccatatttttaaagatttgcattctctccaagttgatatataaatattgtgctttatcaatcaaaatctcaccagtttttatgtgtatgtgtagaaaytgacatgttgattccaaaatttatttggaaattcaaaagaccaacatagccaaaacaattttgaaagaaagaccaaagctggaggacctaaatatctaattttaagacagcaattaagatcgtggtagtggcataatgatggttgtatagatcagtacaatggaacagagagaccagaaatagattcacaaatatctactaagttaatttttgacaaggcgaatggaactcagtgggggaaagaaatatcttttcaacaaatggtgctggaacaawtggttatccttgtggaaaaaataaaatgtgaccttyactttacatcacacacaaaaattaatttgccatagaccttgtaccaaaattgtaaagcgtaaacttcaaaaattaaaacttacgaaaaaatctttgtaactttgagagaggcaaaagtttcttagactgaaaagcattactataaaaaaaagataaactggagtgtactaaagttaaaacctcctttttaaaagacatcatttagaaaacaaaaaggcaagacagagagcacaagaaaatatttataatatacatgtccgacaaggacatgaatccagaatatataaagaactgctatagcttgatgaggagacaaaaaatagaaattaaaaatgggcaaaaatttgaacagacattttacaaaagaagaatcaaatgaacaatacatacattgaaaatatgcaccattattagtcaccagagaactctaaaataaaacrataatgagataccattttacactcttagaatggccaaaattaaaaagactaacaaatgtaacttttggtgatgatgtaagcaattagatctctcattcattcaaataaaagtgaaatcagtataatcattctagaaagcaatttggcagtttattataatgttaaacatacacttatgactcagcattctattcctaggtatttattcaaaakaaatgaaaacatgaccacaaaaatatcttgtacatgaatattcatagcagctttatttataatagccaaaaataggaaacaatttaagtgttcatcagcagttgaatgaacaaattgtgatagatctaatttttctttttcctttttcttttttttttttttttttttgatatggggtctcactctgtcacctagggtggastgcaatgcacaatctcagctcactgcagcctcgacttcccaggctcccaggctcaggcagtccttccacctcagcctcctgagtagctcatgccactacacctggctaatttttgtattttttgtagagacagggtttcaccatgttgcccaggctggtgtcaaactcctggcttcaaccaatccacccaccacaacctcccaaagtgctgggattacaggtgtgaaccaccacacccggacaaattgtgatagatctagagttgccagatgaactactggattcccagttaaatttgaatttcagataatgaataattttttagcaatattgcataaaacatacttatactaaaaaaaactcattgcttttctgarttcaaatgtaacagctttgtgttttcttgtgtgttgtttgtttttgctaaatctggcaacccaaggtaaactygcattgtgtggaacactacttagcaataaataggagtgaacaactgatacaacayggatgaatatcaaaaacattaagctaggtaaaagaaacaagccaaagaagtacatactgtatgatttcatttacataaagttctagatccaggaaaattcatgtatagtgataaaaatcaaatcagcggtatctgcaggcatggtatgggttttgactgaaaaaagtgacataaggaaacttactagggctacagaaatgttctatatctttattggtatggtggtaacatgggtgtactcatttgtcaatactcatagasttatatccttaaaatggatgcattttattgtgtgtaaatttcttcaaaaagcctgattttttaaatgtgaagatcaatctctagaaattaagggtttagaaagaatatttaaatttatctccgtgaagaaataaactttgaatcagggacgtaacccagtagaatattactagccatgtttcctgggcgctagaagttacccctaccacaaatatggaagacaaaatatctactttgttaaagataaatttattttaaaacaaatcaaaagaacacctaaaaagtatctcaagatggaaaaaamgttttaggggaaagtttgttttggtagcaattttttttcatgctgtttttcagagtatccaggaaggaaattgtgggtaacataccaaattgctaataaacactgcagaaaataggtatttgtattacagtggttcttttaaagatttcaaagcattctaaaaatatctaaaagagatttggacattagtttaaattattattaatttttctaaatacatttgattataatgaggtctaatttattttagtcctagccaaatttttcttatgtcctctcttctttgggctcttttttttttttttacagcggtttgttttcacaaagaacaaatcaaaagacataagcacccagaggctgaagtactgattaagctgatattaaaacacaactgggattgtcatttcctgttctaacsatttgatcacgctgccttctgtttctgtgcttctttcctatttttcattagaaatttaatacattggtaggggaaaaaggagctcaaatgagtggagggcagaaacagaggatcgcaattgctcgtgccttagttcgaaaccccaagattctgattttagatgaggctacgtctgccctggattcagaaagcragtcagctgttcaagctgcactggagaaggtaagtgagcagaaacgtttcttatttccatactcctggttcattattgttttgaagtacaagaaagtatagatctgtaatagattactcaagttgagagccctcttaaggtataaaggcaggatgttaatccactgagaacttacgtgatggctataggaagtggtttagaggacagaaggagatgctgtggttggttggtgtaaaaatatatacatgaggctgatacacaagcaatcatccagtctatacctccattccaagtggtttgcactttccacctccctagagtggcccaccacyatcatcactattataaccatgcccaccctttgcttcttctacatacacctgtgggattctcttctctgaccacttttcttctttaggatacccccaggtattcattttgacctaatttcacctcaagtggagaatcgctgaccttgaaccagcgcccttcgacagctctggcccctcaaacctcaccctgacctcctgctgcctatgagctactgcacatacctcaaggccatatgcagttgtggccctgcaccaaattacactgaatctaggaggggagttggcagtggcggtatgaaaaaccattgaacagttttctcgatggcctgactcccttataaaccagagccttcagaccccttacaaggcttaatggcacattttactttgcatttgcttggaagtgagttaagcgtttttttttctctaagaaaatcgcaggcttctttttttaaaatgctgactttatggaaccagaaacggatactggcaggctaaatgtccactgcttcttgaaaaatctcttagttactattatttagtagcaaatcagattgtgcaagtttgaacgcttgtttccctcccataataacaatgccacatgttgcttgtgtgataaataatctttgtttactgtggacacttcggcaatttggttcatcttggtacagaaaatacaaagacaggactaatattttattcattttttatacttagtaactaggacagggatctgtatttagactatattcaagcctcgctctgtcacccatgcttgagtgcaacctctgcccactgtgttcaagcgattctcctgcctcagcctcctgagtagctgggagtacaggcgtgcatcaccacacccagctaatttttgtatttttagtagagacaaggttttgccatgttgaccaggctggtctcaaactcctgacctcaggtgatccgcccacctcggcctcccaaagtgctgggattacaggtgtgcgtctccgcgcccggccagttacataagattttaaaaaatgtattgtaataggctctctgattgtttagaaggtttcatgttgtgcccgcagtattttcatccactggtaatcactttaggtaatcaaaactagttcagacttttaaaataaatagttgcttggtgacatgataaactaataaatgttattcttattggttaatatgaaacatctatcaaaagtgaaaaaagaagaatgcagaatgtttgtaaactgattccaaaattacacaaaatagcaactgtgaaaaaaatgaaggcaatatatgaaaataataacagctatgtggcataattatgggggaatttaacttatttcaaaaattcatttactgtccctgtttttcagttgtttaaaggagaaagagattaaatcaatgtagaaataggtgtgaaactgctttatgtatggtttgctgggtcaggataaagggtaaccaataggatgaaaagtagcacagtaaactagattaatcatatactcttcagtttattggaaaatggcttatggagaaggggagagttcaaatacaggcagggtgatggaagctgtagcaccatgacagccctctcctctcaccaccatagactgcagttatggaaccaagcccttggagggggccctgggtaagaaaggtaggacatccagcaggtctcattcctgatcagctgtctaagaggccccagactctgttatatcatacagcctaacccacacagttaacagttttatgctgctcaaaatatcctgcaagccactaaccaacgaaagaagacataatgaagtgtatccctcctccctggtgatagaatctatacccacttcactccacaacctgccctcacatatcccttccatcccctcctctccattagtcatttatcttccacttatacaaagttctagaacctgtgaaaccaatcaatggtattaaaaaatcaggtcagcagtttcttagggcaggggtgaattctaactaaacagcaacatgaaggcactaacacccttttcctcacttggactattgcagtagctaactctgcatcagcccatgcccacttcaatctgttctcaacacagcagccaagtgttgctattcaaatgaaaatttggtgacatcgtacttcaacttcaaatcatccaataactccccacctcactctaagtaaaagccacattccttacagtaagcacaaggctctatggagctgggctccaagctccttctggaacttcccttcctaccattcgccccaacaatgcctgcttcttaaacataccctcacacttttcattagctaacacacaacgtatatgtttgtttattttgctattgtctctctttctccacttgaacgtaaactctctggtggtgaaggctttgagtgattaactgcagcatccccacctctagaacaatgctggcccttaacaaacagccaacagatattgttggatggacttcgatgagtgtgatccaggatacttctaagaccagaaatattcttttttgctttctttcttttctttttctttttttttttttgagaccgagtctcactctgtcacccaggctggagtgcagtggcatgatcttcactcactgcaacctccgcctcctgggataagcagttatcctgcctcaggctcctgagtagctgggattacaggcacgcaccaccacgcccagctaatttttgtatttttagtagagacagggtttcaccatgttggtcaggctggtcttgacctcctgaccttgtgatctgcctgccctagcctcccaaagtgctgggattacaggggtgagccaccgcgcccagcgagacctgaaatgttcttttctggactcctggatttagaataactacaaactagttttgtttcactaatgttcaagaagaatttctagcgtcagtgaataaaggttcatgtcatagggtgtgagtttcactctgctacttgttttgacctggtgtgccaatgcagcaggtttccaagctgccccactagtaggagacatggcagtgagcacctgcaggcccctggggaagccaaggaaacccacactgattctgtgataaagcctgtgaaagctctgtgaaatgttaaaagtggtatgcaaatctaaggcatcattattattaagggagtttcggccacaccacatcaatggagaacctctttggtaattatgaaggaagagttatcatcacaatattattctttgaaaacacagggttgctttattgcagccctcacgggcacgtcttaaccatcactgtgctttctccctatgatgcgccccgttggtcttcctcggagacctcttatgttgtatttatactacttagaggactggacaataaggaaattggtgtattacattaagctgccagccactggattaaattaagttctaagaagtgattatccaaagtcgaagttaggtcagagtaaattttacacacaaacacacacacactaatgcacacacattttgaatgtctgtgtcaattaaacatctcactctgtatttggaattttgaaaaatcatttatagcaacactgtaatagttgggaacagaaagggaatttctccaagggaatttccttggctgaaatttagacagaaaatcaaaggtaacacacagactacctcatgcaaaaaacatgattggatattttataaacctgcttaatcaagctcacatttgtagcgcttgatgttaaattctaagccactaacttctttcagagtaatggtccttctcctttgatagatcagggcccctttgagaatctgattgagaaagggaaaaataaaccaccataactctttagagaagtatacaaattcacttatacaaaaagacttacacgtactcttgagggagtcatagacccccgaagccatttgtgggtccttattttagatgtaacaaaggaacaaatggatgataacagctaatcctcacaagatccatataagattaagacatttattctcctgttttacagttgagctgtaaaatacactgaagcacagggaggttaagtaataggtaggcacagtgaagccagaacccagaccactcatccttctgcctcattcttgtaaccaccaggctatattgcttcaagattacactgccgggaggtggagctaaaaccgattccagatcaggcttcaaacctcttaataaacatagaattatcaaatttcacttctgagtatatgcccaaaataattgaaagcagggtctcaaagagatattggtatactagtgttcatagtagcatcatctacagtagccaaaaggtgaaaacaatccaaatgtctgtttacagataaatggataaagaaaatgtggtatatacatacaatggaatactaccagtttttaaaaggaaattctgatgatgctaaaacatgaataaaccttgaagaattatcctaagtgaaataaaactgacaaaaaaggatccatattgcttaattctgctcacatgagatacatacaatagtcaaattcagagatggaaagtagaagagcggttactaggggcttgggggatgggaaagcggggagttagtgtttaatgggtatacaatttgaatatgagatgatgagaaagttctggagatgggtagtggtgacagtcgcacaacagtgtgattaagattgcaaattttatgttaggcttttttttttttttttttttgagatggaatcttgatctgtcacccaggctggagtgcagtggcatgatctcagctcactgcaacctccgcctctcaggttcaagcgattctcctgcctcaccctccagagtagctgggattacaggcacacaccaccacacccggctaatttttatatttttggtagaaatggggtttcaccatgttggtcaggctggtctcgaactcctgacctcaaatgatccacgcgcctcggcctcccaaagtgctgggtttacaggcatgagccactgcgcccagtcaggcaatttttttttttttaccaaaaagagagagagagagagattagtaatctaagcctgagtacaaaagaacagtgaaaaaaaattaataaataaaagaatagtgacaaagaggaatttggcctctcagagtcagaaggatcgtaccctttaaaatggctataatggtaaattctgtattatgcatatttttccacaattttaaaaacaaaacacaactagccttttttggaaaaccacactcacactgtcttcttgggaaagaaattcaaaccatactccaaatcgaagctctcatgtgggttaaaaccacttttgttcctgtaagttgtttatttttatactattgtataaataactagtagaattctcttttataaatttaggtcactgttacttagcaggacattccaaggttttaaagaatatactaaaaggtcttctaagacataataaaatatttttccatgatatggataagcatcttggtgatttttgtaaattaaaattattcctaagcctttccttcctcccaaaataaggaaaatgcctatagaagatactgattttcctaagtgctatcaaataagtgatctcaatgtattatttaccaagaataaaaataggtaagctattatgcccttatggaaaaaaataaactaattattgcagcattttctcttcttacccaccatttacttcatcatttattttttattgtaaatttctccacaaatacttaaatgattagcttgttaataaagttaagtaaagctgggagtggtggctcacactgtaatcccagctacttgggaggctacagtgggagaatcacgtgagaccaggagctcaataccagctgggcaacatagcaagaccttgtctgtaaataaaataataaaatgattttttaaaagttcaatgaagagaaaaggtattaaatgatgataaataattttatgttatctctaattcttaaccttcatgttaacttatttagaagtgacaatgaagagattccaggccataaaaagaaaacattttaccattattatgttattatttcacgttcctaattaggtagtacaygtgggttcattttagcagagtttacattttgaaagtgtttcttttctaaagggtcttaacccaagcattcatgcattcacatgagtagatttctgcaagctggaaagaagggtcaacgagcaggtgagtcayccattaaaagtgacttctaagttcctgatattttgctatttgtcatcccccttgacaaaaaagaaagcattctcggaccagtgacgtggtctgacagtaaccccacattgttgagccctggaacccatgtcgacccagaagaacattaagccaattggctttcaacatcacagtcaggtagttaagaaacaaaaggcctatgtttcccgttcaactaccatgg

SEQ ID NO: 12399 - DNA, 21692 bp, Homo sapiens
gttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggmaaacctagaaaacatttggcagaaaattacatttcgatgtttttgaatgaatacragcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatsctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattyggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcaccygatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacargccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggraatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggrcaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggytccggcagggccgcccaggagctttcggmaggcccggccccggcccctttccgagcagcccgggcctccgccctgccctctgtccccaacgccgggagccgccgttcgtcctccagagccccgcccgggcgagcccgggaggccgatcgccgctcgcggaacccgccgggacccgggccctccccggcgcggggcgcccccgtgtgacccagcgcgcggccgcggcgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctgtgagcgcgggactccgggcaccccacggctgggaggccggcgggccccacggggctcccccacccgggcctcaaccttcctttccttccttggcgtcccagggcaccctcccgccccgcttccgtccccaggcaccactgccccgaggcccagcagcatccctgcacccgccgaggccgaggcctggagcccccggaagttgccatcctcagcctccaccttcctctccccaggtaagagggcccggttgttaggctcggtggacccaaagaagagcccaccttgaccacggccacggctgtagaccctgctgctggtctctgcctgcctctcactggtgtctttatgaagcttttccaggctcccagacccattcagggcctgagctcggcctggtyccaagccctgcttccctgtggcctccaccgccatctccagccccttcttctaccaaggtaggtgtcccctgccccccagggaagattcgagacaaggaggaaggaattcagcctttgatgtagcgcagagccccagtcagccaagctgggtcagctgggaggcagctgtggtggggagagcctggagccttgggcagaagggaagagacagggaccccacctgatccaggctctcttcccacagccaggcccagagagctcagtgtccctcctgcagggagcccgcccctytccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggtgagtgtcgcaccctggcagggaccctggaargccatcagataaccctcaccacttctccagcctttccccctcgcttccccacacaactccttcagccctcattctggcgtagggtccctggccccttggtggttctgggcctcgggtaggtggcactggtggcccgaaggccttcgcttcgagagcctcacgctgcccgtcttccctgccccttcccccaccgcaccctgggggctgcagaacgctgacctggagtggactgcagtgaagcagagcttcctgaccgaggtggagcagctgtccaggtgaggccagagggggagccacaccaggtcccgtggggcttcagaccgcacaccacaggacctggctcccttgggcacctgaggcctggcaggcccgggcgagctgaggccccagccagggctgcccacccagtctggcctgatggaaagtgctcccctttttcaaacaggtttcgtcacccaaacattgtggactttgctggctactgtgctcagaacggcttctactgcctggtgtacggcttcctgcccaacggctccctggaggaccgtctccactgccaggtaggctcacctggcccggcacgcttcccaggacccaaagcactcctgacacctggctggagccgggcgcggggcctagggctttcagcctgtgtgagtgggtcctgccagcaggccaggcctgcacttccagctccccagcagcacccggctcaggatttggcccacggtggggtcaatttttttttttttttttttttttttttttttgaggtggagtcttgctctgtcatccaggctggagtgcagtggtgtgatctcagctcaccacaacctccacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgcctggcccgacccaatgttttctatagagctctttcccaggcctctcccctttgcaagcagcgtagctggagggtctcatcagcaagccccggaggcgagggggtctggggctaccagctggaccacctacagctgagggagggcccccttgcctcctcctgcatgctgcgtttggggagagcgggaagaatgccttcaaggacttcccgaccaccagggacaaagggatgagccctgggagccgaagcccagcagattctattgaacgtgtccccagccattgcttaagaagtkcaggtcacggagactttgctcctcgttttccagaagggggaaactgaggcctagagagtgaagtggctgttccaggctgcacrgtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcggtggtagagaagaagcaggccccgaggaacctcctgggccccagcaggctgcagctgagctctccgcaccgtgcagggcagcctgagctgcctcacggtcttactccactcagtctgcctcaccgtggactgtggtggggccaggagactagagacctgggttttagccccagcctgacagtggccttccagcaaattcctgctcccctgtgggcctgttttcccatatgcaaaacagacttcacagaatgtgctcagccagtaattgcttcactgcttctcctcttgtttggggcggttcctgtgtgctgtggggtctccgtcaggattcagccccgctgagaacccaggagccgggcttgagccctccttcctttcccttccccgtccgtccatccatgcatcctgctgaagaagcgcaccaggctccttgggggtccttggacttccccacttgctccccaccctgcagccaaagtgctcttttcaaaggcccctttgccttttctctgctcttggggtgaaggcccagtcccttatgtggttgaccccccaacgccccaggtccctgggactcggggcgctccctgctgcctgcttcacagccttagtatgtgccgttcgctctgcgagaaaagccaccgcccacccaggtggttcctcctggtctgtctgatttcagaactggagatggcctcyggtcctgtttccaccctgggggcgcctctctgcggggcgcctctctctctggggtacctctttgtctgtggggcacctctctgtggggcgctttccttctcggctctgccctctcaggctacttcctgccttcagaccccagctccatggggctctcccccaccaggaagtcagctctgtcaaaccgggtcccagggttctgtttgttcctgtatccctagggcccagagcaccactggcccacagtaggtgtttaataaatctctagaagctactcgggaatctgaggcaggaggatcgcttgagcctgggagttggagaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagygagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcaytccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcrcggayggcctggagcagccctgtggtttgcccacggggtgaccggccagggctgccatctcaccctgagagtccctcttttccacttgcaggtgtacgagaggctagagaagctgcaggcagtggtggcgggggtgcccgggcattyggaggccgccagctgcatccccccttccccgcaggagaactcctacgtgtccagcactggcagagcccacagtggggctgctccatggcagcccctggcagcgccrtcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctycccccaccccattcctgaaggctgggaacaaggagggctctgtctggtagcctgagagctgggccctgcccttrgacttctctgaggaattcaggcctgaggccagggaggcagggtgctaggctgcgggctggggagccacagcatgaggctaagggagtgccatctccaccccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggtgctgccgcccaggctggcctctggggtgctcrggcgcatccgtgtcagccccaaagagcagagtgtctgtcccgactgcgctgagggcrtggggcagccgggcaggccactggctctggcgacctctagaagcccagccggccccacatgcctcccttagcaagaccctggcccactccttccctcgcctcctgacagtagcacctcctttagcccgagggtgcctgycccactctgtgctttcaggaaataggaagccccagcaggaattttccatcccaggtactatttgaagaaccactgcttaggaaccctcagctgggcgaggtggctcatgcctataataccagcacttttggaggccaagatgggaggatcacttgagcccaggaggtggaggctacagtgagctgtgatcaagccactgcactccagcctgggagacagttagaccctgtctcaaaaacaaaygaacaaacaaacaaaaaccctcaattcccacgaacrccccaggagataagggagcatggcccaggccttgagccagggcttctggcagtaggggagcctcccccatttgctaagcggactttcctcttccttctgtaggcttgggcctggaacaggacaggcaggggcccgaagaaagtgatgaatttcagagctgatgtgttcacctgggcagatcccccaaatcyggaagtcaaagttctcatggtcagaagttctcatggtgcacgagtcctcagcactctgccggcagtgggggtgggggcccatgcccgcgggggagagaaggaggtggccctrctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcytgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggytgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcrccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggctctacttgtggactttgttgcaccgaaagccttgagctttcctgatgccttacacttcakggttcttgagcgtccagggtcttgttactactctgggctggccacacccagcacttcccgtgtcaggtttttcctgatgtagtccatgttttttatgctattctaaatggtatctttgattttctagttcatcatgatattatacagaaatgcaattgatgctgggcacggtggctcacgcctgtgattccagcgctttgggaagctaaggcgggcagatcacttgaggccaggagtttgagaccagcctgggcaacatggcgaaaccccgtctctacaaaaagtacaaaaattagccaggcatggtggtgcatgcctgtagtttgagctactcaggaggctgacccaggaggatagtttgagcccaggacgttgaggctgcagtgagccatgattccaccactgcactccagcccgggcaacagagggagaccttgcctcaaaaaaaaaaaaaaaaaaaaaaaaagcggttgagttttgcatatgaaccgtatattctgtgaccttgtttaaattcttttttttttttctttttttgagatggagttttgctcttgttgcccaggctgcagtgcaatggcgctatctcagctcactgcaacctctgcctcctaggttcaagtgattctcctgcctcagcctcccgagtagctgggattacaggtgcccaccaccacacccggctaatttttttgtatttttaatagagacagggtttccacatgttgaccaggctggtctcgaactcctgacctccagtgatccgcccgcctcggcctcccaaagtgctagattacaggtgtgagccactgcacctgtccctggctgtctgtatatttacttttttttttgagatggagtttcgctcttgtcacccaggctgcagtgcaatggtgcgatctcggctcattgtaacctctgcctcccaggttcaggtgattctcctgcctcagtctcccgagtagctgggattacaggcgtccgctaccacgcccgactgatttttctatttttagtagagacggggtttcaacatgttggccagtctgatctcgaactcctgacctcaggtgattcacccacctcagcctcccaaagtgctgggattacaggtatgaggcactgtgcccggctttttttttttttttttttttcttcagacaagagtcttactctgtcacccaggctgaagtgcagtggtgcaatcttggctcactgcaacctccgcctcccaggttcaagcgattcttctgcctcagcctccatagtagctgggactacaggtgtgtgccaccacgcccagctaatttttatatttttatttagtagagacaaggtttcaccatgttggccaagctggtctcgaactcctgacctcaagtgatctgcccgcctcagcctcccaaagtgctgggattacaggtgtgagccgtggcacccagcccagccttattcttttaaacaatctgacaatctctgcctttagttggtctgtttaatccatttccatttaatggttggagttaagtctatcatcttgttatttgttttctattaccccatctgttttgacttttggattaattacatatttctgggattctgttttttctctgctattggcttggtcgctctagtaattcagtgagactgctggttccgctcaggcccctttgctgaaccatggtgtgaaagtgcctccaggcagaaactcagggtacttgtaaggctcaccttctttgttttctctctggtcacagccctgcacagcctattgtccgatatctaaaaatagttgcccagtgttttaggtgtttacaactggcatcagttattccactgtggccagaattgcaagtttctcctcttttctgaggacttcttcactcataatgtcacccgacatgatcaatttcttccttgcttctggatctatttcttttctttttttttttttttgagacagagtcactctgtcacccaggctggagtgcagcagcatgatctcagctccctgcaacctctgcctcccgggttcaagcaattctcctgcctcagcctcctgagtagctggaactacaggcatgtgtcaccaagcccagctaatgtttgtatttttagtagagacggggtttccccatgttggccaggctggtctcgaactcctgacctcaggtgatccgctcacctcggcctcccaaaatgctgggattacaggcgtgagccactgcgcccggcctctggatctattttcatcaaacatgtcctggtagcttccgttcttgaagaataaaaataaaaactcatttgacccaacaccccctccaaccacaaccctaattctctgttcctctttgtagctaaacttttcagaatccttgtctgttttctcacttgcccattccctgtgcagtccctcttcctctgcttctacccctgccactccatccaatcagcgttcatccagaacaccagggatctccgtgttgtcaaatccatccagtcctcttggactttctctcgccggtgcctactcccccaccaaccgcttgtctcttgtgacctctgtgacgctgaagtctgtgttctttctcagcgtgcgtgggctctctctacccagcctctacaaggtgtgagtccctccagacacgcctctgcgccttcttagctgcctgcactcattcccgacggtgatcttcctcattctcacggctctatcatgtccattcccaaacggcagcgcctccgtcatgctctctctcctgaggttttggccttctgatttttctcacaggcaccgtaaacttagatggccaagcagacttgggattccctttcaccatgagcttcccacctcagcgtgtgggactagttccagcgcccacccagctgcccacaccagagcctcaggagttaggcttttctgaaagactttgttagggaggtataagttaaaggtagaaaagtacacaaaccgtactcgtacagcccaatgactgttttatatgtacacggccatgtggcagccaccacatagacccacatatgaatctgctccagttatctcttgctaggtaccaagccaccccaagatgtacgggctgaaaataatggcaatgtttgttttgctcgcgagcctgtgctctgtgaggtctcagttggcagagctcacccgctgcagtcggttagccggggcagcccgatggccacgagctggaaccacccagcggctccttcgtgtccagcggaggacgctgccggggtgaggacacctccatgtgcctgtgaggctgggttctccggggagcatctcaagctagaaagcccagcggaggccacgtcatctgatggcctggcctggggatcaggtgctgccacttccccggcagcctgctcactagacgcaagcctctgaggccagtgtatgcaaggggagaggcgctgtgggccgccttttttgatgagagtagcaccagagaacatccaaacctggctttaaacacatagatagttttgcatgttctggaatttcatgtcaatgagattgtgtcgtgatttagtttggatgtgtgtccctgccccaatctccagtgctggaggcggggcctggtgggaagtgactgggtcatgggggcagatttctcatgaatgcttccgcgccatccctgggtgctgttctcatgatagttgtttaacagtgtgtgctacctccactgtccggctcttgctcccgctgtggccatctgatgtgcctgctccccctttgcctcccgccatgattggaagcttcctgaggcttccccaaaagcagatgcagccatgcttcctgtacagcctgcagaaccgtgagcccattgaacctcctttctatataaattgcccggtcttggctatttctgtacagcagtgtgagaatggattaacacacgtggtacgaactcgcgtctgcctgctattgctctgcactgttgttctgttgcagccgtgagtagcgctaagcgattgctttgccttcccaggtagcgttccattgtaagaatgggccgcatttgactctttctactcttgggcgtttggattgagtttggggctggcataaagctgttatgaacatttccgaatctgtcttgctgcacatacacactcatttctcttgggtgttgtacacatctgtatacacatgttggaacatctgatcagggagacctgatgggagctggcagtgctgcgatggccccacaccaggactcacagtgcacaaatgcctactgcgtcccctccgccttccagatcccagttccggccagtttttgtattttttgtagagatggggtcttgccatgttgcccaggctggtctcgaattcctgggctcacacgatccacccacctcagcctcccaggtagctgggactgcaggcgtgagcccccacgcctggcctggtgggttcattctcgattgtgttgatggtttggcagatataactttcaaactgttcactttaaatgtgcagtttattttatgtcaattatacctcaataaagctgtttttggccaggcacagtggctcacgcctgtaatctcagcactttgggaggccgaggcaggcagatcattaggtcaggagatcgagaccatcctggctaacatggtgaaaccctgtctctactaaaaatacaaaaaattagccaggcgtggtggcgggcacctgtagtcccagctacttgggaggctgaggcaggagaatggcgtgaacccaggagatggagcttgcagtgagtcaagatggcaccagtgcactccagcctgggcgacagagtgagactctgtcaaaaaaaaaaaaaaaaaaaaaaaagctgtttttaagaaataaaatgggccaggcgcagtggctcacgcctgtaatcccagcacttcggaaggccgaggcgggtggatcacgaggtcaggagatcaagaccatcctggctaacatggtgaaaccccatctctactaaaaatacaaaaagttagccgggcgtggtggcgggcacctgtagtcccagctactcgggaggctgaggcaggagaatggcgtgaacccgggaggcggagcttgcagtgagcggcgatcacgccactgcactccagcctgggcaacagggcaagactccatctcaaaaataaaataaaataaaataaaatgcagccgggcacggtggctcattcctgtaatcccaggactttgggaggctgaggtgagaagatcacttgaggtgaggagtttgagaccagcctggccaacatggtaaaaccctgtctctagtgaaaatacaaaaattagtggggtatgatggtgcacgcctataatcccagctactcaggaggctgaggcaggggaatcacttgaatccgggagatggaggttgcagtgagctgagatcacgccattgcactccagcctgggcagcagagtgagactctgtcaaaaaagaaagaaagagagaaaggaaggaaggaaggaaagaaaggaagaaagaaagaatgtctctttgaggcagcatattgattgattggttttattttccctctacgccagcccggcaatctttgtgtgtttatccattttcattttaatggatttgccaatatggctgtatgtgagatcttttattgtgataaaatatatacaacataatattcatctgtttaactatttataagtgtacaactcgggggcatgggctttgtttcttcaccctcaacatcctcctcctcctcctccacaccattagaccctgacccccgccaccctcctgctctggctgtgtgtgaggaccagcttaccatttgttctctgttgtcccatctgtcgttggttactttctttctctttttttgccttttctcagtgtcacttttcattattactccagcagttaccctagggattgag

SEQ ID NO: 12400 - DNA, 22242 bp, Homo sapiens
aaggcatagctccttgcttatcagtgctacaatctagataagaagagatttactgaaaacctacatagttgtgaattattcagatgctaggtggtatcaggattcagagaagggaaagatcaaattgggctttgtggaagaagtggggattgacccaggcactgtaggttgggtagaatttgaattggtgaggaggtagaaaggcaggagattcctaacagaataacataagcaaaaggagcatgacaaagggcagaaggagggaggagagatttctgttgggaacttaaggctaaaaataagaagtgaagtctgagagggcctcaaatattaggctaaggacttaaatttataagctgtaaagagttactatgtttgccaggtgcggtggctcatgcctgtaatcccagcactttgggaggccgaggtgggcggatcatttgaggtcaagagtttgagaccagcctggccaacatggtgaaaccgtctctactaaaaaaaaatacaaaaaattagccgggtgtcgtggtgcatgcctgtaatcccagctactccggaggctgaggcaggagaatcgcttgaacccaggaggcagaggttgccatgagccgagatcataccactgcactccagcctgggcaacaagagtgaaactccatctcaaaaaagaaaaataaaaaagagttactgtgttatggctgcgtgaggtggctcatgcctgtaatccaacattttgggaggccaaggtgggaggattgcttgaggccaagagtttctgaccagcttgggcaagaaagctagacaccatctctacaaaaaattattggaaaattagccagacctggtgatttgcccgtagacccagttactcaggagcctgaggcaggaggatcacttgagctcaggaggttgaggctgccagtgagctatgatcacaccactgcattccagacttggaaatagaacgagactctattaaaaaaagaagttattgtattttgttttttgtttttaagattttgggtttttgtttttgtttttgagacagagtctcgctctgttgctcaggctagagtgcagtggcctgatgatcttggttcactgcaacctctagctcccaggttcaagcgattctcctgcctcaacctcctgagtagctgggattacaggcacacagcaccatgcctggctaatttttttttttttttgagacggagtcttgctctgttgcccaggctggagtgcagtggcgcgctcggctcactgcaacctccgcccctgggttcaagcgactcccctgcttcagcctcccaagtagctgggactacaagcacccaccaccatgtccagctaatttttgtattttcggtagagatggggtttcaccatgttggccaggctggtcttgaattcctaatttcgtgtgatccgcctgcctcagcctcccaagtgctgagattacaggcgtggcccactacacatggccaatttcatgctttttaatggctgcttctcagttcccagttttccccaacatctgctctgtagtctttaaccctgatccttgtgctagaaggacagatgtttgtctaggacctgatctctgccctcatgatttggtttcatgtgatcgttatccacacaccttatgtatgtatatacattcctaccctccccctcagcacgtcatttcccctgtcacagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagtaagttacatctccatcttcagaggaaggaagggagctagcaattgagctgcctctgggccagctggggaagaggtaagtgtcaagcaaggccagtggtgggtaccagccctcggctcagtgccacctctccctgttctgcttctaggatgaggtcaaagctgcccgcaggagtatgctgcagaaaacatggctgctggcagatgaggtagggtcagggccattaggagggtgggatattagaggatcttgggggacagagaccacaacaggatctcattacccacttcataagttttctttcctttctgcagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcctggaaatttgatctggactgatttcagccatgttagttcagggttagtatctgggggtgggttatcccaggtgaggagcaggactgctgtgagagagatggggaagaatcataagtgggaggtaaaaactttgtccacatctggagacaacaagaatgtggggcctgccaggcacagtggtacacacctgtagtcccaactacttgggaggctgaggcaggatgatcacttgattccaggaattcaattccagcctagccaacatagtgagaccccatgtctgtctgtctgtctgtcggtcggtctgtctatctatctatctatctatctatctatctatctatctatctatttctgagacagggtcttgctctgttgcccaggctggagtgcagtggcgtgatcatagctcactgcagcctcgacctcctgggctcaagccattctcccacctcagcctcctgagtggctgggaccacaggcaagtgccaccacgcctggctaattttttgtatttgtagagacggagtttcaccatgttgcccaggttggtcttgaattcctgagctcaagcaatccacccacctcagactcccaaagtgctaagattacaggcatgagccgctacacttggcctattttggtagtttctacattgttctttggtctgaattctaaactttaggctttcttagactgtcttttgctgtgtggattacttattgtgtttgcaagtaaccagagtcagagcagtgtgccaaggcctagccctgtcagtaggtagagagaacccagtcttcataaatggagctgctgaacacagaattatccaataggtttttttgggtttttttttttttttttttgacacgaagtcttgctctgttgcccaggctggagtgcagtggggcaatctcagctcaccacaacctccccctccctagttcaagccattctcctgcctcagcctcccaagtagctgggattacaggcgcgtgccaccacgcctggctaatttttgtatttttagtagagatggggttttgccatgttggccaggctggtcttgaactcgaactcctgacctcatgatccgcccacctcagccttcaaaagtgctggtattacaggcatgagccactgggcccagcctttttttcttttttttttttgagacagagtcttactctgtagcccaagccagagtgtagtggcatgatcttggctcactgcaacctccgtttctgaggctcaagtgattctcatgcctcagcctcccgagtagcaggggctacaggcatgcaccaccacacccggctagttttttgtatttttattagaagcggtgttttgccatgttgcccagggtggtctcagactcctaagctcaggcaatccgcccacctcagcctcctaaagtgctgggattataagtgtgagccacagcatgtggccccaataggttttattaagcaactactgtatcagcaaataccaatgattctcaaactttgtgacaaaaatcatctggaggatattttaaaacagatcactgggtcctaccaccagaagctgctgattcagtacatctggggtgaaacccaagaatctgcatttctaacaagttcccaggtaatactgatgctgatgttcagaacaaaccacacaaccacaatttgaagagcagtggcttaaagagactttgcaaggtaaattctgtgatctcatagtgtgatatctagtgttaagtagggcatagagaccagggtttttttgttttttgttttttttgagatggagtctcactctgtcacccaggctggagtgtagtggtgcaatctcggctcactgcaacctctgccttccaggttcaagcaattctctgcctcagcctcccaagtagctgggattacaggcacctgccaccacgcacggctaatttttgtatttttagtagagacggggtttcaccatcttagccaggctggtcttgaactcctgaccttgtgatccaccccacccccaccgtccccttggcctcccaaagtgctgggattacaggtgtaagccaccacgcctggctgagaccagactttttacaaaatcactgttctgtttacaccttgaattagactttaccaagtagctaactactataacttctcttttgaagtattttgtattaaacataggtctcagactttcaagttaggattttttttttttttttttttttgagatggggctttgctcttgttgcccaggctggagtgcaatggtgcgatctcgtctctgcaacctctgcctcccaggttcaagccattctcctgcctcagcctccagagtagctgggattacaggcgtgcgctaccacgtgtgtctgattttgtatttttagtagagacgggattttgccatgatggtctagctagtctcgaactcctgacctcaggtgatctgcccgcctcagcctcccaaagtgctaggattacaggcatgaaccaccgcacccggcaaatgatcatttaagcaaatgatcgaagactcaagacacaaaactacctgaagggagtggctcccacatttgtagggtaccttacagagcaatttcccttcatatgattttgcaggtggtggggaaactctcmgggcagttgtggcctgtgctacatcacccattgaccagaggtgccagtactagtgctcaagatcaatygatcgatcggtctacctacctatcatctattgaccttcagtgctactaaaaacactcggatcttctaacgtctggtccagtctttcaccccatcacagtgagaggctgtgcacaggggtaacacaggcaacggaattatatgaggcaaacacagagatccaggtttctgggagtagcaatgaggttcagccttgcagtcacaaaggcaccactaaaaggcacaagtaatggcaggtaatgaggccttacttggagcagtttagagtacttmccacgtgtggtgacgcatgccacacactcaccaccaccaccactgccacaaatgaagtgcacactccactgctcctgtcctcaggaacctggaagcccccacctggtgtccgaggtgtggctcccactttaagcgtggggcacctcctctccggcctcaaacctacccgagctcccagcaggctgcggcacatctgacggctggaaactagaacccctgggtggggactccttaaggctcctcccggaagcgtagggacctcgctgcccacacgcccctccctttcctcctctggcgtcctggggtctgaggtgggcgtggccagaccagctttaggtccggggagtgtctcgccagcggcagcacacccctgtaagtggtggccagrgctgccgtggcaaaatgagctgtcaactttaggttgacaggggtgtggccgcgaccgcaagggcttttgttgccgggtggacccaacagggatgggctgctggggacagctgctggtgtggttcggagccgcgggtaagtgctatctggcggtcaggggaccgtccagcctgaggcactttcctaggcttgggggtggccggtcaacaggccaggtgtcagtggttcctccagaggcctcgaactctcacagccaaatttctccggtccgtgcttctggagtgcgggccgagaagcgccaagtgcgtgcgaatcccagagtctggatcacgcagcttgggaaggaggaacattctttggggtctcagcaccgccttggggcggggccaccaatctaagttgaggaaagcattggggaggctgcaggaccaaattcattgcggcccctaagttattcactgggaaaggcgctcgaggagagaaactggcagacctatcagcgcgcacccgcggggcttctgcgaccggagtcgggtagtggcttccaggctgagagcgcggctgggccgggtgacgggtgtggccgcgaccgcaagggcagctgttgcggggttctctctttctttcatatcctatttccacccgccttaacgtcctgcgccttctcccaacacctttcaggcgccattctctgctctagcccggggtcccaggagacttttctgcggtcctcgcccctgccgctggcaagtcccagcccccrggacccgaaagtcagcgccccgcctagtatcttggagccagcctccccgctgaattctccgggtgagctttagacgcctccttcctctttcgctcaccataccagacccctctggcccagcyaggggctcgacgacccttgcctcgctccttgctctcaggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgtaagtgcacggcggaggtagggtggacagtgacctgctagttggaggtttcaccctcagggtaacgaagtccacgtgcgcaccgacttgcgtcttggactattccgsggggaggtccaccttgagtgcccttcaaggtggcagtagtcgccaccgagttagccsttacccggaacctcttacaccgagcggaaggcccccaaccagggcrgcgccaaggggtgcttgagcctccccacatttccacgaaccctcctgaaataagtgtaatatctgatttttcggtgtgcaaacctacccttcccatcccgtcagagtcgattgcagcctccaagtccctcagataaaaaataattctggagcctcctctgtcgccaacttctgcccggagcggccggcctgagcaccgaaggccggggactcaccgtccgttccccgcaggatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggagtgagcgcagccagtggggatgggscggcgccggcgccgggggcgagggctgcctgggggccgggggagcgtgctttcctcggtgccgggtcaccagcacagcgaggggaggctcccgggccccgccgattccctcccccgctgcccgcagggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtacgtgctcccttcggcgctcagcgttggggtcccaatcctctccccaggggcgctcacgcaccggctctccgtccgtcccttggggtccccctatccyygcgctgggctgggctggcctgggctgggctgggggcccctgcccttatccaggccccctgggcgggagccctctcccagtggcagtgcccctggacagctggagggcgcttcctggamcacgccgctggccccacaggtgcgcgctggcgagctggaacygttgctggtggcggccggaggcggcggtcgggcctacctgaggccgcrggaccgaggccggactcaggcctcccccgagaaactggagaaccgctcggaggcgcccgggagcggcgggagaggcggggcggcaggtgagggcgcgggccgcggggagaggcgggcgtgctccccgtgtggctgccaaccttcctgctgtcgctctgcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacaggggtaggtgcaccgttggagagggcagctgagcaggcccgagggtgaggtgatgttagaacctaagtacaggccggagccctcgggaggataggtgtgggagaggcattaagccctgctcagcagctccaaacaaaaagcaggagctcttagaaaaggaggtcaaatacactgcaaatcagcatgcagacaggactccctagatttccgtttaatccaggatctttcccatcacagcaggtccctgccttgttctgcagcagtcttcagaacttagagctggccgagtgagcaagctgagcaaaggggcagaaaggcaggattgggttaagtcagtggttctcaaagtgtggtccaggaacaggtaatatccccacaacctaagttgttcgaaatgcacattatcagctgggcctggtggctcacgcctgtaattctagcactctgggaggccaaggcaggtggatcacctgaggtcaccagttcgagaccagtctggccaacctgtgaaaccctgtctgtactaaaaatacaaaaattagccgggcgtggtggcgggagcctgtaatcccagctactctggaggctgaggcaggagaattgcttgwacctgggaggcggaggttgcagtgagccgagatcactccattgcacttcagcctgggcgacgagggaaattctgtctcaaagattaaaaaaaaaacaatggaaattatcctgggagttgggggaaggttggggagatgctggtcaaaacaatgcaaaatggcagttaaataggaggaataccttccagaatctactgtactacatggtgactgtagttaatgacgatgtattcttgaaaatygctaagagaggcggggcgcggtggctcacgcctgtaatctcaacactttgggcggcggaggcgggtggatcttgaggtcaggagtttgaggccagcctggccaatatggtgaaacccccatctgtactaaaaatacaaaaattagccgggcgtggtggcatatgcctgtagtcccagctactcgggaagctgagacaggaaaatcgcttgaacccgggaggcggaggttgcagtgagccaagatcgtgccactgcactccagcctgggtgacagagcaagactctgtctcaaaaaaaaagaaaagaaaattggtaagagcgtagattataggtgttcttaccacagaaaataagcatgtgaggtggtgtatatattggtttgcattagccattgcacagtgtgtacatatttcaaaacatcatgctgtatacaataaatatatgaattttttttttagatggagtctggctctgttgcccaggctggagtgcagtagtacaaatctcagctcactgcaacctccgcctcccgggttcaagcaattctcctgcctcagcctcctgagtagctgggattataggcatgcgccaccatgcccggctaatttttgtatttttagtagagatggggtttcaccatgttggtcaggctagtctcggactcctgacctcgtaatccgcccatgtcggcctcccaaagtgctgggattacaggcgtgagccaccacacctggccctgaatttttatttttaattaaaaattaatttttaaaaagaaatgcgaattctcagcccttctctaacatactgaatcagaaactgtaagggagagtcccagtcatctgtgttttgatcaaataactagtgtaaatgcctttgtgcctgtctgggctgtactgctcatacatacacacatgatctacattctcacagaaagggactgtgaggacatgggacaggaggggctcaggcaggcaggaggcatcccagccagcctcagmgaggccttcargctccagctgattaccccctcctcacctccttcactcccacttgtgaacagacagcatttgcatcatgatgctggagaagagagggccacactgggatttccaccgggagattccagcttctcccccatcccccatttttgtagtcaaactctccatcactctccacttccagggggcgacgcttcagagactgacaacctctgggctgatggggaagatggagtatccttcatacaccccagcagcgagctcttcctgcagcctctggcaggtattggccccaaccccacctctgagcctggcctggacttcttccgcagtccctgagcccactcctgcactgcactgaagagccacctgcactgtgaataaccttgcatagcacaggattcttgcatagcatagggtcatttgaaaartgggctgtcatcatgccattgcactccagcctgggcgacaagagcaaaactctgtcttaaaaaaaaggaaagtgggctgccagtcgtgctggatggcaatgcagggcatgctgcgtgcttttcaagtacccccttgctatgaattcgcttcaaatacctgggagtgtgcaggcttgacagaagtcccccagcttctctcaccacccttgtaagcttggtgctgctctttgctctaaagtcctgggctagaattaaccatgtggctggaaaaggcatgtatttatttatttatttatttatttatttatttatttatttttatttttgagacagagtctcgctctgtcacccaggctggagtgcagtggtgcgatcttgggtcactgcaacctccgcctcccgggttcaagtgattctgcagcctcagtcgctggagtagctgggattgcaggcgtgcgccaccacacccggctaatttkgtatttttagtagaggcggggttggccaggctggtcttgaacttctgacctccggtgatccgctcaccacggcctcccaaagtgcaatgattataggcgtgtgccactgtacccagccaaaggcatgtatttactatatcccagccctaccacaccatatcatatcagttcttttactcacagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatgggtatgtcctacctttgcccaaggtctggactcctggggtcacagactgggaggagcagtaggccactgggaaagatggtatagagatttgctgtgtgccaggccctgtggtgggtgctgggcaggggattggagattcatcggtgcacagtgcctttcagaggcctgtcgtccagtgtgggaggatgtttagatatagctatgtaaatgtatatctcaagtgacgattgttgtgggaggtataaagtgctttaggggtgttcaagagggagaggttgcttttgcccaggataatgggggaaggcatcatggaaaaattaacacttgagctgagtcttgaagcgtgggtaaaacttgagggtaaaggaacagagaagaccttcccactggaggtgtctctctttctccctagacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccartgagctgggatgggtttctgcggggtcccggggctgacttcaagaccactcaccgcagcagagccgtggtagactcctctgggattctaagataggaaggagctggggaggcctggggaaaacgtttaccttaatgagcatctggaggggtgtcctgggcaggtgggggagggagagttgatgggcaggtggagggtgtgccgttattcttcccacccccagtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcaggtaagtcttctgcctccttctgagaacctatgcactctgaatccccacctctgattctctccctgctgtagtgaattataagtcccagaaaaaatctggcccacatcccttgtgtaagggagagggaggccctgagaagctccagaaggggaagtaacttgctcaatgtcacctctccgtcccagttcttagaatatgatctctcagctgggcrtggtggctcacacctgtaatcccagaactttgggaggtcgaggcaggcaggtcacctgaggtcgggagttcgagaccagcctgaccaacatggagaaaccccatctctactaaaaatacaaaattagctgggcatggtggcgcatgcctgtaatcccagctacgtgggaggctgaggcagaagaatcacttgaacctgggaggcggaggttgtggtgagccgagattgcgccattgcactccagccagggcgacagagtgagactctgtctcaataaaaaaaraatatgatctggcgcctgtaatctcagcactttsggaggccaaggcaggtggatcacctgaggtcaggggttcgagaccagcctggccaacatggtgaaaccctgtgtctactaaaaacacaaaaaatagctgggcgttgtggcgcttgcctgtagtcccagctactcgggagactgaggcrggagaatcacttgaacccgagaggcagaggttgcagtgagccgagatcgcgctattgcactccagcctgcatgacagagtgagacttcgtttaaaaaagaaaaaaaatcatgactcttggagcccaggrattgcctcccgcccagggcgtctgcagggaccagggaagtcctcatcatgcactcccaccttgactctggcccgcatctgccctcttttttgccctggctctatgccagtgagcaccacccttgcagggcttctacctggggacatgccatggtatggagagagtctatatagggtcagctgggcatatggcaggggcaggggaggtaaagggggtactagactctctaggactcttctccaggccgcctgcccactcccttccaacrtgtcttcctgcagagccctgggccatggtgcctttggggaggtgtatgagggactggtaattggccttcctgggractccagtcccctgcaggtagctatcaaggtgagaggagtgggacttctggctgggggtaggagagcggaacaccctgaagggaaggacaatgactagagctagggttaaccccctctcctgaagcgtgcagggcagctcagaaactgtgcccttttcctccccagaccctgccagaactctgctcgcctcaggatgagctggatttcctcatggaggccctcatcatcaggtgcacctgggaccaggggcagggctggaaggcgggaggggaatgcccgggaacagtttctcttcaccctgaggctgaggtagcaagtcaggggacacagagggcctctccagctttgtggagcctaaaacatggtttccgtctccctcctggtaacgggatatgtcccccaccycactcagcaagtttcgccatcagaacattgtgcggtgtgtggggctcagcctcagggccacccctcgcctcattctgctggaactgatgtctggaggggacatgaagagtttcctgaggcacagtcggccacacctggtgagacccttgtcttagccccccccaggcccctctaaagaccctgtccatgtgtctgagacctacatggactgatgccccctctgcctgacccagggccagccatcacctctggtcatgcgggacctgctgcaactggcccaggacatagcccagggctgccactacctggaggaaaatcacttcatccacaggttaggagcagtcctggctcaggggacccccatcccaactccctccccaaggaacagcccttccacacagcttttaaggaaatagatcaggaagagcaagaacttctagrttctggcagtgattttttttgcctactctgtagggatattgccgcccggaactgcctgctgagctgcgctggacccagccgagtggccaagattggggactttgggatggcacgagatatctaccggtgcgggacttgggaggtgggaaggctcttgctccaagggggttttccccgcaccttggtggtgaacaactcatcattcacctcctccctcctgtagggccagttattaccgcaggggggaccgggccttgctcccagtcaagtggatgcccccagaggccttcctggagggcatcttcacatccaagacagattcctrgtgataacacccttcccctccccttccccactgttcccctcccctgaggctaatcctgtcctttccagcmacctcatgtgaggggaggctacacctgacgggcctcacttggttcccccacttgtgatgcaggtcttttggggtgctgctctgggagatcttctcactgggctacatgccctatcctgggcgcaccaaccaggaggtgctggacttcgtcgttggaggaggccggatggaccctcctaggggctgcccagggcctgtgtgagttgagtgctgcccgggaagggaggtccttcacaaccatgggtgggcatgaactcctgcctctccccaggtaccgcatcatgacccagtgttggcagcacgagcctgagctccgccctagctttgccagcatcttggagcgtctgcagtactgcactcaggtgtgcccccgacctaatctaacatcctggtcttgtgggtcwggagggagggccagaaaactctatgcccccctgctccctgactcttccattacaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcrtccttcatctgggcagaccccccaccctgcagatgcttctaataaaaagctcttctcatcctccagcgatctgtggatgccagggaccggaactgaggaagagggggccggaggagggaggggctgaggcctgaggcacaggaagctgcatcttgtctttgagttttattaggaaggggagtccgtcgtggtgtgagacgttagaccggaaggtctgggcttgctaaataaaatccgcggtctggcacctctggagagggcagagcctcctcagaagagctggcctgaggaagaagccctttgccccctccccttctataagttagtgtcatttggctctgggaacgctggggcccgggtgggcaaaacccctggcatcggcggtgcccccccttagtggctggcacctggtcctgcaggacccggtgaactgccctgcaccgcggggctccagtctcaagccggcatgcacagtggggacaaagctgcaggtccacatgtcaggtgagcggcccgcggggacaggagtccagcctcatctctcagccaggctggccaggatgccaatgagattgtccagccccagcaaatagccgtcctcgcggttgccctcctcccagggccgccggtggtccaggatctggccatcggggaggggcgtggtcttgccgaagtcgatgagccacacgccggcgcgatggcagtgatcgtgcacaaagaggagcgagctgccgatcacctgcgagccccgcaccgtcaggccgcggccctgcccagagacgcccttgccgggttcccgccctagccctcgcggcccgggcacccgggcagccgccgcttacctcgtgcctcctgaagaactcggatacctccagggtgtcccggatctgctgcaggcggttcagataccgcctctgcagagggtggggtgggagaggagggcaaattaactaaacgccaaatgagcccctgctaacgatgaggagccgggacccacgctgtgcttggcaaatgccgccaggaggaggacccagggccccgcccagcgtggcccagaagggaaggagcgtagagcagttgcgagccagcgcggtgagggccatggtggggacacagccgagggcactgggccagatgacaggggcagtcctcggcttcaggctccccaacacctcagggtttgggatcccgctctcaccagcacttcctcatctccttgcacaaactcttcaaagacgcgaagcacctgctctcggcttcgcgtagtcttgaagtcggtgctgcaggagccgtccgctttctggatgtgggacaggagtgtcaggggccccgggcccgccagtggggaagaggacagcgtagagcagcggtacctcccagttgcaggggacggcgaggcggtgggagagggcggaggggcaggcggggcgggagcgggggatcgggaaagacagcgcgcagtggggctgcggcggtgccagcgaagcgcgcctgcctcaccttgatgccctcgatgcggaagccgagggtggtgctggagctgatgccttcccgccactgcatgtagcgcggcttggtgacggcgcgctgcgcgtgctcctcctccgtgggagcttcaggatccaccgccagcattttcttgtacatgtccttccgcagcttgggccgctcacgggccttggtcagctcctcctctaggtaagtcctgtgggggcgcaggcagcggccagggcatgagggggcgcacacggagaccccttcgagcactcgccccgggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatccgtcagcgccgcccagccccttcccgtcgcgggcacccgcccacccgccccactgctcaccagtgtgccctgccagctgcacccaggcgtagcgcttcttgaaagggcttatgaccggcagattgaccatggtccggatcttctgccagtggtttttctgaaagcgacagggtcaaggtctgataatcggcgtctcggcaatgcataagccctccctccactgaaacagggtctcgccacgcccccgacccaccggaagcagctggggctggatgagtcattaattcattcattcactctgggaaggtttatttgtgcgcctgwgtggcgggtgctgatacaggcgcagtgaaggtgattccagcgtctccagtgagctgtcaagagcctggacttagcatctgaagcccccggtttgcgctccagctctgccactgaagaacgcgtgggcaggttacgaaaatgctctgtcgaggtttttgaactgttgtgaacatcggaattacctgatggtcacccttgttaaaaattgcagattatcaggcctaccgcagggatgttctaagttggtctagagtagggccatttttttttttttttttttttttttcagatggagtcttgctctgtcacccaggctggagtgcagtggcgcgatctggcctcactgcaacctctacctcccgggttcaggcggttctcttgtttcagcctcccgagtagctgagactacaggtgcacaccactatgcccggctaattttttgtatttttagtagagacagggtttcaccatattggtcaggctggtctccaactcctgatctcaggtgttccacccacctcagcctcccaaactgctgggattacaggtgtgagccaccaggcccggccccccaaatttttattactaccaatgcctcaaaagattccagggcccaagaaacaagcctctgtgcatctgtaagaaaaagatctataaaatgaggaaataactatccttactgggttgctgtgagtagtacataaggcttaagcatgataggcgcccagctcccccatcccattccatggtatgaggcagaagctgaacaaatctcaatcactgattccttcactcaggaccttggttcctctcatttagggagacagacatacacagaaacaaacctgtacacaggcccagggcaggaaggccagcctggcagggcctggagaaagaacagggctggagaaagaaaaggctctccaagcctctcttgctatccctggattctatgcactcattagctggcaaggcccagggcacccttggtttttatctggacctagaaatcttaagccatgaaaataagatgccgggctgggcgaggtggctcatgcctgtaatcccagcactttgggagactgaggtgggcggatcacaaggtcaagagatcaagaccatcctagccaacatggtgaaaccccgtctctactaaaaatacaaaaattagccggacatggtggcatgcgcctgtggtcccagctacttgggaggctgaggcaggagaatcgcttgaatctgggaggtggaggttgcagtgagctgtgatcgagccactgcactctagcctggcagcagagtgagactccgtctcaaaaaaaagaaaaagaaagaaaataaggtgcaaacctgagggcctgtcaacttagacaaacctgggaaggagacgagggttgttttttgttttttgttttttgtttttgtttttttggtgtgccccttatctcttctagcctccagctaatcttgagagcatcccatcctctggacctctcctcttaccacccgcaactyggcagccctgtgtcctctctgaagtacacaggttggctcatgtcaactgtgtctgccgcctccccacagaggcacttgccttttagcacagttacacatgttgtacccccagaggaatacacctccctgacaagagggagttctaagagggagagagagaactgaggaggtggcctaagtagaagagggctgctgaccataaagccctttcccatggggaggagatggaagttatggtagagcactgggtgggaagtcagtagttggttccagtcatggctgtgtcaccttccagctgagtgaacccaaccaagtactgccatctgtgtgggcctgtttcccctgggaggacatagctgctgccgtaacacgaaccatcaaatgctacctgcctattgcatgtcaggcactttctcatcttccatcaggcagcattgctcccactttcctactgaagcccttacatggcacactagggtgtgatcacgtgcccaatccccagggatctgggggtgtagccagaagcagcccactagaagcatgacatcactttcaaaactccttttaaaatctttaaatacacaccaggtttgcattctgctgcataataaatccaagttttattataaaactcaccacctccaaaccctcaagtaaaattccaggaagatgatgtatgtgccatgtatattcagcagcaccatcctgtacccccttctcccacactcagtttgagagccataatgaatgcacatgcatagcaagtgcgtgaagtggtatcattcccattttacagaaggaaatcaaggggagttacatcccctcatgccctgcctccagcctcccaatctctggctgaagctatcagcccatcctccctccccaagttccaactgccccagcaggttccaaagtatccccagcaggatgctaccatcctgcctccctttgggggttaaatgggatgtggcctgagaaagtgctttgtgcgtggtgaagtgatgtgcagcaataaggcagtctgagttttgacttctggggaacactgagacctgcctgggggcccttctctactggatggccacctttgcctttatccaaaagaatgagtttaatggctgtagggacctgctagaagaatttaggggatagtgggaccagaatggacttagtgaagaggaaacttgccttgggttaggcagggtgagggaactgaaccatccttttagaactgtgcagaaacagtgaggagggctggcaggtgggcctggcagaagaggatttgatgtgtgtctaaaaacctgggctactaccatttgattgatggacctgctcccaagcaggggtaaaatggtgtcatcacctactctcttgaccttggttttctgcatctcataagaatcaagagcagcagcaactaaggccagtcctagctagcaggttacaaaatactttttttttttttttttttttgagacaaggtctcactcccattgtccaggctggagtccagtggtgcgatcacagctaactgcatcctggacttccagggttcaggtgatcctcccacctcagcctccagagtagctgggactacagatgtgagtcaccatgcctggttgattttttgtatttttgtatgtatgtatgtacatatttatttgagtggtgcgatctcggctcactgctacctctgtcttccaggtttgagcgattctcctgcctcagtctcctgagtagctgggattataggcgtgcaccaccaacgcctggctaatttttatatttttagtagagacggggtttcatcatgttggccaggctggtctcaaactcctggcctcaagtgatctacctgccatggcctcctaaagtgctgggattgcaagtgtgagccaccgtgacattttttttgtatttttagtagagacaggattttgctatgttgcccaggctggcctcgaactccggggttcaagtgatcctcccgccttggactcccaaagtgctgggattacaagtgtgagccactgctcccagcctacaaaagattttcatacctattatctcatctgagtcctccgtcctaccacctgaggttgctatgacaggatttagcccccctgccagtaatgggtatgg

SEQ ID NO: 12401 - DNA, 43021 bp, Homo sapiens
ggtgtgagagctttaggatgtgaatttgagcttgatagttatccatttctcaatacctctgtttcctcatcagtaagacgggtgagaacagtgtctaccatagaagagtaagtaagaaatccatacaaaatactgaatggtatatgataattgtttataagttgtctttttttttttttttttttttcagagacagggtcttgctctgttgcctaggctggagtgtagtgacacaaacacagctcactgcagcctcaacctcctgggctcaagtgatcctcctacctcagcctccatccccagtagctrgaaccacaggtgcacgccaccttgcccgactaatgattcttctttaaaattgtttgtaaagaaagggtctcactgtgttgtccaggctggtctcgaactcctgagctcaaggaatcctcctgccttgacctcccaaagtgctgggattacaggtgcaagccaccaggcttggccacattttcatcattattattgaaaatgaagaatgttactgtcccttatcctgttatgccaaagaaacttaaggctactctattttgctcacagtaaaatgtgtctttctcagacctgctttcttataacgtgaactcaaatttcacaggtcaaccttgagtctgctattcttcctaaataacaatgtgagcaaaacaggttctcagaaacatatagaggaaaataccccttcctcccagaagttacatagagattcagcatcattaagctgcatcagaaaatacaacctgattaggtataaagctgagaacttaaccaaaggctcagtcttctgtacaaattggtggtttacttaaacatttacaacaagaaccttcttattctacctcctggtatttacacctgtccttggaaatattatctgtaaaatgtattttttgtaagatggctgtatattggagattattgccattgtctgtagaggtaacctttaaaataatctaattctaaaactcttttttgcctggtaattcatttttaaatgacatttctataatcccagaagttgtaaatatttgaaggttttcaaataagggaatcactagtacttccctcttctccctaaatattcaagattaacataaaacctagaactgggttggatttttttttcaaactaagaactaaagagtcttcaattcatttacatcaccaattactataattttattctgcagaaaaaaagaaaaaaaaaacagacccataggctcaaaggaaaaaggatttaaataaaaatattccaaagtgctgggtgtggtggctcacgcctgtaattccagcactttggaaggccaaaggaggcggattgcttgagctcaggagttcaagaccagcctgggcaacatggtgaaaccccatctctatcaaaaacatgaaaaattagctgggcatggtggcacacacctgtggtcccagctaccttccctctgaggtgggaggatcgcttgagcctgggaggtggaggttgcagtgagctgacattgcaccactgcactccaacctgggtgacagaatgagaaactatctcaaaaaagaaaaagaaaaaaaacaccaaaacattaaaaatgattaactctagaggatgcaatttttagcttccttctctatatgtctcctggaccgctgagttttttttttggaccaagcctgcattaattccataattggaactataaagacatttccaaatgtaaaaaactgagtgacaggaggaatatattccagtcattaagaaaactgaacaaacggggccaacactgaaaatcagtgggcctgaaacaatttacacctaccagctctcgaacatcctgtagctgttattcaatgtaatgagacacattcactgtcaagattctcctgtaaatcaacacaaatgagataaaccaccttcaaagtctgaggaagaaaataaatgtgcataaacaaaacagtatttggtatagagtagatactctgtaagtacggctgcacctttccacttcttcagtgaatgaccaattaaagtaacattttaatgtaattcttgaaatatgtcttccaaaaccgtgtcttatcagatgggattgacacataacacaatattcttgagcacttttgttcataactataatgattgcttaaaattatatcatttatatttttccttcctttgactctttataaacttaatttttattaggtgcatatcattccatcactagacatactgcaatttacttgactatttccattctattggacactaattttttttttttttttttttttttttagatggagtcttgctctgtcactcaggctggagtgcagtggtgcaatcttggctcactgcaacctctgtctcccaggttcaaccaattctcctgcctcagcctattgaatagctgggtctacaggtgcacgccaccacgcccggctaatttttgtaattttagtacagatgggatttcaccatattggtcaggttggtctcgaactcctgacctcaagtgatccacccgcctcggcctcccaaagcgttgggattacaggcataagccactgagcccagctggacactaatatttttcaagctctttcccggcaattacagtcttttttccagaacaatggagctagatctttttgggtcatggtcacttttgataatctcatgaaattatagacactttgcccacttaaaaaaacacatttacacatatttacaaaaatttagtctcaatttcaagggattttggtcacctggaagctcgtcaatggaacaagaagacctcaggttaagacttcctgtcgtaaggctgggcacagtggctcacgcctgtaatcctagcacttgaggagcccgaggcaggcagatcacttgagtccaggagttagagaccaggctgggcaacatagcaaaaccccctctctataaaaaatacaacaaaaactggtcaggctttgtggcacgtacctgtagtcccaggtactcgggagcctgaggtgggaggatcgcttgagcctaggaggccaaggctacagtgagccatgatcatgccactgcactccagcctaggcaaaaggccaagaacctgtttaaacaaacaaacaaaaaaagtgttcctgtcctagatcatttgagcatgtggtcactttttcgtgtctgtgtgtgagacagtcttgctctgttacccaggctggagtgcagtggcgcgatctcggcacactacaacctccgcctgctgggttcaagcaattctcctgcctcagcctcccgagtagctgggactacagccacccgccaccatgcccggctaattttttgtatttttagtagagacggggtttcaccatgctggccaggctggtctcgaacttctgaccttgtgatccacccgcctcggactcccaaagtgctgggattacaggtgtgagccaccgtgcccagcccccacttttttagttaatttgcaagcacccgtcacaatcaacttcatacttctgttactctaatctataaaaagtttatgggaaataatctagaagagcccaataatagcaactcaatattcagtaagcccatatcatggggatgacactgctctacgaagctttacatataatatctcatcttacatcatatcaactccattaggtaggtactatcctgtccctattttatagatgtggcacagagggcctgaatcaattgtctaagcacacacagctaccaacaggcagagccaggatttgaattcagatactttggatccagagccttaatttttttgttgttgctgttttttcgagatggagtctctctctgtcacccaggctggagtgcagtggtgcaatcttggctcactgcaacctccaccgcccgggttcacgccattctcctgcctcagcctcccgagtagctgggactacaggcgcctaccactacgcccagctaattttttgtatttttagtggagacggggtttcaccgtgttagccaggatgttctcgatctcctgacttcatgatccacctccctcagcctcccaaagtgctgggattacaggcgtgagccactgtgcccgaccccagggccttatttttaactacaacatagtacggcttcttacatgccacagaaagctggacttcaaacaagtcatgcttggaaatgttacagatttctatctaaagattatctgaaagtccccactcttgttggtgcaaattacaaatccctatgttcaaagctcaatcatatttccacccctaaaagcctcacaaagcagacaacattgtcatttactgccagaaacattcccttacttaaaatcccttataccttgcctttctttaagcatcatgactatgggccaggcatggtggctcacacctgcagtcccagcactttgggacgccaaggccagaggaacacctgagcccaggacttcaaggttgcactgagctatgactatactactgcactcagcctgggcaacagagtgagaccttgtctctaaaaaaagttaaaaaaaaattttaattatgactacagaaaagataaaaaataatgtttatataacaccacctaattactaatctcttcaaataatcatagtataaaataatgctctaatagcaatctacaagaggtgcctttctataactcttcagtgcatcataatgcactgaagtatttgaacaatttgccatatgaacaggtgggtaagaattgtggagaagaacaatagggggccactgggaggaaatatgtaccagcatggcgggtcatgtaactgggaaaacccagtcaagatatttcaggccaaggaaagaaaatgttctcrtgacctagaagcaaaggtaattgtatgtgtatgtatttaaaaagtatgtataaaaaacctcacctgaaccttgatttctaaacatgcaaaaatccttttctcctcttcaaactccttcttagaaatctggcaacctggcagcactgggggaaaaaacagtaacatgagacatcagcatttctagcgcgtcacagacttaattaaaaaagaaaaagaagagcaaaacaccctctggggccacttctgccttcatccacacaaaaccaaacggaatgaaaagggaggctagagtctgtctctgtgttgagggcaattcttggggacagaggtctgcttgcaatggctctgaaacatgtagctcaccaccaaagagctcctagaggcccctcttctaggaatcccacctctagaacttccccatcaggtcttgacaagatcctgtcccgcggacacttccagatctaaaattctcatccttcttgcttgaaacgttcattatggggcttagcatagacttctttcttgcggtcatttaattgtggcaggcccgaagacaggctaaagggaacctagagcatttggtcaaagcaaatcacatttacaaatacggccacgcaccctgtcagcccgtcacacattcacaactgcacccacctccgtggggacacgccccgtccctgccacgccgtctgagacacactgtccctcggctgctcgcgtgcacacaggcttgaggatccggacacgacacgctctgtccgtgacccagccctccccacctccagcrcccccgatgccacccccaccctcactgccggttccagtcgggccccagtaaagccagccgagccctcccagcttcacccgggctgattacttctacagacacgaccaactcaccatgcagagtccaagaaccttaaggacaccggaaaaggacccagagacctgtggttagtttggacccagaggctgatgggaaacaagagcctggaaatgctcgcaggctgggagaggagcttctggcaggcaagctcgccccgcccctaaaaggcctgtgccccggagacttctgggaaatgtagtccacagcggcagagtctccggaagttgaaacctggacagcagggatgctcccagcatgcaacttggcttcacctgtcaaaggcgcttttttcgaagacgcccgggagctcttgcttttgcttgagggtctttggtgttgactgagagcgaattaaaaggttctcagctttcgctaaggaacgcattctggagtctagaacaggcgaagatgggactggggtgtctggggacttagacgtgagcgagcaagggaatccggggtaagttcgctggaaatgacctgcgcgacactaccagtttacctgggtatgagcgcctggaacagtgtctggcaattgaacagatgggtgtgtcttgctgtgagggagtttcttagttcgattcggtgtctgggaccctgcgtggacctgtttatgttcatgggatgttttctaaatttatgcctgtgtgagtctgttttattaggtgtgagatgaactgtgttacagattttatatgccgctgttgaaagacaacaataagtggtagtgagtggatattgtgaccgtggagacttayggcagtgcaaaggcggccataaacaatgcacaagcaatccagcatggctgtgttccaataaaacttgatggattataaaayttgaatctcattttttatagagtatgaaaccatttattctgaagcacacactcatactccaaaaacaatactatatattccctctctctctctcctgtgtgtttgcgtgtgtgtgtgtgtgkgkgtgtgagagagagaaaggttttaaaggagacaactaactgattctgaggttagggcaaaaagattggggctgtggttggtgtggtaagaacctttggatataaatacttttttaaaaaagaattgtctaaaaatattaaagcgaaattttatattaaaactaacagaaagaaaaggaagttactttttaggggctctttctggtcactgatatcacctctctcatcctctgccatctctcacctcctggtctctcttgcttatcaagagaagactagagctcttggatcccagcttttyccctgcctcagctgaggccactaccctggttgactcccatggtgacatggatgcctcatccagtatcgtgggtctgagtcctcatctgcagggkscttgagctttcctcggcacccatccccgtttcccatctgggacttcattatcatcagcatctgctccacctccaaaaccactggtggaagcagcctcctctcttcccatgttacttgctcaatgactcccacaagtactactctgaatattttgggggtctgatttttttttaattttttatttccataggtttttgggaaacaggtggtgtttggttacatgagtaacttcttcagtggtgatttgtgagattttggtgcacccatcacctgaacagtgtacatggcacccaatttttagtcttttatccctcaccccctttccaccctttcccccaagtccccaaagtccactgtgtcattcttaggcctttgcatcctcacaccttagctcccacttatgagtgagaatatacgatgtttgattttccattcctgagttgcttcacttagaataatagtctccaggccgggcatggtggttcacacctgtaatcccagcactttgggaggctgaggcagctggatcacctgaagtcaagaattcaagaccagcctggccaacatgatgaaaccctgtctctactaaaaatacgaaaattagccgggcacgctggtgggtgtctataatcctagccattcaggaggctgaggcaggagaattgcctgaacctgggaggtggaggttgcagtaagccaagatagcgccattgcactacagcctgggcaacaagagggaaactccatcttaaaaaaaaaaggaaaaataaataaatccaggcaaatgcattaattcattcctttttatggctgagtagtattcaactgtatatatctaccacagtttctttatccactcattgattcatggacatttgggttgttaagcatttttgcaattgtgaattctgctgctgtaaatatgtgtgtaccagtatcttttttgtataatgacttattttcctctagatacccagtagtgggattgctggatcaaatggtagttctacttttagttctttaaggaatctccacactgttttccatagcggttttactagtttacattcccaccagcagtgtagaagtgttccctgttcaccgcatccacggcaacatctatttttttttccattatagacattctttcaggagtaagatggtattgtactgtggttttgatttgcatttccctgatcattagtgatgttgagcattttttcttatgtttgttggccatttgyatattttcttttgagaattgtgtattcatgtccttagcgcactttttgatgggattgtttgtttttcttgctaatttgagttctttgtagattctggatattagtcctttgtcagatgtacagattgtgaaatttttctcccgctctgtgggttgtctgtttactttgctgactgttcctttagccacgcagaagctctttagtttaattaagtcccaggccctttgtttttattgcgtttgcttttgggttcttggtcacaaaatccttgcctaagccaatgtctagaaggctttttccaatgttatcttctagaatttttacagtttcaggtcttagatttaagtccttaaccatcttcagttgatttttgtataaggtgagagatgaagatccagtttcattctcctacatgtggctagccaattatcccagtgccatttgttgaatagggcgtcctttctccactttatgtttttgtttgctttgttgaagatcagttgactgtatttgggtttatttacgggttctctattctgttccattggtcgatgtgcctatttttataccagtactatgctgttttggtgactatgaccttatagtttgaaatcaggtaatgggatgcctccattgctttgtcttgctttggctatgcgggctcttttttggttccatatgaattttagggttgttttttctagttatgtgaagaatgatggcagtattttgatgggaattgctttgaatttgtaggttgcttttggcagtatgatcatttttacaatcttgattctacccatccatgagcatgggatgtgtttccatttgtttgtgtcatctatgatttcttttagcagtgttttgaagtttcctcgtagaggtctttcacctccttggttaggtatattcctaagtattttatcttattttatttttgcagatgttgtaaaagttgttgagttctggatttgattctcagcttggtcgctgttggtgcatagaagagctactaatttgtgtacgtcggaaactttgccgaattggactacatttctagaaatggattcctgaattaaaagagatgcttctcttaaatatttatgtaaagttactctcagaaaggttgtaagtggattcctcccamcaaaagtattgtgaatgaatatcttcttaaaatttacaattgttttgaccatttcccagtccttaaaccaatgataacattttattttctttttcttttttcttttctttctttctttttttttttttttttgagacagagttttgctctagttgcccaggctggagcaatggcacgatcttggctcaccgcaacctccacctcccaggttcaagcgattctcctccctcagccttcccaagtagctgggactacagacatgcgccaccaagcccagctaattttgtatttttagtagatatggggcttctccatgtgggtcaggctggtcttgaactcccaacctcaggtgatccgcccacctcagcctcccaaagtgctgggattacaggcgtgagccactgcgcccggcctttattttcataatatttccatgtcttttatttctcataagcttacatatgcattcaagtatttattggtcattttcaatttttccttctaagagtctatattctttacctatttctacacatttttgtattcatctatatgttgatttgttttaaatttattatctgtttgttgtatctgaaatattttcccttagtttatttgctacttaaatttgagggaggcagggaagtttactgaaacatactttatattttctataatttattaactatttacttcataatttgtgttttggctgtcaagcctacagaccaaaattataataacatcaatttgtaatttgataagcactctggtagtctatttttaagttatacatgtcgtgaacattatttgttttaatgtgtgagggatggaagttactttatttttccaggtggttaactagttaacacagattattgcttttctgtaatacttttactgagatataattcatatactctaaaactcacccatttaaagtgtacaattcagtagattcttttttatttctttgagacagagttttgctcttgttgcccaggttggagttcaatggcgtgatctcagctcactgagattattgcttttctgtaatacttttactgagatataattcatatactctaaaactcacccatttaaagtgtacaattcagtagattcttttttatttctttgagacagagttttgctcttgttgcccaggttggagttcaatggcgtgatctcagctcactgcaacctccgcctcctgggttcaagcgactctcctgcctcagcctcccgattagctgggattacaggcacctgccatcacgcctggctaatttttgtattttttagtaaagacaggggtttcaccatgttggccatgctggtcttgaactcctgacctcaggtgatctgcccacctcagtctcccaaagtgctgggattacaggtgtgagccaccgtgcctggccgaattcagtagtttctagtttattcaaagagctatgcaaccatcatcacaatcaattttagaacattttcattgcccaaaaagacaccaatacccactagcaatcatcattttcagccactccatgggctacagggatcttttctgttattgcacttgttctatattcatatttcatgtaataaacatgcattgcttttgtaattacaaagtaaaaagaaaaacgttttaaaaaaaacttatgttgggattttaaattgatccaactgatttcactttttctgatgccacaatcaatttcttattgttttacttttaatcactcaagtaattccatgttctaatgcttttcggaccagatcgggagcattcagagtggtatagctgtagagatgttctaatgcttttcagtgaggagataaaacagaaatgagggaggtctattaagctaaagtagttcagtatttcaagaaagagtacgtcgctgagatagtagaaggcagccaaaaatctttcaaaataagtaataaaaatatttatttggatttagcaacattcagttaattgttgcagtttttaaatattcaaataactgatgataaataatgtcagaaatgaaagtgtccccctactcattccctatctacagaaatgacsaaagttaatattttcaggtattcttccagatttttctgtacactgaatgtatgtataaagacacagctattttatacagaaatgggatcatgctatccatataattctgccatttgccctttccacttcaacacattcttctacttcatttcatgtcagttatagatttaattcattccttttaacgttgaattattacctaacccagcactgttcaatgtagctttctgtgatgttagaaatgtttatatccctcttgtccaatacagtagccactagctgtcttggctaatgagcctttgaaacatggctagtgtaagaaactgaatttcgaattttatttaattttaatagatttaattttaaatagccacaaatagctatcatattggctagcacagactaacagtgtctcaaaaaacgaacattgaggttcttcagtattacaatgtgaattcttcagtattacaaacacggctttggtaagcattactgtacccacatctttgtctttcatgccagcatttttgtaggctagattcttgtatgtaaaaatgctggttgcttaggggtttgctttcacacttcgtgaatgctactacacaaaactgtaaaagagctgtagtcatttccacccactacgtgtgaaagctctcatttccccacattctcaacaatattgtgtaccatctacatttttagtttttgaaatttgataactgaaaacgaagtatgccatctgtttccgttatcagtttattgctctcacctccgcacgcactcttcaatatacgctccctgctaaagggattcccccgaagggttcctgcgcctacgcactcggagcacaggttacaacttccagaaacccttgggacgcgccgtcccaaacttgggtttctggcgtctcctgcgtttccggcccgggactacaattcccacaggtcactgggccgaatgagcgkgcgctcctgatccgctttgcgcatcccagtgattcttgggttccgcgtgtagtttcggaaggagacatcgaagcagggcgaggcgcagagggcgttgcggactcatgccccagtcggcagtgcgggtaagggtgggagaagcaatgaggcgaatgcgagcagccgaagaaggcgacagtgtggctgggtatgaagacttgagggagggrgtggggcaaaacgaggtcaggcgtctccctggccgcgtgtgatggaccgtccgtggtggtgacagacatggtgtagggggtgtgtgcaatattatgtgcgtgatagagccaaggatgtgccctaccgtgcgaatggtgacgttgcgtctgtatgagagtgcacgtgccacggctgggatgtcttgtgacacagggaatggggtgtgtgtgcatctgtgcacatgaaatggccagggtatgtcttcgtgactgcatgtgtgctcatgacacagcaggtgtgtttctctttgtatgacagactgtgtgtatgtgtcaaaaagaagaaagtgcttggtgtatgacaggactggaatgaatctgtgactgtgacacaagtgtgtgggtttgtgtgtagagtgacagctggagtgtgccctagacaatcgagctttcctacaggaatggtgaagtcttttccttctctagctacacagtattgtccaataattgaagtttttaggacccagaagttgctaatttgggccttctgaactggaattgggtcaggaactggatcagtgggcaccaactctctagcttcccaaggccatcagtctcccatagtggttccctcacatacataacagaaagtaacattgaggaaatgagctacactttcygctagctggagaaacaagttcttttgtcctttttggaagctctggtgttggcagattcggctcatcataaaaagtttgaaacactggtttgggagagtgcctgtgtacctcccctcaaactaaaaaggcaacttgggggtttagccctgacccatcgatctccagggttacacgttctccttttttccaacgggggtctaggggattagtgggtcatgagttagaggcctgtgaaaattgtgcctattgaccatgtgttatttaagctacttagaaaaaggacagaaaagacccggttcaccttcagaaaaaggaagccaatccctcctgtgctaccggtcactgtaacccgctagaactaataatcactaatctcctagacccctcgggaggctgaggcaggagactcgcttgaaccctgggggtggagattgcagtgagctgagatcatgccactacgctccaacctgggcaacaagagcaaactccatctcaaaaaaaaaaaaaaaaaaagaagaagaagaagaagggaaaaatgaaaagaatgaaggctatgtccaacttgaagttagaacacagaataatagaataaatacaaagaaagttggttgaggtcaacaataagcacaagttaaagaaatagaaaacactgatgcaatagaggctaaatgccaacaactgcttatttgaagtgatccatttctgagataattaaaaaatagattatttcaaaagatgaataaaaaagagaacaggcacaaataatattaagaaagaaaaagactacacaagaatagaaaatattttttgaattagaataaatttgaaaacagatgaaatggtcaatttcctagaaagctataacttaaagaattgacaagaagagacagaaacttttaataatagacaattagtcattaatgatacagcatcagtagtttagaatttaaactctaatcatcaccaggctcagataattgcatgcaagagttgaattaagaaagagttcagacacatcttatgtgtcacttcagatcctctcagcctcacctgtgcctggggcctctggaaacttgtttctcttgattcactgctgcagcaacatccctgcatgaactcagaacaactctacatgggcacaagcagcaacgaaacctgacctcatgcctgcaatgggcactacttgtctcaagcccyagggctttcctgttgatgctgatgcatgagacgttacagaacccattgaactattcacacgcgacctggaagtacagcggagttaatagtctctgggacaaacatttcatgaaccagtggatgaattcacctcccttcttctcctcagctaggtggtcttaaaacacaaaattaaacaatcaattacacttgatagcaagcagtggccagctcagtaagaccttcatacaagtgttgtctccttccctaccacactatacttttccctctctcctgcttccctggaactgtaccggctgataaaataatagcacagaaacttcttctcagggtcctccctgtaggcaatgtaagctaagaggagtgtttccaggagagaccctcaagatccttgtgataggatttcaagcttgttacttatccatgtttggcccaagtctgatctcacagtgagttcagtaagtccatgaactcaccctatggttgttttcctctatcctttaacatatatttgggatagatatgctcatcttctggtagaactcattatagtggcttcctaacttgtgaactaagagtacttatgggctgggcgcagtagttcatgcctgtaatcccagcactttgggaggccaaggygggtggatcatgtggtcaggaaatagagaccatcctggccaaaaaggtgaaacctcatctctactaaaataaaaaaattacttgcgtgtggtggtgcacacctgtaatcccagctacttgggaggctgaggcaggggaatagcttgaacctgggaggcagagattgcagtgagctgagatggcgccactgcactccagcctggtgacagagtgagactccatctcaaaaaaaaaawaaataaataaagtccttayggtataaaragccaagtggaaacccttgaaactcaatactgtgctgtgggaggaattgcagagattgcatcatcatcaaaayttagaggatgcaggattatttgtccctatcatacctccattcatttcacttggcccctgcaaaaaacctgcatgactgaagctagtggatgtggtagattgaaaaaaaatcccacaaattcttcccattcctgtgtgtatattctttgcaacatgactttgcagctcttcccttcaaaggtggagtcaatttctccactccttgaatctgggaatgtgcatttgattttctttgagacagtagtaaatgtgacatatagaggtttgaaaaacactcactgaatggaaactgctttcttgttgcattttgaacccagctcccatgggttcatgcaagcgtgaactagactgagggatgatgagaaacataaggccaagtcattctcatgccccctcccccacaataaccaaccaaccattagaactttgagtgaggcctgactatactatgcagctgcagccaaaccagcccagagcaaaagaaatgctcagaaagcccccagaattgtgagaaataatattcgtaatttcaagcctctgagttttggggttactgattgttttcgtctgttttcatgctgctgataaagacatacccaagactgggtaactgataaagaaaaacaggtttaatggactcatagttacacatgcctggggaggcctcacaatcatagcagaagagcaaaagagaacaaagagacatcttacatggcagccagcaaagagaatgagagccaagcaaaaagggtttccccttataaaaccatcagctctgataatacttattcactatcatgagaacggtatgggggaaaccacccccatgattcagttatctctcaccgggttcctcccacaacatgtgggaattatgggagctacaattcaagatgagatttgggtggggacacagccaaaccgtatcacttattatgtggccaaagctaattcatagtgactactttaaatgtaaacaaatagcagctccaatttcagctgctatgtcagatgtgacatctttactggagttgaccaacctagtttttggtccttagtatgtgcttaatgatctgacaaatgtattttacttgatctctgacatttaggagaattaaaagccattcatgtgtgcatggtaaggactgcagcactgtcttgccccaggttcctgataaccctcctaatctccgtcatattgtagtccacagaggccttgatcatctttacattctgaagaacatagcactggttcattccaccaataaaatcatgctaatttgacctggtgatcaggaagtggcaatcactgtagaagccatagtaatgcaaatgagtgacagaaagagggagataaacctcatgaatgttcactaacttaccacatcagtgaagattttagaagtccaatcatctgggacatgccatagtatctcccttaaggtaaagaataagttattacaactcacacttcctaaactgataaacaggcacataatttggtagggctctttgacatttgaaagtgatagatacatgataggtagrtagatagatagatagatagatagatagatagatagatagatagagtggggcgtggtggctcacacctggaatcccagcagtttgggaggccaaggcgggtgaatcgcttgaggttaggagttcgagaycagcctggccaacatggtgaaactccatctctactaaaaatacaaaaattaggcatggtggtgcacacctgtagtcccagctactcaggaggctgaggcaggggaatcgcttgaagtcgggaagcagaggttgcagtgagctgagatcgcgccactgcactccagccagggtgacaaagtgaaactccgtctcaaaaataaaataaaataaaataaaaataatagatgggtatatatagatgtgtgtttatatataacatatatgatttatatgatacatatataaatcacacttcagaatagtgttctttttttctctttttttaatagttctaggtgtcttttatagctggtttttggttttgtttttgttttagacagagtcttgctctattgcccaggctggagtgcagtggcatgatcacagctcactgcagccttgacctccctggctcaagtagatcctcccacctcagcctcccgagtaactgggactacaggcacatgccaccgtgcacagctagtttttaaattttttgtggagacggggtctccgtgtgttgcccatgctggtctcaaactcctttttctttctttctttttttttttagaaataggttctcactatattgcccaggctggcctcaaactcctggcctcaaacaatccccccactttcggcctcccaaagtgctgagattacaggcgtgacccatcatgactggcctggaattttgttctgactcatttttcagataaacttgaaggctgctgagtttcaaagcaggtgagagctctacagcaggtaaagcctgcgatgcaatctccctgtccctgagccacatgaatcagcaactttgatggtgtcacctctatccataatggttgaagctgttatgtggagtctctggcaagatacaaaagcaaaattacagcccgtaaggttctgaagyaagtccatttattatgcagcatataagtgctttcaatttgaaaaccagctgctgagtactaatagagtctgtgattttgaccatgggacatcaagtatctatatgactaaaactacctgtcatgagttgggtatctaacccactaagtcatagtgcgatttgggcacagtattaattcattgtaagagatctagatggcacaaaagagttacacacacagacagctcagactctcatgtcactgaccttggttgcagctatgttgttcctttaattcacattcatgacatcatatgaagattttcctgtagaatattaaggaagaaaaggtctggctcacagatggatcagtgtgactgatgtattttggaagctgaacctaaattatcatattacgggaccactactcagaggtgggtcctacaggcagtggtgaaggtaaatcctggtgtacagagctgtgattggagatcttcacttcatttgtttgtttgtttgttttagagacaggtctttctctgttacccaggctggagtgcagtggcaggatcatagcacactgcagcctcaatctcttgggttcaagtgattttttcatttcagcctccccagtagctaggactacaggtgtgcaccactacacctgctaatttgttttgaatgttttgtagagatggggtctccctatgttgcccagattgattttgaactcctgggctcaagccatcgtcccgcctgagactcataaagtgctgggattacaggctgagccaccacacctggccccttcacttaaattggagtgagatgtggcccaatgtgcagatatacatgggctcctgggaaatggcccatggctttctgtttggtcaggatcttgtaaggaatgagactggaagctcaggggcaagtaggtctaggaagaagtatgtggatacatttatgggcrtacatacaaaatgcatgcatatatgtgtctcatcctaattcctactaaaaataatccttggttgggcacagtggctcatgcctgtaatcccagcactttgggaggccgttgcaggcaaatcacttgaggtcaggagttcgagaccagcctggccaacatggtgaaaccccatctctgctaaaaatacaaaaattagccgggcttggtggtgtgcacttgtaatcccacctactcaagaggctgaggcaggagaatcacttgaacccgggaggcagaggttgcaatgagccaagattgcaccactgcgctccagcctgggcaacagaatgaaacagygtctcaataaataaatacataaatacacaaataaatacaacaataatccccacaaagaaagctcttaacaacagggatgatccatcccatgaaagtaagtcagtccatctcctcagccagccccatgctggttcaatggtctcatgaacagagtggccatggtggcaagggtgaaagctatgcctgtgtgttagtctgtttggcattgcaataagggaatgccggagtctaggtaatttataaggaaagaaggttatttggctcacagttctgcagactgtacaaaaagcatagtgccagcatctgcttctggtgaggcctcaggaagcttacaatcatggtggaagacgaagggggaacaggtgtgtcacatggcaagagagagagcgagagagagacggtggagttcccagactttttaacaaccagatcttgcataaactcattactgtgggagggcaccatgcaggggctacctttcactgaaactaatcaagttaccrccgctactgagtacccaatctgctagcagcagaggctgatcctgagcacttgatatgcaactgcttctcaaggagaccagccagctacctcatagtaacgtaattacacaagacatctcctgaatggggcaggaatttattcttacagtgtccttaatatctttatgaggtcggaggtgggacttgattccggaggtggggctcagacaccagacctaattgaggaccagctaaaacagggcctgggtggaagcagctttccataagacactcccgccagtgtgccatgtcagtttaccattgccatggcaatacccggaagttaccacccatttccatggtgatgacctagaagttaccactcttttcctagaaatgtctgcatcatctgtcccttaatttgcgtgtagttaaaagagtataaatttgactgcagaactgcctttgagctccaagaaatctggttaaatgttgtggctcaaacctacgatttccttgtgggtaaaaatgaatgtttttaaatattttaattagttggccttgtaggtcttccctgcatgttctttatcactgtcacaattattgtgtgaatgtgagatgaacgatcaagtttcaagttatttagccctttaaaaatagtctgaaaagaagggaagggaagaattgaattggagaaagacccttgcctatgccagaatttatatttaggagtgaagcaaaagatgtctgcaacttgcttttaatggttcaacagtaatagacaaataatagatgataaagatgataatgatgatagatagctggatggatggatagatagatgatagattgatagatagatagatagatagatagatagatagatagatagatagatagaaaaaataaccacaaatcattcccctccctctatccacaccttttgttagtgtccttctgcactgactctgggataccctggtgacttgctgtggccaatgggacatgggacattagcaaacataacataagcaaaggcatgaaaagcacctgcttattaggggttgctcttttttgctcccctttggaacgttgcaactcccatgtgataaagttcaagctagccatttggaggagaactgaggcctgcctgacagccagtcttgtgagtgagaccattctgggtcatccagccaccacccaaccctccagctgaccacaagcacatgacagagcccagcagaaatcagtcaagccagcccatatcagaagaacaacccaagagacacacaggatttggagaggggtaaaatgcttgatgttttaagcccctacattttgcttgtggtttcctatgcaccagaggctgacacagaagatagagatagaataagcaaatatggcaaatgttgacaattttgatccacataattgctatatggatgatcaatgagtcttcctgcctgccttcctccctccctccctcccttccttccttcctccctccctctctccttccctctttctttctctctttccttctttctttctttctttctttctccctttgtcacccaggctagagggcagtggcgtgatctctgctcactgcaacctcygccttccaggtccaagccattctcctgcctttgcctcccaggtagctgggattataggtgcccaccaccacatcaggctaatttttgtatttttagtagagacagagtttcgccctgttggccagtctggtcttgaactcctgacctcaggtgatctgcccgccttggcctcccaaagtgctgggattacaggcgtgagccaccgtgcccagctgatgagctaatttttcaacactttcatacctttaaatttgtttgcaataaaatttagaaaaatcacctttattttcatgatgtcacgtttctcaactattccatgttatccatttttttttccctcaatctcctgggctcaagctgtcatagtcatcctgcctcaacctcccaaatgctgggattacaggcataagccatggcacccagccccatgtcatcctatatttcaaagttaatctgtgaaaccttgcttatatcaagttaactcaaaatattcacctctcaccttttatttagagccttctccaggctctaaataaaatataaatacaaaggatatttaataattctttatgarcatattttaaagctgtattagaaactacacaaatgctgccaaagaaaggtgtttgatcacgctgtgggtggtctggtatatatttactattatttaaaaaatatttttctgttaggctgggcgcagtggctcacgcctgtaatcccagtcctttgggaggccgaggcaggtgaatcacctaaggtcaggagttcaagaccagcctggccaacgtggtgaaaccgcatctctactaaaagtacaaagaattagccaggcgtggtggcaggcccctgtaatcccagcttacttgggaagctgaggcaggagaatcacttgaacccaggaggcagaggttgcagtgagccaagatcgctgcattccagcctgggcaacagagcgagactctgtccaaaaaaaagaaagaaagaaagaaaaacggaaagaaaggaagggaagggaaagaaaggggagaggaggggaagggaggggaggggaggggaggggaagggaggggaggggaggggagggaacggaagggaagggtagaaactagcaaaattagccaggcacagtggcatgcaactgtggtcccagctactcaagaggctgaggagggaggatcacttgagcccagcaagttgaagctgcagtgacccatgatgatgccagcgcactccagcctgggtaacagagaaagaccctgtctaaaaaaaacacacgactatataacatcagtagcaagacaagcatgtttactctcattaattctattcaatcatgtactgggagttctagcctatacaataaggcaagaaaaagaaaaaaaaggcataaagattggagaggaaaaagtaaaatggattttgttttgcagatgccatgattctactgtcaccatgtgcagttgttcatgttgggcactgcacaagaacactacacctaaggaggtgctattcatatcacagacatctttactattttgaaaacaactttttgaaaattattatgtattgtgcatgctattgacggttgcaaaagtgatttacaatttattgcaactatgttccagcagatggcagtaaagtgtcttgttccaagagggttggtagctaccattctacttccatatactaaggagacattggttttgaaatggaaagacgtgttgattttatgtcatttaaaatagtctgtgcttctaaacaatgagctgctcttccacctgatatgcagaacattttgttaaagtccctaatggtgccagcacattgtctgtattcagtatttcatattgcagttcatattttcatctaattatttactctaccagactggaattgttgaattctatgtttaaatctacaagtcctggccaggcacagtggctcacgcctgtaatcccagcactttgggaggccaaggcgggtggatcacctgaggtcaggagttgaaaaccagagtgaccaacatggtgaaaccctgtctctactaaaaataccaaaaattagcccagtgaatgagccgggcgtggtggcagtcgcctgtaatcccagttacagaggctgaggcaggagaatcgcttgaacccgggaggcgaaggttgcagtgagccaagatytcgccattgcactccagcctgggtgacaagaacgaagctctgtcttaaataaataaataaatctacaagtcctttcacttggcacaaatcactgtataataatatccggtcaggtgcagtggctcacacatgtaatcccagcactttgggaggctgaggtgggcagatcacgaggtcaggagttcgagaccagcctgccaacgtggtgaaaccaagtctctactaaaaatgcaaaaattagccgggtgtagtggcgggcgcctgtaatcccagctactcgggaggctgaggcaggagaatcacttgaacccgggaggtggaggttgcagtgagccgagaccacgccgttgcactccagcctgggtgacagggcaagactcttgtctcaaaacaacaacaacaataacacaacaaactaatatccggttaccattaatcatccacaaagaatgtgtgtgggttgaaattaaagagtattatgcaagtctgttaattatactattatagtagttgcttattattgctttagaaatttcatcagtataaaaataaacttatgaaaatttaatgatttgttgcctacatagtattgtaagatgctaaaattctaagataaaatattaaccttattcgatgtctatcaaggacaaaaaataatcaggaccagaaaatggaaagctattatgaaacaaagtggatcattgaatgaatttttgagaaaaacaaagttgcamggggaaaaaatttccacagctgctattttggcagaatgtagcacagatccattaattattgagcagaacagaccatgaatttactccttccacttttgggtaagccaagaaaagaaaattcaagaaataactggaagacaggaaaaatggagaataaacgaaccctttaattacatgttcttttcgtcaatccaggtacccagccacctaatttaaatattaaactctttagatgtgaatatttaaatattaaacccttaaatttaaactcttaaaaattattcaccttaaataagagcagttaggctgggtgcagtggctcacgcctgtaacctcaatgctttgggaggctgaggccagtggatcagttggggtcaggagttcgagaccagcctggccaacatggtgaaaccccgtctctactaaatatacaaaaattagccaggcgtggtggcagacacctgtaatcccagcctctccggaggctgagacataagaatcacttgaacctgggaggcagtggtgagtcaagatcacgccactgcactccagcctaggcaacagagtgagactctgtctcaaaaaaaagagcatttaacttccaaaagacagtaacggtagacagaaaagtagtttcacatcaattttttcaactgaggaataaatgaccagatcaggtaactttgtttaatctcaaaggattctgtaattaatgtttatttcaaagaggtggaaaaaatacactggagatggagaaaaatacactaaaacaaagaaatgagtagaatgtggtggatgctgtgatttgccaccaagatctctttaggaatgaaggactctgacagctgcttctgatgtcagccccttgggcattkcctcagctgatcagaacccagaagcccagtgccagacctccccctggggtgcactgaacccttggattgactgaatcaggacccaatctcaccctctgctcaaaatccagtttcctttgcctcctttatgcagctattgatcccaaggtcctgcatgctaatctcagcctcacaatctgcctcccaggagagcctagcctgcaacaacacaggtgagcacagctatcacaaattatttgaaaattagaaggtgggccaggcgcggtggctcacacctgtaatcccaactctgggaggccgaggcaggcggatcacctgagatcaggagttcgagaccagcctggccaaaatggtgaaaccccatctctactaaaaacacaaaaattagctgggcgtggtggcaggcgcctgtaaattcagctactactcaggaggctgaggcaggagaatcgcttgaacctgggacacggaggttgcagtgagctgagatcacaccattgcactccagcctgggtaacaagagcgaaactctgccaaaaaaaaaaaagaaaaagaaaagaaaagaaaagaaagaaaatgaggtgaggggcacttccacaagagcgtgcaacattcaaaatgatttgatataataaccaaaaaaattcaaagcagggtcccaaacagatatttgtacagccatattcataacagcattactcacaatagcccagaggcgaaacaaccccagtgtccattgatggaaggatgaatgaataaatagaatgcrgtgtatccacacaatgggatattgttcagcctttaaaaggaaggaaattctgacacatgctacatacaacatggttataccttcgggacattatgctaagtgaaataagccagtcactaaaggacaagtactatatgacttcacttatatgagttatctagagcagcggtcctcaaccttttgagcaccagagactgattgtgtggaagacaatttttccatggacctggggagtgggggatggtttcagatgattcaagagcattacatttattgtgcgttttatttctattattattacattgtaatatatgatgaaataattatataactcaccataatgtagaatcagtgagagccctgagcttgttgggtttgttttgttttgttttgttttgttttgttgagacggtgtcttgctgtgtcgcccaggctggactgcagtggtgtgatctcagctcaccacaagctccgccttccgtgttcaaggattctcttgcctcagcctcctgagtagctgggattacaggcgtgcccactatgcccagctaatttttatatttttagtagagatggggtttcaccatgttgaccaggctcatcttgaactcccgacctcaagtgatcctcctgcttcagcctcccaaagtgctaggattacagatatgagccaccacgcttggcccactgagcttgtkttcctgccactagatggtcccctctaggggtgatgggagacagtgacagatcatcaggcattataatctcataaggaatgcataacctagatcccttgcatacgcaattcacaataggattcacgctgytatgagaatctaagccactgatctgacaggagacagagctcaggtggtagtacaagtaatggggagaggctgtaaatacagatgaatcttccctccctcacccaccgctcacctcctgctgtgcggccccgttcctaacaggtactggtaccaggccccgggggttggggatccctgatctagagtagtcaaattcacagaaacaaagtagaatgatgcttgccagggggtgtggggaggagggatagaagaaaggggagttgtttgatgggtaaagagtttcagttttgcaagatgaaaagttctggatattgattgtacaaaaacatgaatacacttgatactactgaactgtaaaagaaaattaagatctgatttgaaagaaagagatattgatgctgcaggaagaatgcatgtgaaaacaacaaaagaggccaggtgtggtggttcacgcctgtaatcccagcactttgggaggccgaggcgggtggatcacctgaggtcaggagtttgagaccagcctggccaacatggtgaaaccctgtgtctactaaaaatacaaaaattagccaggcatggtggcaggcacctgtgatcccagctacttgggaggctgaggcaggagaatcacttgaacctgggaggcggaggttccagtgagccaagatggcgccactgcactccagcttgggcaacagagtgagactcggtctcaaaaaataaaaataacaaaataacaaaagaatatattggcatacaatctgcatgatccaatttttgacaaggtcatgactagagttccaaaagaaaattcacaattctgataatgtgtgaaataacatttatgcagaacatgaggactggaagcaagggatgacccacattacttagggaatatcttaaaacgcattacaattatgacttgtttgattaatggaatcatttccaataaggcaagaaatactaaatacttctcaactatttgggccacaaaccctagaaggtacccacatttagtaaactgcttatgaaaatcaaatatgaaaaaaaattttgagaggccagatgtttgcaaacatgattggaaatggaaccatgcrtggaaactgatggaatgcaacagaagatccttgagaacattctaaggcattcagaattctaaggcattcaacagactcgtgaacactcagacaccaggcagatgaagacagccagatggatgctcccaaaaggtacagggagctgacacttcaaagtctccaaaagtacctgaatgataccagaatcaaaagtgcacacagcactcacatactcaygcattcaccagactggtctgcctaccctgtaagcctcaatccctgaaactgacaactgctgtgaagaccttcartgcctccaccttccacgggggcttcagaaaaaccatcctccttcctggccagactccactctccagagacccccgagcacaaccctgccccggtctggatagacccccactgagagcctggggcagaaactggagaatcaggaaggaagaataatttgtatgcaaaacaggttctgggaagtgaggcctgatgggaagaggagggatttggcaagatgacagtaagggaggacatagcttggtgagtgtccatagtggctgctgtcaaagaaaaattgcacaggcaaggcagactttattcaaggagattgcaatagggaaagagactgaactcaactccactgaaacaaatrtgctagggtggttaagccctaggtgagttaatggaaaaatattggaggacaatgggggaggtgggtcaacgggatgtgtccatcacatggagttattcctgagtctgcaaatgtttttctctgtgattgggccatctgagtttgctgattgtcaattatcaaagtgaggctccyaycctcccacagagactgggcgataggggtgctrtctcccttgatgatttcaaagggataattcccaggtccttgaaaaagacattcctgggttgtaacgctggcaagagaccaggagaagatttacctacatttcaaaggsgcagagaaggccgggcacastggctcacgtctgtaatcccagcaatttgggaggccgaggcgggcagatcacttgaggtcaggaattcaagaccagcctggccaacatggtgaaattctgtctctactacaaatacaaaaattagccaggcayggtggcacatgcctgtaatcccagctactcgggaggctgaggcagaagaatggtgtgaacctgggaggcggagcttgcagtgagccgagatcacgccactgcactccagcctgggcaacagagtgagacgccgtctcaaaaagaaaaagagagggggtgcggggggagcagagaaagaatttgcaattatatttggccctctgtgtctatggggttctgcatccacaggttctacctccacgcattcagtcaactttggataaaaaatattttgaaaccaaaaaacaataaaaaaaatagaaatagaaaacaataccgagggatgactgtacaagttttctaaagtaagtgtcctacaaaaagcgtgatccagggccgagaggaagaaacctgtctaaagtttagtcgatctgaggggaccattaaggctcttttggtcaccagtgttacgtggactctgccatccagatgtgggtctgagactctgggtgtctgcacatggctggtgcccactctgtggctagtatccactagcctgatccagcaggcagcatctccaggcagcaagaagtgagacaaaccaggaggtgctagcctggggtctctgcctcagcaccaaccacctgctggggcctcctctggacctcctcacctgctgagtgtctgagcatccacatgtgtctgcctgtgtcctcgggggacagtgaccctctggttgtctgctgtatctccatcttcttgatttcattcatttaataaatgtttctgaaacacctgggggcatgtcgtgtctatcggggtgtccctcttcacctctaggtttgtctgtgtgactacacagtcacatctgttcacagcaggctgtgtctgtctttctgcatctcatgtgtaattgcttcctcgaaggcacactctctctctctctcttcctctctctctgtttctcttttgtgtctgtctctccctgtatgtctcttggtgcctctctgtttgtgtcttcattcattgattcattcgttcagtcatacggtatctcagacattcctggaggcccccgaagagttcacagcccggtaggggagacagacgctagcccagcctagtttgatcagggctgggagacaggaaggtgctggaggctgagggtgtgtggatgagtggggagatggggttcagagaaggtttagacgatgggacgatgaacgtgtctttgggtgtggagacatcccaggattggaagctgtgtgggtggtgtgtgttggggtagggggagggaagggaagtcaaaaggccatatgtgccaccctcagattagagcagagtgctgggaggggtgaaggaagaaggccaacaagacaccaatcattcaaaattaagggttccagacttctagttctctcctccctcagacccagaagtgtagatctccagcaactgaggatcaccctgtttccatcacgattacctaggaagagacccgcccacatagggagggtgggacgaagaaatactggccaggctgggtggccgggatgcttaggactcagtaaggagaaccagccaggcagmacatcacagcgggaggagctgtcccaggtggcccagctcagcaatggcaatgggggtccccagagtcattctgctctgcctctttggggctgcrctctgcctgacaggtacgcaaacttctgaatccagtagtgagaaggggcaggtggcctggactcctagatctgagggaggagagactgggggcctggactcctgggtctgagggaggaggggttgggggcctgatctcctgggtctgagggaggagggggctgggggcctgaactcctgggtctgagggaggaggaggctgggggcctggactcctgggtcttggtgggcaggagcctggaggctatgtcattttcatttctcttccctgcctttgttcttctcccatcagtcatttttcctggtgtctctcttcccaccatcccagcctttcttctcttccttgcccaacccccaattcaaaggtatttccagggagccctcaggactctttccgaaactggcagaaaccctggcttcaccttcaggcaacctctaccccattgtgggctaggacaggaacataactcatttcagaatggaagtggttacaaagacagggaattagaaatgtagaaaggaggctattcctgcacacaaccaaatctgtgtgtttctgctccttaatgggagagagtttgatttctgtatgtgtccaggttcagtatgtcctrtgagtctctgtgcttgtgtgtgtttctctgtataggttttaaagtcttagtctgaacaaatgcgtttgtgggtctgtttctgagtttgctttctttgtaaaagagatgcgtgtgtaattttgtgtatctgtgtctgtgtttatgtatctgtgatttgtaagcctatatttatctctatgtatatatgctcagtttttgttttttgttttgttttttgagacagggtcttgctctgtcgcccaggctggagtgcagtggcacaatcacagctcactgaagtcttgacctcctgggcccaagcaatcctcccacctcagcctcctgagtaactgtgactataggcatgtgccactgcgcctggctaatttttgtatgattttgtagaggtggggtttcactatgttgcccaggctggtctcaaactcctgagctcaagcaatccactcacatcagccaatgagactggccttttttcttgtggttgtttttwaaatagagataaggtctcactctgttgcccacactaaggtgtagtagcacaaccatggctcactacagcctcaaactcctggctcaagcaattctcctgcttcagcctcccaagtagttgggcctgcagggggacaccaccatgcctgaccaattgtttgggccttttgatgtgtttttttttttttttctctccatgtatctgtgtwacatgggtctatacattttgtatccatatgtgattttgatttttttttttttttgagacagagtctccctctgtcgccgcccaggctggagtgcagtggcgcgatcacagctcactgcaacctctgcttcccaggctccagcaattctcgtgcctcagactcctgagtagctgggaccacaggcgtgcaccaccatgcccagctaatttttgtatttttagtagaaacggggtttcacctgttgcccagactggtctctaactcccgagttcaggtgatcctcctgcttcagcctcccaaagtgctgggattataggcatgagccaccacccctggcctccatatatgattttaaactgtatgtttttgtgatctcattttcctgtatctctaaacatcgcataattgtggcctctggttttatttgtgcttctgtgatttgggacctctctgggtatgattttctgtgcatctggtccctctctgtgttgatatggttatcatacaggcacaagcatcctcacagacakacgctttgtgtctgtgtgattttccatgtgtgaagtgctgtgccttagttagggaggtttatattgcagggtccagatgcgtacttgttttgtgtgagaatgtaaaactctgcctgggtgcattcaggatattctgtgtatatttgtgagacttggatgaacctgtgtatgtgttgttattgtgtgtttatgtcagtttgtgtgttgctggggctgatgtatgggtttacagggcactacaggaccacacttcactctacctgtcctggagtgcatgtttcttgtcaggggtctcttactgtgctgtccactttgtgagttaagcttggggaaggatgggcagagcaagaatgaatcacttttccttcctattctaagtcatagctagggagagggcttcctggaagagggtggagacctggagtgtcctggagggaaaaaactggactgtyagctgcagagaggtcattactctgccatgagacagacacagctgtgaccagctgcaatagcagcacctggtctctcaaggcgtgtcttccctgggagcagaggggccaggcccgtgtgcctgtcatttgctgggtggagctctgagttcctgggacaggctcacactggccctgctgactctgccacgcctctctccccagggtcccaagccctgcagtgctacagctttgagcacacctactttggcccctttgacctcagggccatgaagctgcccagcatctcctgtcctcatgagtgctttgaggctatcctgtctctggacaccggtaaggagcgggagccgggggacagggatgagagattagggaggaaaaaggggggagaggggagcagaaagggaggggaattgagtagaagatgaaaagataaagatagaaagatggggagggagaggaagaagaggaggaagaaaaagaaaagggtggatgagggctggggcagtggctcaggcctgtaactctagcactttgggaggcagaggctggcgaatcacgaggtcagaagtttgagaccagcctggccaacatggcraaaccccgtctctactaaatatacaaaaagttagctgggcgtggtggcgggcacctgtaatcccagctactcgggaggctgaggcacgagaatcgcttgaatccgggaagcggaggttgcagtgagccgaaatcgggtcactgcactccagcctggcgacagagcraggctccgtcctccgccccacaaaagaaaaagtggatgagggacgagcggtgaggggaggaaacaatggggaagcaaggaagagaaggtgggagaggcgcacagggaggaagagtggaggaagagaagaactcgggggaaaaggtctgggggtgagaggaaggagggaaggagggaggggaggaggtgtaggtgaaagtgaaaggatagagggaggaggaagaacgctgagactggagggagaagggtttcgggaagcagagcacgagccccgatcccgcccccagggtatcgcgcgccggtgaccctggtgcggaagggctgctggaccgggcctcctgcgggccagacgcaatcgaacscggacgcgctgccgccagactactcggtggtgcgcggctgcacaactgacaaatgcaacgcccacctcatgactcatgacgccctccccaacctgagccaaggtgcgcgggagagcggggctgggctccgggagggacgatgagaggcctggcagcctcggggaaggcgtggcctccgctgggcgcctgctcttggcgcgctaggatcccaacccccgagacgtgctaggcgcgggctctggcgcagtgcgcagcccgcacgactgtgccagggtaccactgcctgagtgtgcatctacgctctcttgccagcacccgacccgccgacgctcagcggcgccgagtgctacgcctgtatcggggtccaccaggatgactgcgctatcggcaggtcccgacgagtccagtgtcaccaggaccagaccgcctgcttccagggcartggcagaatgacagttggtaaggggctggaagggtggaagggcctgggcaagggatatggaggcagggcagccatgagggtagtgataccagacaggcccaacagggagacatggccctgctctgaggtgggaggcatgaccctggtctgagggagaaggtttgaccctggtctgagggagaagatttggccctggtctgagggaggaggcatgaccctggtctgagggaggaggcatgaccctrgtctgagggaggaggcatgaccctggtctgagggaggaggcaagaccctggtctgagggagaaggtttgaccctggtctgagggagaagatttggccctggtctgagggtggaggcatgaccctggtctgagggaggaggcatgaccctggtctgagggagaagcctggccctgctcwgaggaaggaggccatgcccyrgtctgagggaggaggcataaccctggtctgggggaggaggcatggcccctggtctgagggaagaggcatggccctggtctgagggaggaggcacgaccctgttctgagggaagaggcatggccctggtctgagggaggcctggccctggtcttaggaggaaaacctgaagcaagtctgaggaccgaggcatggccctagctaccaaggtgaaggttcaggtgcagctgtctccctcagttctgaccgttcctcactgctttgcccacctccaggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctccygcccttgtgccccacaacctggccaacagtactggaagaaactggacacagtcaccagcatcccmggggagggcaaaacagccatgtcgtgcccygatgaagagcaattctgatcacagctgttactcamtgagcaccagccaggcaccaggcaccccataacacggcttcctgtgctctccytccagagcctgtcgcagctctaggrgggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtrtaaatgggctacttgtcataagccctaagtcacaggtcaacaaactgagaggyaaaagcacttggttgagcttgtgtatctagtgagtatggattyagggaccagattcccagccccacgaactgctaagcaaccccmcctcctaaacacatgagtgccgattaacttcacagaaaaacacmcaaggcaaagttcagcgaggtgaaattctccaagctataaagatcagggaagacttcctggaggaattcacccttgagcaaaatcctaaaggatcaatagtagctggcaaaaagaagcaggaggaagcrcattctaggtagaggagacagcctggacaaaggtctgagggaggaaggarcacaaggagtgcaggacactttcatragtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctgctattgtctgaatgtttgtgtctccccaaaattcatcttttgaaacctaattaccaaagtgatattactgggaggtggggcctttgggaggtggtgagatcatgagggtggagcccccatgaataggattagtgcccttataaaagaggccctggagagctgccttgccccttccaccacatgagaacacagccagcaggtgcctataagcaagaaagtgggttctcaccagccatcgaatctgctggtgcattgattgcagacttcccagactccagagctatgagacataaatttctgttgtgtataagccatacagtctatggtattttgttacagcagcctgaagggactaagacaccttcctgttttacagacaagatgcccaaagcacagtgagagagcaattttcagagtaagtgcatagcaagagtagactcccgtgtcttctcgctccatgtcagcaagtagacttgtgggaaggggggcaattcagaaacactccgctcctatgctcctgtaaggccatgtgacaagggcttcaggtgtctttacatcctgacatacaaggggaagctggatgtcttcattcatccttcacatttactgagcacctactatgtgcaaggcactgttccagttgctgggcatgcagcagggaactaaagtggcaaaaattcccaccttcaaggagctagcctttttgatgggctagcaatccaaagcgaactttggattttgcttgtgtatttattagagacaaggtctcgctctatcccaggctggagtgcagtggcacaatcagctcaccgyggcctcaatctcccaggctcaagcaatcctcccacctcagcctccctagtagctgggactataggtgtgtgccaccacaccctgctaatttttgtatttttcatagagatggggcccccactatgctgcccaggctagtctcaaactcctgggctcaagcagtcctcctgcctcagtctcccaatgtgctgagattacaggtgtgagtcaccatgcccagccagattttggatttcattgcaaatgtggtctgaagttgggatggccagtttgatgtgtcagcttacctatgtgacagttccagttattcaatcaaacactaatcagtgtgttgatgtgagggtatttcgtagatgtgattaaagtccataatcagttgactttgaggaagggagattgttctagacagtttgggtgggcctgactctatcagctgaaaggccttaggagcagagatgaggcttctctgaggaagaaaaaaactgcacctatggacagctgcttcagcccatgcctgagattccagcttgctctttctgacctgcctagccaggccacataagccaattctttgcaataaatcttatattatagattgtctactggttctgtttctgtggttaatccaagactaacacagaatgtgttggagccagcgtggtggctcatgcctgtaatcccagcactttgtgaggytgggttgggcggatcacctgaggtcaggagttcaagactagcctggccaacatggtgaaatcccgtctctactgaaaatacaaaaattagccgggcatgcacctgtagtcccagctacttgggaggctgaggcaggagaatcacttgaacccaggaggcaaaagttgcagtgagctgagatcatgccattgcattgaagcctgggcaacacacagagactctgtctcaaaaaaacaaaaaaaagaatgcgttggagaagtagaaggctgccataatcatatataagggtgtatgtgtgtgtgtgtatgtgtgtatatatatgttgtatgtgtatataattatatgcacatataattacatgtaatatatgatataacattttcattgaggtataaaatatatacaataaaatgcataaattgcaatttttccatatgtacatacctgaataacctccacctaggtcaagatgtagaatatttccagcccatgtccccagagcctccctcatagcccttcagagtcagtttcccaccccaaggataaccatgactccaacttctatcacagatcaattttgcttatttttaaacttcatatgaatggaatcctacagcatgtgctcttgtgtacatgctttacattttaaaagcttccctgtggcaagaatggaagctagacctgtgaggtggctactgccccagtctaggcagagatgatatacctaggcaagagatgatggcagaggtagtgcaaggagttggaaaatgaatagattttttaaaaatttagcttctccttaacaggctgcaaggaataggttttattagtggagaagacaggacctgctgatatattggttgaggagtacttgagatgactcctaggtttcagcctgaggaacagggtaaataggtttcagcctgaggaatggggaaaaaaggaatcgctcagcttcatagtaatctttcttcttcttcttcttctttcttatacagagtcttgctctttcacccaggctggagtgcattggcacgatctcggttcactgcaaactccgcctcccaggttcaagcaattttcctgccacagcttcctgagtagctgggattacaggcatgagccaccgcgtctagctaattttttgtgtgtgtttttagtagagacggggtttcaccatgttggccaggctggtctcaaactcctgacctcaagtgatccacctgcctcagcctcccaaagtgctgggattacaggcgtgagccatcacacctggccagcttctttataatcttatggtgccacagtgatgataaaggcagtccgtcgttggccaaggggttgttaggcagtgtatgactgtacttctgagatagaagattatccctgaggcatggtggccaaggactcctgtgagatgaaatacatgagcaattggcagttctttgtcatgagaatgattcaaaaacttctaaaagcttatacttgacagctctcactaagtagaacaggggtgcaccgactgccttagaactcatagtatggggggtccaagtgaaactgtggactcggctatgtagctgcttgggtattgcgacccagatgccttcctgagtgcttagcagagagggagatgcctttcaaaagtaattatggttttggaccataaatttcattttatttatttattttttagacagagtctcactctgctgcccaggctagagtgctggagtggcacgatctcggctcactgcaacctccacctcctgggttcaagcaactctcctgtcccagcctcctgagtagctgggactgtacagatgcatgccaccacatctgggtaatttttgtatttttaatagtgacaggggccagggggagggggagctttcaccatattggtcaagctggtctcaaattcctgacctcaggtgatccaccctccttggcctcccaaagtgctgggattacaggggtgagccaccacacccagcccggaccatgaattctaaatcattataactaggctcacacacatctttattaatcaaaataggaaccattacaatcaacacatttttgccaatgagaaataagtttgttgattcctgtagtataaaaatatgtgcttcaggattcaacaaactctgctttatgacccattttgaactcaaataagaaataagaaagtcgctctaatgtgctttttgtctaatatcatttccagagtctaaaataaacataaaataaacatcaagtaataagtcattagcagaaaaacataaagcaagaaatgccaattacaaggatgtataacaggccaggtatggtggctcacaactgtaatcccagcactttgggaggtcaaggtgggcagatcacttgaggccaggagtttgagacaagcctggccagcatggtgaaaccctgtccctactaaaaatacaaaaattagccaggcatggtggtgcacacctataatcccagctactcaggaggctgaggcaggagaatcgcctgaacctgggaggcggaggttgcagtgagcctagatcgtgccactgctctccagcctgggtgacagagtgagactctgtctcaaaaaaaaaaaaaaaagatgtgtaacataaccacatttatttaagaatgtattccaatatcaaatggcaaattccaacaatgcaaaaatcgcaattacttttgcactcacctaataaaagcttcacctgctggaaacagtggctcacacctgtaatcccagcaattttggaggcagaggcagaaggattgctttagcccaggagtgcgagactagcctgggcaatgtagcaagaccccgtctctctaaacaatttaattaaaagtaaaataggccgggcacagtggctcacgcctgtaatcccagcactttgggaggccgaggcgggcggatcacgaggtcaggagatcaagaccatcctggctaacatggtgaaactctgtctctactaaaaatacaaaaaattagccaggcgtggtggcaggtgcctgtagtcccagctacatgggaggctgaggcaggagaatggtgtgaacctggaaggcagagcttgcagggagccgagattgcgccactgcactccagcctgggcgacagagtgagactccatctcaaaaaaaaaaaaaaaaaaagtaaaataaaaggcttcatttattagcaaggatgtggagctactgggattctcacatccaagtagtatgtgtgtaaaatagaacaaccactttgaaaaactatttttcagtacctacctgtgtttaaagtgtgaggaaagccagaagcagtggctcactcctgtaatccccgcactttgggaggccaaggtagaaggaacacttgagcccaggactttgaaaccaacctgggcaacatggtgagaccttatctctacaaaaaactaaaaatattagtggggcatgatggtgcatgcctgtggtctcacctactagagaggctgaggtgggaggattgcttgagcccaggtatttgaggttgcagtgagctatgatcgctccattgcactccagcctgggcaacagagtaagacactgtctctatttttttttaagtgaagaagatgtgaatgaagatgtggcagtgcccctgaagggcttacaatgtcaaatagggataacattttctgaactttctcctacagccaatggggatacatggactgatatagagaaggggcgaggcatggtcaaagccaggtgatatgaggctctccctgtggccatgcaggagacaggcccgagggagtgagattggaggcagggagaccagggaggtggatggtgagagggcctctcatgctgcctggtttccagagtcaagggcaatttaggattaaaaggctggaggcagaaggaggaactgagaaaccagagtgtgagtgttatggtctacgaggagttaaagtcccttctaagtgagggtagtggtttcctctggaggttgggggttcccgatcataaaggagcacataaggagattccagggaatgcaaatactttctcttggtgtgcctttgattttatggaggttcacaatacatcatttgtccaaaatgtaccactatgttttatgcacttttggcatataaggtatattttatttatttatttgtttttgttgtttttattttttgagacagagtctcgctctgtcgcccaggctggagtgcagtggcacaatcttggctcactgcaagctccgcctcctgggtttacgccattctcctgcctcagcctcccgagtagctgggactataggcgcccaccaccatgcccggctaattttttttttgtatttttagtagagacggggtttcaccgtgttagccagggtgttctcgatctcctgacctcatgatctacctgcctcggcctcccaaagtgctaggattacaggcttgagccaccgcgccagacctattttttttttaatg

SEQ ID NO: 12402 - DNA, 47444 bp, Homo sapiens
  misc_feature (1)...(47444): n = A,T,C or G, or insertion/deletion polymorphism (see Tables 1-2)
gttgcctaatcaccacgtttatgctctgtactgagtgtagatttatagacctcgtcagacagagaaacaatgactggaaaaatacatggtcccttgtaaaagcagttgtctaccatttaatcttgatggaaagaaatttgttcctatgctaatttctcattaaggaaattgaactgtctatttctatggatagaaatacatatagaggtatcaaggctaaaagcaaaaaacatcaggtatgagatcagatgtgtaaagaaggatagagaaggcaacctgaaattattgagagctccacaatagctttcttcttgagtttcctgtattcgcagcctgagaaaagcaccttccccattctagcttctgacactccacccttgtttttccaaactcaacacggctgtggatgtcaatactaggttcatctatccgggtactacagtttatttaaaatgtgcaggaagcagccaggcgcagtggcttgcgcctgtaatctcagcactttgggaggccaaggcgggcggatcatctgaggtcaggggtttgaaaccagcctggccaacgtggcgaaaccctgtctctactaaaaatacaaaattagcctggcgtggtggcgcatgcctgtaatcccagctacttgggaggctgaggcaggagaatcgcttgaacccgggaggcggaggttgcagtgagccgagatcatgccattgcactccatcctggacaacaagagtgaaactccatctcaaaaaaaaaaaaaaaaagtgcaggaaactcaaagaacctatgaaaggccagaaagtcggtgaggtttgtttattgtgtaaccacaaacatcaccaaaaccacagagaggactgctcaacctatgatgccactgagcagacacaatatttgacataaacactacagtttgaacaggtgacactggggaccagatattagaatatctgctgctgctcctgctcctgctggtgctgctgctgctgggagacatctctactgccattctcaccaaaaggaggattttacatacttctggttcctcacttacccacttgcaaaatgatgttctatacaggtgtgcctgactggcaaaggctaggtctcatgtctgtgccttaactgcactggatccttgaaaatggagctttggcttcaacttggagaagcaaaatttataacgtgggaaattctccaaacatgggaatattgttcaaaagatgctaggtggccataaaaataaatgaacactgtatatactactgtggagttatcagaatttaattgctaaagtatagtttctaaaaagctgagagcaaatatacaacgaacgcatcgaagtttaactcattaattaataagggatcagtaagattaaagtcagttcaaataagaatttgaggccgggcatggtggctcatgcctgtaatcccagcactctgggaagccgaggtgggtggatcacctgaggtcaggagttcgagaccggcctggccaacacggtgaaaccctgtatctactaaaaatgcaaaaattagctgggtgtggtggtgtgcatttgtaatctcagctactggggaggctgaggcaggagaatcgcttaaatccgggaggcggaggttagagtgagctgagatcgcaccactgcactccagcgtgggcgatgaagtaaggccgtgtctcaaaaaaaaaaaaaaaagaattcgactgacagagatctacattctctgtttctctattcagtgaaatctacaatacaaaatttatttgcattgccatgtatagggatcatttgcatagttatcagttttttacaacttaactctaaaaagaatcaaacaattcctgtaaaggtccactaaataatacccagcacatcactgaaaggacacctgctaatgtctttcgcctgaataatttttcttaataaaatgttaagtgattgactaaaacaaaaaaaatgctaagtgaaaaaaacaagatagagaaaaatatgtgtaatatgttagtgttcacttaagatgaaagaatattaatatataggcatatttgcatatttctaaaaataggaagataaaccataaattttttaaatgattaccaattaaggaaaaaaggaaatcgtgtaaaacagacaaaagtagaggctagagttctttgaatatacctcattgtgatgatttcactttggatccacataaatgttttacataattataaaatgaaattacataagtgtaaaaagcaagccctaaaaggaagaagtgaaatgaaacaaataaacctgtgtatggaggtggagcataaccatacagggaactattccaggtgacttcaaaacacagtaattgacttacatcgttagcgacatttggcttaatggagaaaaacctgtccccctccactttaaaacctctaatttgttttcattaacaatcttattggcgtaggcttgttgttgttattctgcaattttacaggataaattaaacaagtacttgagttgatattttagagaacccagattttttaagcatgtttgaaaagaagtgcagatataagattgatggggtgagtaaaccctatagtcttgaatttgaatttgaagtatcagtgtcagcttgtgatttatttaatttttttaaaaaagatatttcttagctctagctactgaaaaggcttagcaacaatggtcaatctgctatcccaaacactgctagttcctagattatggtatttaaacattgtttccactaaaaggaaccagagctccttggagaaatggctgattccaggtctggggcaggaattgttcaagacaaacctgcaatagcctgtcatattagaaagaaaggaagcttttaaagagtactaatattatgccaaatatacaaactctgtctgcaccaaagagccagtttgaataaattcctacagaccaaaaatgagacaatatgagtatcaataaggataaaactggaatggattgaaacacatcaaatatgtttaaatccatgaattcataatgatataaacataactcaatggtttcacaatatatggagcttatttaaatctcaattcaaacaaactattaaaaaatgtataagacagtccagaaaatgtgaacattgataggatgtctgatgacattaagaaattattgtcttaatttcttatgacaataaagtggctcacacctgtaatcccagtacttagggaggctgaggtgggcagattacctatggtcaggagttcgagacaagcctggccaatgtggtgaaaccccatctctactaaaaatacaaaaattagctgggtgtgatggcacatgcctgtaatcccagccacttgggaggctgaggcaggagaatcgcttgaactcggcaggcagagattgcagtgagctgggatcacaccactgcactccagcctgggcaagtgagtgagactctgtctcagaaaaaaaaaaaaaagaaaattattgttcatttattttagatgtgatgatggtattgtggtattatatttgtttaatagtctctgtcttttaaagacacacacagggacatttacgtatgaaatgacagaatgtctagaatttatttaatataattcaggtagtgagagtgggaatataaataaaataagattggccatgtactgatcattgttgaaacaagacaatggtttcacggcagctcattttactactatttttacttttacatgtgttttaaattttccataagcagtatctttttaaaaaaaactgtatggctacaaacacaaacatgtctactacagctgagatgaatcaacattataatgatgttacttctccctaaatttatgcatatattcaaataaaaactctaatagccagatgtgggggctcatgcctgtaatcccagcacttcaggaggccaaggtgggcagattgcttgagcccaggagtttgaggccagcctgggcaacatggtgaaaccccttatctacaaaaaacaaaaaacaaaatcagccaggcatggtggtgtgcacctgtagtcccagccactccagaggctgaggcgggaggatcacttgagcccaggaggtcaaggctgcagtgagccatgattgcatcactgcactccagcctgggtgacagaatgaaaccctgtctccaaaagaaaaaagcaaaaaactccaacagagtttttcagggaacttgataaactgattcaaaaaattcatataaagaagagttaacaagtacaaaatacaaagacaatgtttaaaaagaagaacaaagatagggtggcctagatgacttgccttaccatacgtggagacatattacaaagctgttttaattaaaactgtgtgatactgaagtagcaaaagataaaaagaacagcttcatgagctcagaaactgacctatctatgtatgagaatttggtgtacaatagaggtagaatcaaaattggaaaacaaagaaaataagctccctacgtcataccatacacaaaactaaattccaggtgaattaaacacctaaaagcagtagccatagaaaagataaataaaacactctctgaaagtataaaaataagatgagtgtatctttattacatttggatgaggaaaattttcttatacaaaaacagtatagattgattatacggaaaagctgaataaaatgttctacctcaacataaaaaaatttcatatagaaaaactcactataaacaagactaaaggacaagtggaatttcataggcttatgcaaaggaagaaaaaataaaataaaagacaagtggaagactaagggaggatgtttttaagggtatataactgtcaaagattagaagccagaatatatttttaaaacacatacaccttggccgggcacggtggctcacacctgtaatcccagcactttgggaggctgaggcgggtggatcacgaggtgaagagttcaagaccagcctggccaagatggtgaaaccctgtctctactaaaaatacaaaaattagctggacatgctggcaggtgcctgtaatcccagctacttgggagtctgaggcagagaatcgcttgaacctgggaggtggatgttgcagtgagccaagatcgcaccaatgcactccagcatgggagacaaagcacgactccgtctcggaaaacacacaacacacacacacacacacacctcccacaaatcactaagaaaatgcaacaatacaatagaaaaatgagcaaaaaagatgaacaggaaattcacagaaaattcaaacggtcaataaatgtgtgaaaagatcctcaacctcattagtaattaggaaaatgcaaatttaaaagatgatagttcgtcttgctcccaccccacccaggtaatcattctcaattggatatatttgagtgtatccttttttccatgaatatactaacacatacacacacacacacacacacacacgcatattactaaactatacatatagtatatattaataaagacattttgagtttgatgaacgaaggaatggctgagtgagaaccagacaatatcagatcatgaatgagttgtgttaaaagcagtaagacaggttttcctaggaaatcatacaaggagctgggatttggggagctttatctaaatctctttataactaaatgttttccatgtaaaagttggtgtttttaaaattcaatttaattttttttttgagatagggtcttgatatgtcatccaggctgaaacacagtggcataatcatggctcactgcagccttgtcctcctagactcaagcaattctcccacctcaccctccccctcagctgggactacaagcatgcaccaccatgcccagctaattaaaaaaaatttttttgcagagacagggtctcactatattgcctaggctggtcttgaactcctggcctcaagtgatcctcccgcctcagcctcccaaagtgctgggattataggcatgagccactgggctcagacaagggctcttcttgatggcttactgtatccactttgtccccaagaccatagggaaatgactagaggtgactgtactagctagattttaaatgaaactgaaatgaaagttcacttcctcattttgagtacctcatgtgacaagttccaatttcttttcaagtcaattgaactgaaatctccttgttgctttgaaatcttagaagagagcccactaattcaaggactcttacygtrggagcaactgctggttctatcacgtatgtactctttgttctttttctcccatttggtcttcaaacactctgtgtttgtaacttgttctgcctgctaggttttaaatctttggtttcaggaagtaaactaaaaaatcgtgtcgttcaatttgcctcttctctatttttaaaaagttaatgtctgcttgagcatctaagcatctaagttgagactgaaacatggctttctttggaatataatttaaaggcttacatgtttaaaattccagatgttttcaattaaaaagaaatggaaaagaaagtagaatccagtttgagggagctagtcgctgaatttctgttgatgtctcttgaattaaatacagaagtggcattttaaagagtagttaattgcctcatttgaaacagatgtctgatcattaaaaaaaaaaaaacgtaaaaaggaaaattacctacctaaagatgtgaaagcaatagatgagaattgtcttttaactatctgtaaagactgtggatatttaaacaggtcagttaagaagagcccatgtattcaaaaattcaggagataaactgatttttcagaggtttgtctctcttaaggatgatttttttttttttttgagagagagagaaagagatttcctttgattagatttgttggcaaatcctggaaagtccctgttttctaaccctctagatgtgtttggtttaccagatattgggaaattcctggaaatcactttttaaagtgctactaagcattggaagtagtatttctgacataaatctgcagctgttccctgtgactatatatcccaggaattttcctgtakaattctgtttataatagtctgtccctttgatagactttgcattgttattttctcttatgaaaacatgtggtcacaacatatgcagctaatagcaacacttcctatgttacctttccttacacagaatgaaacggctggtttgtgygctcttggtgtgctcctctgcagtggcacagttgcataaagatcctaccctggatcaccactggcatctctggaagaaaacctatggcaaacaatacaaggaaaaggtagattggattgccactcgagcgatatgcttttaaaggagtactgttttctacctcttaaaattgtgttcttacaggcagtgttttcagtaaatatttaagctgggtgtggtggctcgcgcctgtaatcctagccctttggaaggccaaggtgagcggatcacctgaggtcaggagttcgagaccagcctagccaacatggcgaaaccccatctctactaaaaatacaaaaattagctggatgtggtggtgggcgcctgtaatcccagctactcgggaggctgaggcaagagaatcacttgagccgggaaggcggaggttgcagtgagccaagattgtgccattgcattccagcctgggtgacagagtgagactccatctcaaaaataaataaataaatattatgtacttgtttcttgccagatactgttcttggtaccatacagcaggaatcaaaacaaaattcctgttatggagcttatattatagtgagagagacaggaaataagaaaataaacaagcagatatgtagtatgctagatggtgataagtgttgtagataaaaataacagaaggcatggagagtaggaagggccctgggtggtggtggtggtaagaagtctatctatatgacaggagggttagggaaggcctcacggataagggtgccatttgagcagagaattgatggaagccagggagcaagcaaaatacataatagagtgaaggtctcaggccaagggcaaatcagcacaagctcctgaggaagggccacatttgggatggctgaggagcgaaaaggcgttaatacccacatagtgtggccagatattgtttcttgactatcacttcccattttgtacttttgtttttatttcaaagcacacttgctgatgttaagaccttaaccctactgctttaaataactaagtcctgtaactatgtaatatttctgtttgtaagctagcatcatatatttatttatttgacatattattttgtataaaaatgacactcttaggtcatacactctaagttttatttttatttatttataattaaataataattgtgtctatttatggagtacaatgtgatgttatgatacaaatatacattgcagaatgattaaattaggctaattaacctattcagcacctcacatacttatcctttcattgtgataagaacatttaaaatctaccctttcagtaattttgacatataaaatacattattattattatctgtagtcaccatgctatgcaatagattgctagaatgtagtcttcttgtcaaatgaaactctgtactctttgcctaacatctcccctttccctgtctaccctccgcccagcctctgctaaccaccattctactctctacttttatgagttcaactgttttagattccacatgtaaatgagattatgcagtacttgtctttctgtgcctggcttatttcacttagcataacgttctctagacccatccatgttgttgaaaatgacagaatttcctttttttttttttaaggctaaatagtattccattatgtatggaatacaatatgtaccacacttttttatccattcgtcttttaatggacactttataaggttgattccgtatcttggctattgtgaataatgctacaatgaacatggaagtgcagctatctcattgacatactgattgcgcttccttgggacatatacccagaagtgagattgctggatgatatggtaattatatttttagttttttgaggaacctccatactgttttcccaaatggctgtactaatttacattcctactaaaagtgtatgagggttcccttttctccacatcctcaccaacacttatctttcatcgttttgataatagccattctaacagatgtgaggtgatatctcattgtggttttactttacatttccctgatgactggtgatgttaagcattttttcatatatctgttggccatttgtatgtgtcttgttttgagaaatgtctattcaggtcttctgcccatttttaaacagggttgttttcttgatagttactttgagttccttctatatttgggatattagccccttatcaaatgtatgatttgcaaatattttctcccaatctatgagttatcttttcactctgttaattgtttcctttattgtacgaaagctttttagtttgatggagtcccgttcgtctatttttgctattgttgcctgttctttaggggtcatattcaaaaaaccgttgcccggaccaatgttgtggagttttcccctatattttcttatagtggttgtatatagtttcaggccttatgtttgtgctttaattcattttgagttgattattgtatatggggtgacataagggttcaatttcatttttctgcatttggatagccagttttcccaatactatttattaaacagactatcytttccccattgtgtgttcttggcacctttgctgaaaattgattgaccataaagttgcaggttatttctgggctctatatcctattccattggtaaatgtgtctgtttctatgccagtactatgctgtttaaattactatagttttgtaatatattttgaaaccaggcattttgtaatgcctccagctttgttcctcttgctaaagattactttgactayttaaggacttttgtagttccgcatgaatttgaggattgttttttctatttctgtgaagaataacattagaattttgatagaaattgcactgaatttctagtttgctttggatagtatgaacattttagcaatattaattcttccaatccataagcatggaatatcttcccatttatttattttatcttaaatttctttctttcttttttctttttttcttgtttttttgagatggaattttgctcttgttgcccaggctggggtgcagtggcgtgacctctgctcaccacaacctctgcttctggggttcaagcaattctcctgcctcagcctcctgagtagctgggattacaggcatgtgccaccacgcccgggtaattttgtatttttagtagagtcggggtttttccatgttggtcaggctggtctcaaactcccgacctcaggtgatctgcctgcttcggcctcccatagtgctgggattacaggtgtgagccaccacgcccggcctattttgtcttcagtttcttttatcaatgttttacagttttcagcatataacttttcaactccttggttaaattaactcctaaatatgttttaaatgctgttgtaaatagaattgttttcctaatttctttttcaaatagttgttagtgtataaaaatactactgacttttgtatgttgactttgtgtcttacaactttactgaattcatgtatcagttctaatagttttttgatggagtctttcttctctcttttttttttttttttttgaggcggattcatgctctgtcgcccaggctggagtgcagtggcgcaatctcggctcactgcaacctccgcctcccaggttcaagcaattctcctgcctcagcctcctgagtagctgggattaccggcacacgccaccacacctagctaatttttgtgtttttagtagagatggggtttcaccatgttggtcaggctggtctcgaacttctgacctcatgatcaacccatcttggcctcccagagtgctgggattacaagcataagccgccttgcccaaccttctttttttttttttttgagatgagatcttgctctgtcacccaggttggagtgaagtggtgtgatcatagcttactgcagcctcaaactccagctcaagtgattctcttgcctcagccttccaagtaactgggactgtaggcacatgccaccacacctggctaatttctatttttgttttttgtagagaaggggtcttgccatgttgtccaggctggtgttgaactcctagattcacacaatcctcccacctcaacctcccaaagtacaggcatgagccaccacacctggccaagactttctatatgatcatgttatcaacaaacaaacgcaatttcacttcttccttctcttatttggagatcttgtatttatttttcttgcctaattgctctggctaggattttcagcactatattgactagaaatggtgagagtgggtacccttgtctttttctgatcttagcagaatggcctttaaattttcacccaattgagtatggtgttagctgtagtcttgccatatatggcctatttgtgttgaggaacattccttctatatgtaatttgttgagaatgtttgttatgaaaggatgttgaattctgtcaaatgcttttcctgcatctatttaaatgatcatacggtttcgttggtggtgatgaatttcaccctcacccacaccctttatgaacaggttcctcatttcaagattgactggacttagatgtgcaattagcaccactatctggttaaatgaatgctatccctctgtttaataattccagtccctcaggatgaatgaacctgacttttgattcgtatcctacctttataattgatctcaaagtgcacttctttttttttttttcctttcttgcacttagttagatttgtttgcctttayaccattgcttctcatcttgtggtttggaagtaagcccatcatgcatgcccattatgtccattactggggtaacagtaaaaccttgctccaagggaaagaaacctgcatccagacttgctacccagtgcctctgggactgggctcacccgctcaatgaaatgaggcagaacacagttgttgctgactgctccctggggttccagcttattggaaactctggcttcagctactgtaggaggcaccatccaccttgccttctacatcattgtattctatgtaaatgaatctcctgaaggacaagaaaatcgtcggtcagcatgtaaattcactctgaataaaattaaaataatagaatcaaaaatgaattttcaaaagactatatataaaggaataatatgcacactaatggacaagaaataaattagaaatcttgaaaataaaaaatattgtcattgcgataaaaatcaaaaggatttccagactggaaagagctggatagaatcagtaatctgaaagatagtactgaggaattcacccagaatgcagcacctagaaataaaaagaaaaatatatgaaaacgcaagtaagagagatgaaagagagtttgaggctccaaaatacttcggataggagtttctgaagaagagaattaggtggaatggtggagaagcaatatatgtggagacactgattgagaattttccagatatgagaaaaggtcctgagtcctccaatcaaaagcacacagccgaaggtaaataaagaaacctacacccagatacatgtaacgaagttgtaaaacatcaaaaagaaagagcaaatcatggctgggtgtatggttcatgcctgtartcccagcactttgggaggccaagggggaaggatcctttaaggccaggaatttgagaccagcctaggcaacatagggagaccctgtctctacaaaaaaaaaaaataataataaaataaaaataaaaataagctggttgtggtggtgcaggcttgcagtcctagctactcgggcagctgagatgggaggatagtttgagcccaagagtttgaggctgtagtgagctatgatcataccactgcactccagcctgggcaaaagagcaagaccctgtctaaaaaaaaaaaaaaaaaatgctgggcgcggtggcttacaccaataatcgcaggactttgggaggctgataggggaggattgcttgagcccaggaattcaatatgagcctgcaacatagggagacccagtctctaccaaaacaaacaaacaaacaaacagaaaaactggctgcagtggcacacaccagtcatcccagctatgcaggaggctgaggtgtgaagattgctgggtcccaggaggtcaaggctatggtgagcagtaatcaggccacttcactgcactccatccagccgagtgacagagcaagactctgtcaaaataataataataataataataaatgttaaaaagagaaggaaattcatgtttatcataaaataatattaaaccatcaaagcagttaagagcaagaattaagattaatatgtgaagttagcagttatattggatatatttatgtatttgcatgctctcgggcagatccacatttggtagaatgcttcaaaaatgctatttttgggcgggtgcagtggctcacacctgtaatcccagtactttgggaggctgaggcaggcagatcccctgaggtcaacagtttgagaccagcctggccaacatgacgaaaccccgtctctactaaaaatacaaaaattagctaggcgtggtggcacatgcctgtaatcccagatactcggaaggttgaagcaggagaatcacttgaacctgagaatcggaggttgaagtaagctgagatcgtgccattggactccagcttgggtgacagagtgagactccatctcaaaaaaaaaaaaaattgccattttcatcatcaaacacttatttgtccaggatgcagtatgactatgttcttcttcattatgttttagaatgaagaagcagtacgacgtctcatctgggaaaagaatctaaagtttgtgatgcttcacaacctggagcattcaatgggaatgcactcatacgatctgggcatgaaccacctgggagacatggtaggtacattacaagaaatcccactttcacgtctgggtaaatatcatttccttyctgtctccccaaaagcaatttgaaggtaaacaacaataacaaaggaatgtatagtacaaagttggaaaacagtagaattgaaggacgtaagaacktgtacagaaatttcttacttagttctattttgactgctttctttctttaacaaatcacttctttagaggaaattttaaactcagagactaccattgttttttttttaataaattctagaaagtattacctaaagactattgacaggtttttatagcaagttgccatacttatttaagtctagattgacaatttagtatgacccatctgctttcttaatgggagaatgtgggtatttaatatcacaaataatcccctattggttttcagattctgttctgtcctgcaaaactttaccactgttgccaaagtgaagaagggaacgccctaggtagactgaattccttcttaaatgcaggaatctcctttgtaattatttctcacatgggaaaycagtttagtccactttttagacagcccttttataaaattctgccttgctttgaaacaaaaatctgcctccctgtaacttctagtttttaccattctctttttctccttccccatgagggtgcctagctgggatgctagtgccaagtgtgaaactaaacaaacccagataattcgccccaccagatcctaatggaacctgtgttggtcacaactattactgttttttctcagtttttttattccatggcagtttttaaatatattcacagttacagttattaggatattagaaagtaggataggctgggcacagtggctcacacctgtaatcccagcactttgggaggccaaggtgggcagatcacctgaggtcgggagtttgagactagcctgaccaacatagagaaatcctgtctctactaaaaatacaaaattagctgggcgtggtggcacatgcctgtaatctcagctatttgggaggctgaggcaagagaattgcttgaacccgggaggcagagattgcagtgagccgaggtcatgccattgcactccagcctgggcaaaaagagtgaaactccgtctcaaaagagaaaaaaaaaaaaaaaaaagaaagaaagaaaagaaagaaggatgtaagtgaaagagatatatagtcatgtgtcatatgcattttggccactgatggaccacatataccatggtggtcctttaagattatgatggagctgaaaagttcctcttgcctagctagtgatgttgtagccaccataacaatgtagcacaacacactactcacttgtctgtggtgatgctgctgtaaacaaacctactgctctgccagtggtatgaaagtatagcacataaaattttgcacagtacaaaatgcttaataataataaatgactatgttactggtttatgtatttactatactatacttttaattgttattttagagtgtactcctacttatacttttaaaaagttaactgtaaaacagcctcaggcaggtccttcaggaggcatccagtagaaaacattgttatcagaggagatgacagctccatacgtgttgttgcccctgaagaccttccagtgggacaagaggtggagacgraatgcagtgatactgatgatcctgaccttgtataggcctaggctaatgtgtgtgtgtgtttgtattttagtttttaacaaaaaagtgtaaaaacttttaaaaaattaaaaatagaaaaagcttatagaagaaggtgataaagaagaaaatattttcgtacagctgtacaatgtgtttgtattttaaggggttaccatagaagacaaaacatttaaaaaattaaaagtttattaagtaaaaaagttgcattaaactaaggttaatttattattgaagaaagaaaaatgttttaacaaatttagtgtagccaaagtgcaccgtgtttataaagtctacagtaatgtcctgggccttcacattcactctccactcactcactgactcacccagagcaactccaggcctttcatagtaaatgacctatatagaagtaccatttttactttttttttttttctttgagatggagtctcactctgtcgcccaggctggagtgcactggcgcgatctcagctcactgcaacctccgcctcccaggctcaagtgattctcctgcctcagcctcccaaatagctgggattacaggcatgcaccaccatgcccagctaatttttgtatttttagtagagatggggtttcaccatgttggccaggctggtcttgaactcctgacctcaggtgatttgcccggctcggcctcccaaagtgctgggattgcaggcgtgagccaccatgcccagctcccatttttactttttatactgtattttcactctaccttttctatgtttagatatatttagatacacaagtacttcatattgttctacaattgcctacaaccttcagtacagtaccatgccgtgcaggtttgtagtttaggagcaatgggccctaccatacagcctaggtatgtaggagccaatacgctctaggtttgtgtaagtacacactatggtgttttcacaatgacaaaatcacctaacgatgcatttctcagaacatattccagtcattaaacaatgcctgactgtatatttgctttgtagaccagtgaagaagtgatgtctttgaygagttccctgagagttcccagccagtggcagagaaatatcacatataagtcaaaccctaatyggatattgcctgattctgtggactggagagagaaagggtgtgttactgaagtgaaatatcaagtgagtattaccatcccaagcctctgaaccctaggtagagctctttaaatgcttagtctagctacagaatttgacagtgaatyttacagtcccacgtgttactttctagttatttttgttattcttgtcttcccaactaaattataarttccttaagggcaaggatcacatattatattttatttatacagttggccctccatatccacagcttccacatctgcagattccaccaaccgtggatcaaaaatatccagaaaaaaatgaaaataaaaaataggccaggcactcacgcctataataccattactttgggaggctgaggcaggcgcatcacctgaggccaggagttccagatcagcctggccaacatgatgaaaccccgtctctactaaaaatacaaaaattaactgggcctggtggcacatgcctataatcccagttactcaggagagtgaggcaggagaatcacttgaacctgggaggcagaggttgcagtgagctgagatcacaccatggcactccagcctgagctaaagagcgagactccatctcaaaaaaaaaaaaaaaggtaaagtataagggagggccgggcgtagtggctcatgcctgtaatcccagcacttttccaggtcaagggaggcagatcacttgaggtcaggagttcgagaccagcttggccaacatggtgaagtcccgtctctactgaaaatacaaaaattagcctggcgtggtggtgggcgcctgtaatcccagctactcgggagggtgaggcaggagaatcacttgaacctgggaggcagaggttgcagtgagctgagatcttgccactgcactccagcctgggcgatagagtgagaccctgtcttaaaaaaaaaaaaaaaaaaaagtgtataggaggatgtgtaggttatatgcgaatactcagtaatttatataaggaacttgaaaattcttgactttggtatgctcagaggtcctggaaccaatcccttgtggatactgagggacaactggattctccacagtggtttttgttttgttttgttttgttttgtttgagacagggtctccctctgttgcccaggctggactgcagtggtgcgatctgggctcactgcaacctctgcctcttgggctcaagtgatcctcccatctcagcctacacggtgactacaggcacacaccaccactttttttttctttgtatttttagcagagatgggttttgccatgttgcccaagctgatctcaagctcctgagctcaagtgatcctcctacctccacctcccaaagtcctgggattataggcatgagccctcgtgttcagcccccacagtgcttttctaagtgatcatagagccacctacttagacaaacactgaactaagcaaataggtgtttaacacagacttttattgctcacrctatgcattgactgcactggactctccaataagccaattgcttgagaagcagtgttgtgtgagagagccctggtgatcaggaagtttctccatttcacttgtgagtttcaaagttgaaggagaagaaagaactagagatagagtgttctataaattgagccactcaagttaattcatggctagtcttgcatcgttagaatatgaaatatgtgccttgtaaaattattgttcctatgctgttgtattttcctttagtttgcttgttttaaaaaaattgcaaaaatcctaaattagttagaggtaaaacacatgtatcaccatagaggtcagggtaagtgagaggaatcaaagcattctgagcagctaccccaggttgtgatcaatgaagaaagtaaaaatttattaggaagtaaatggtggccaggcacagtggctcacatctgtgattccagcactttgggaggcagaggcagaaggatcgcttgagcccaggagttagaaaccaacctaggcaatatagtgaggccctgactctacaaaaaataaaaataaaaattagccaggcatggtgcgctcctgtagtcccagctacttgaggggctgagatgggaggatcgcttgagcctgggaggttgaggctacagtgagccatgatcacaccactgcacttcagtctgagtgacagaaggaaaccctgtctcaaaacaaacaaamaaaaagaagtaaatggtactgctaatctcttattcttttccacctacatatttttctttcaattagttttggatttcttacccgaggttctctaaaataacagcttttagaagacccaataaaccacatatttagatgttaactctgagtaagttaatgagctcctttctctgggtgcttgcattttaatgaacaattttgcttcaatcaaaagcaatgtcagtttgcttccttttggtggagagcaaggtgggaggagggaaggagagagaaagagaacaattatgatggggctctggacactctgccccttttaaaactaaagcagctttgcctttttttgtttgtttatgcctccttgtaaaatattttttaatcaaaaaaattctgaagataacaaaggtttgaaaaatgccaacctaggattaaacttcttatgtttcaggcatcatatgacaggagaaagggtattttaggtcaaggaaatcatcctagctctctcaaaatctcattactgtaggcaactatctcccttacttatgggtgaaaataggtgcaatttggtacatgctcagtgagtattgtttctaagtatatttgaatatggccattatgttctgagcttggctgattgcaaatctctatcaaggttggaccttgcctagataacaattgagttaaatttagtcttcattcccattgttaaagacagaaggaaactgtagtgggggagctctttctgggaactagggacagaactgatgtagctgagcgttgtccagtttgggttatggaagtcattccgaatgattttctgtgatttgcgtttgtgaccttgtatctgttttagggttcttgtggtgcttgctgggctttcagtgctgtgggggccctggaagcacagctgaagctgaaaacaggaaagctggtgwctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggtgcgtctwaagcaaactttttgtgctgccccatgatctcatgttatccactgactgactgtgctgggcttgccaccatgccaattgcttgagaagcagtattgtgtgtgagagagaaccctgaagaggaattcttaaattctcaagagttctgtttctgatgaagtactcttcttaatatatcagtagtacaaataaggaagtagcattcatgcttaaaaacagattttaatgactgggcgtagtggctcatacctgtaatctcagcactttggaaggccgaggtgggtggatcacctgaggtcaggagtttgagaccagcctggccaacgtggtgaaaccctgtctctaccaaaaatacaaaaattagccaggcatggtggtgcatgcctgtggtcccagctactcgggaggctgaagcaggagaatcgcttgaactcaggaggtggaggtgcagtgagccgagatcacgccactgtactccagcctcggcaacggagcaagactccrtcccaaaattaaacagattttaagcaaactatccttaaaattatttctctgtatttaaactttttcttctgcagcctcccatgctcaaccttattctcagatcattaaccacatcattcttccacccactgagaagctaaataacactctcctcttcctcagaaattcattatacattttgatataacgataacctaaggattgtgtccatgttacagaagattttaaaaatataaaaatatcactcaaaaaccttctaccttaaccactattgttttggtttatttctttcaagttattttcttgttaagcacttaaaaaacatagttggccaagtgtggtggctcacacctgtaatgtcagcactttgggaggtcgaggtgggaggattgcttgagctcaagagtttgagaccagcctgtgcaacatagtgagacctcacctctactaaaaatcaaaaaaattagccaggcatggtggtgcacacctgagtagcagttccagctactcaggaagctgaggtgggagaatcacttggcccaggagttggaggctgcagtgagccatgattatgctactgcactccagcctggacaatggagtgagagcctatctcaaaaaaataaataatataaataaatacaaaatagttgtatatacaacaaacatgaatttgtaactttccttttcccacttgaaatacttgtgtttcccatattatatggtctttatataccatcattttagctgcagatcatcttgcaggcatcaaaaagattttaaagctctcatctagagtttattatctctatgtaatatttccctacagtccacctgaaagtctgaggggccattgtcctggcaagttttgcatgtatgaggatgttcacaatttgaaagaayagaatagttctgtatttcctccattattgctgaaacccgggactgttaggatttggaagatttgcaaaggaaggagccttagacacatgaaaaagttaaagaaaggaagggagacatttaaaatccaggcttaggatacaggtgatttatacaggagttgaagtatacttcatcatatttatacttctttttgcaggatcagaaatgtcaatatgactcaaaatatcgtgctgccacatgttcaaagtacactgaacttccttatggsagagaagatgtcctgaaagaagctgtggccaataaaggcccagtgtctgttggtgtagatgcgcgtcatccttctttcttcctctacagaagtggtaaaaaataaaataaacaataattagaatttaaagaaagaaagaaaggatattggctgagcacggtggttcatgcctgtaattctagctttggaggctgaggtgggaggattgcttgagcctgggagtttgacaccagcctgagcaacatcgcgagacccttatctctacgaaaaataaaaataaaaattagccggatatggtgacactcacttgtagtctcagctacttgggagggtgaggcaggaggactccttgaacccaggaatttgaggttacagtgagctatgatcataccactgcactccaacctgggcaacagagtgaaaacctgtctctaaaaaacaaggaagaaagaaagagaaagaaggaagaaagaggggcagggcagggcagggcagggcaaggtggggcggggcggggcggggcggggtgaggcggggcggggtgaggcgaggcaattttaaacctcatgaaccaacatctgctggcttcaaacttttcttctgtagcttcctcgcctctctcagccttcttacaatagaagagagttagggtcttgttctggattaggttttggcgtaaaggcatgctgggctggcttactcttgtatctagaccactcacattttctctgtatcagcaataaggctgtttcactttcttgtcatttgtgtgttcagcagagcagcatttttaatttccttcaagcacttttcctttacattcacagcatgcctgactgttcggtacaagtggcctaggctaggttctggcctgtcttggctttcaacatgcctttcccgctaagcttaatcacatctagcttttgacttaaagtgagagatatgcaacttttctttttacttgaacacttagaagctatcatagggttatcatgtggcataatttcaatatcattgtgtctcagggaacagggaggcctgaggagagagatgggggtgtggccagtccgtggatcagtcagaacacacacaacatttgtgggttaagtctgctatcttatataggtgtggtttgtagctcaccctcaaaattatgaagtaacatcaaagatcattgatcacagatgaccataacagatataataatgatgagaaagtttgaaatattgtgagaattaccaaaatgtggtacaaggacacaatgtgagcacatgcttttgggaaaatggtaccaatagacttgctgaatgtagagttgccacaaaccttcaatttgtaaaaaatgcaatatctagctgggtgcagtggctcatgcctataattccagcgctttgggaggcmaaatcaggaggatgactggagcctaggagattgaggttrcarttagctatgatcrtaccacctgtattacagcctagacaacagagcaaaacactgttccttaaaaaaaaaaaaaagctaatatctgcaaagcacaataaagcaaagcacaataaaatgagatatgcctgtatacacagagaattaaaataactgattgtatgcaagtttaaaaatacttagaaaaaaacaaaaaagaaaaaaacttagaaaaaggtggtgtgcttatcaaagaaggtttctgggggaactatgactggagtgatgctaagcttggcaagaacactgacaaatacagcattggtggcaaataattatgagccctagtttatgcatgacagtatatgtccttgacttttttttttttttttaagatggagtcttgctctgttgccaggctggagtgaggtggcacgatctcagctcactgcaacctctgcctcctgggttcaagcaattctcctgcctcagcctcctgagtagctgggactacaggtgcgtgccaccatgccyagctaatttttgtatttttagtagagatggggtgtcaccatgttggccaggatggtctcgatctcttgaccttgtgacccgcccgccttggcctcccaaacttctgggattacaggcatgagccaccatgcctggacatgtccttaactttttaaattaaccttgctatgtatccaaagcaggctaataaaaagtaataccgttttaaaatgccctttattatcctatagtattcactcttttttcccacccatatttgattctcaggtgtctactatgaaccatcctgtactcagaatgtgaatcatggtgtacttgtggttggctatggtgatcttaatgggaaagaatactggcttgtkaaaaacaggtaatatatttacactttatatttaattggaatcaggaatttgagggagtttcrgcaaatactctcatgattttgatgatgatcattatgatcacgatattgacaatgatgaactttatagcttcttacaaagtgacattctaaattactcagtgcccccatcttttcacttaccattctgccttcatcactttgttttcctggtttatcttctgtactacttctgtgattattccttctcagcctctctcatgaacctattcctctcctctatttagcccaaaaatgttagttttccccagggctctatcatctgcccattcctcttcttattttattttttcttgggtgctataattccactcttaggactctagctataacctttatatgccaatagcttttgaatctctagctctagttctgacatcttcccagaacttcagacttatctggacacactcacttacatatatcttagtctttccaaactcaatacatccaaataattcagtactctctcccccatactgttcctccttcagaatttcccatatcagtaaagggccacacaacacaatcacccaataagatatgatggattcatctgagacctccccaagtccaaccaagcaaccaattagtcaaaccaattttaccttatctatgtccttgattctgttccttctctgtttcttctattacggctctagttcaggcatctctagtgtggactattgctrtacccttctaactggtctcctttactctctattttcttcccctttaccctcaaatccatctttcatactgctgccaaacttatttgtctaaaatatgaacgagtctgggcttataactcttctactgagtttcattcggtgtaaaattaatgttccctgacagaagacaaatcctataggctgtgctccctgccttgccagcctcacctcctggcatttgttgcctcctattttcactctggttatactgcactatccacagttgtagttcccatacattccactttatctgtaataccttccttcatatcttggtttgtgttccctctgcctagaacatcctgtcttctcttttggtttacttctccttttcttcagaagtagctcaggcacaatctattccagaaaagtctttcctgaatccttgggctgaggaacatgtcttttttctatgctgccaaaatgtcctatgcatactggatcacaggattttaggcattatatttaaattgtatatttacctgtctgtcactccagtgttctgtacgtgcctttggggagagattatgtctggtcttcatatccgcagcacagactaagtgggtggcacctaaaggcccctcaatatatgtattgaactgacatctatatcactcataaacaaaaggaacataacttctagagggaaaaaatggaggaaatatgaagagttgagactttggggcatacctggagtttctctttgtgttagtttgctatggctaccatgacaaagtgccacgaactgagcagcttaaatgacagaaatttatgtctcccagttctggaggctggaagtctaagatcaaggtgttacttccttctcacgctgtgaggaagaaaatattcgtggacacaggaaaaaaaaactgtatgatcttacttatatgtgggatctaaaaaagtcaaacttacagaaacagacagtagaatgatagctgccagggactggaggctgggtaatgaggagatgctgatcaaagagtgtaaactttcaggtrtaagatgaacagattctgggaatcaaaggtacagcacgggtggagatggatgtgttatttcatttgattatgtcaatcattgcacaatgtgcacatacatcaagtcatcacactgtataccttgagtttatacaatctgtcaattaaatatgttcttttaattaaaaaaaaaagtttgatgcctctcccctagcttctgaaagtttgctggtgatctttgactttcctcagcctttaggacaatcaccctgacctctgccttcattttcacatgacattctccctgtatgcatttctgtctctattcataattttactttcttcccctttttgagacagggtctcactctgtcacccaggctggagtgcagtggggtgatcaatgttcaccgcaacctcaaactcctgggctcaagcaatcctcccacatcagccaccaaagtagctggcactactggcatgcaccaccacaccagaccaattttaatttctatttgtagagacaggatctctctatgtttcccaggctggtctcaaactcctgggatcaagtgatcctcctgctttggtctcccagagcactgggattacaggtgtgagccactgcgcctggccaattttcccttttcatgagcatcattcatgttggattaggacccaccctaatgacctcatcttaatttaattaattatgtctacatcaaccctatctctaaataagttcacattctgaggtactggaggttaggattccaacatgaattttgtggggacacaatgcaacccataacaccccttaaatctttacttgaagtacatagtctacaaatcaaacaaaaggtgctttcctacccttttcccactgtggcacacatagaagatgatgatattcgtatggcccatggggaaagtagctgaggggatcaatatcttggttcactgataacctattcacagcactgatcagcttgggtgtagaccagtgatagctttttaaaatgaaactatttccctcatatcttattgactctctaaggaactccctacggcaggtgttctaaattcccttctctactgaagttgctcttgaagatcatctatatcttttagtgttgaaattcaaatctgcttctcttcactcattcattcaacaagcacttactaggcatctacaatgtgactggcattatctaggccctggagatacaaaaaatagtaagaaaccatcctgtcctaaaggcactcacaatctaacatgaaaaaatatatataatatatattatatatacatacataatatacaatacatattatgtatgcatacataatatacaatacatattatgtatgcatacataatctataatatacataatatataatataatayataatatacatatataatatataatatattatgtatacataatatacatatataatatataatatattatgtatacataatatacatataatatataatatattatgtatacataatatacatataatatataatatattatgtatacataatatacatataatatataattattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatatataatatattatgtatacatacatataaatctctctatatataaatataaatatatttataaatatatatatatatatatatatctcccagcctcccaaagtgttgggattacaggcgtgagccaccaccgcacccagcctagatgtatttttaaacgatacaacaaacacatcgtggtataatgatacatgtctaaatggctatgggactgttgaagaggaaatgcctaacagcctaaacctccacagagaagacactatttgaatcaagtttccagatgtatggaattgttcatgtattggaggaggaaagtgtgttagaggttggaaagttgctctcaatgacccaaaaaacatatgcaatggcacatttctcactatcttgattcattttgctacatcaactttagcctcatatcttacgttattttatccacctgcctgttacatgagtttgctatatcaaagcaaactcatctatatcaaagcaaactcacctgctccttcagtttcaactattgccattatgtagatgatccccagttcataatctctgaaaatgacctcctaagtgacacacttccttgtccaacttccaatttggcagctctccttgaaaaatccaaactccccacctacatcaccctactaccaacatatacacactctcatactcaataagtttacaatgttcttctcttcctttcttccctcatccctgaaaaggattttcaaacaagctcaagggaaaactattccttattttgggtaatatattaccatcttcagattattaaagcctaagcatcatcttggccttttccttttcccccctcaacccacccagccctatccatttggcctgtgaatcatattttatatgtattttctctttgccattcccaatggccctgctgtaattcagattccattctacccagctatagcggtatctttttaaaatatagatcatgtcaactcctgctcaaaaattctgaatagttcaccattgtctaaaaatgaagtccaaactcctggccaggcattccaggtactccattatctagcttttaacataaccttagacatttcttccactatattttcatatacccacagtcatactctggccacagtgaactacttattcatcattccctaagtttacagatacatccctacctctgtttctttatatatgctgtatctttctgaaatgcctgtgaagtccaatgctgtctatagaaatcccacctgtcttggtgaaatgggcattcttatacagtttgatgggaaagtaagctgtatttattctttttttttttgagatggagtctcactctgtcaccaggctagagtgcagtggcatgatctcagctcaccgcaacctctgcctttaaggttcaagcaattcttctgcctcagcctcccgagtagatgggactacaggcatgtgccaccatgcccagccaatttttgtatttttagtagagatggagtttcaccatgttggatggagtttcaccatgttggccaggatgatctcgatctcttgacctcgtgatctgcccacctcggtctccccaagtgctgggattacaggcatgagccaccctaccctgcctattctctttcttggaagcaatttgacaatatgataaagaactttttaaatgttcatattcttcccccccccttttttttttgagacagagtctcgctctgtctcccaagctggagtgcagtggcacaatctcggctcactgcaacctccgtctcccaggttcaagtgattctcctgcctcagtctcccaagtagctgagattacaggtgcccaccaaaacacctggctaatttttgtatttttagtagagatggggtttcaccatgttggccaggctggtctaccaactcctgatcttgggtgatctgcctgtcttggcctcccaaagtgccaggattacaggcgcaagccactgcgcacagccagtgtcccattacttttatttcttggaatctatatgaagaaaataatcctaaatatgggaaaactttcatacacaacttatgtgaattgtagcattattatttaatagtaaaaactagtaagtagccaaaaatgcctaacaataggtatatgattaaataaactatgacataatcaactccatgcattagatttattcagactattattaataacctaataaaatacttgggatatatatttaaatgaaaaaagatacacataaatacaaaatttatatgtagtataaatattagctgaatgtggtaagctcatgcttataactctagagctttgggaggccaaggcaggaggatcacttgaggccaggagtttaagaccagaaacatagggagacccagtctctataaacaaatttaaaaaattagctgggcatggtggcatgtgcctgtaatatcaactactcaagaggctgaggtaggaggattttttgagctgaggagtttgaggctacagtgagccatgatcacaccactgccctctggcctaggtgacagagcaggaccctatgtcaaaaaaaaatttaagttaaacatagtatgtccaaccaggcttagtggctcatgcttgtaatcccagcactttgggaggctgaactgggaggatcgcttgagcccaggggttcaagaccagcatggggaacatagtgagaccccatctctatacaaaaataagccaggcatggtgacacacacttgtggtcccagctacttgggagactgaggtgggaatatcacttgagcccaggaagttgaggccgctgtgagtgagccatgatcacatcactcaactctagcttcagtgacagaatgagaccctatctcgaaaaaaaaaggaaggaggccgggcacagtggctcatgcctgtaatcccagcactttgggaggccaaggcaggtggatcactaggtcaggagatcaagaccatcctggctaacacggtgaaaccctgtctctactaaaaatacaaaaaaaattagccaggcgtggtggcgcatgcctgtagtcccagctactcgggaggctgaggcaggaggatggcatgaacctgggaggcggagcttgcagtgagccaagatcacaccactgcgctccacactccagccggggtgacagagcgagactctgtctcaaaaaaggaaggaaaaaaaagaaaggtattaattttaaaatgaaaaaaaagtcattacaaatcctattcattttttaaatcctgcctcaaatactatctccttcataccccattcacttagaattgtttctctaattcctaagctttggcaatgctttatgaattctattatagtattttacacatatcccttgtgttatagctatttgtgcaaaccatgccccattcactaaaatgtaaacttcttcaaggtaggatagtctcttgttcatttttgcatcttcatttggacactgattcaacaaacatgtattgagtacctaccatgtgccaagctaggaactagcgattggaaatgaaaaatgcagctcttctaccgtccctcaaggtactcatagtctaatggagtgaaggaaacaggcaggtgcatgtgtagtccattgcaactcaatgtgataaatgctaaaatcgaggtggcataggttgcactggaggcatagaagaacttcggcaggttatttaacttctttaattttagtttcatcagccttcttacaatggaagagagttagggccttgctctggattaggttttcgcttaagggcatgttgtggctagtttgctcttttatctaggccactcaaatcatatcagcaataaggctgtttcactttttttctttacttttttcttctttctttctttttgttgttgttgttgttgttgttgttgttgagacaggtctcactttgtcacccaggctggagtgcagtggcacaatctcagctcactgcaacctccgcctccctccaagtagctgagactacaggcatgtgccaccaggcacgggtaatttctgtatttttagcttgttgcccaggctggtcttgaactcctgagctcaagtcatctacccgcctgagcttcccaaagtgctggaattacaggcatgagccactgcacctggcctgttgttttgctttcattcatgtgttcactggagtagcattttaatttcctccaagagctttccctttgcattcacaacatggctaactggttcaagaagtctagctttcagcctaccttggctttcacaaagcataatcatttctagctttgatgtaaaatgagagatgtataactcttcctttcacttgaacacttagaagccactgtaaggttgttttttgtttttgttttttgagacagtctccctctgttgcccaggctggagtacagtggtgcaatcttggctcactgaaacctctgcctcccaggttctaagcaattctcctgcctcagcctccggagtaactgggattacaggcacgcaccaccacaccctgctaattttgtatttttagtacagacggggtttcgccatgttggccaggctggtctcgaactcttgtcctcaggtgatccacctgccttggcctcccaaagtgctaggattacaagcgtgagccaccgcacctggcccattgtaaggttattaattggcctaatttcaatatcattgtgtctcagggaaaagggaggccagaggagagagagagagatgggggaagtgtcagttagtggagcagtcagaacacacaccacttatcagttaagttcaccatcttatatgcacgtggctcatggcaccccaagacaattacaatagtaatattaaagatcactgatcccagcttgggcaacatagcaagactctgtctctacagatagtttttttttttaattaccctggcatgctggtgcatatttgtggtcccagctacttgggaggctgaggcaggagcgtgagacctggaggctgaggctgcagtgagctgcgattgtgccactgcacaacaacctggatgacagagtgagatcctatctcaaaaaaaaaaaaaaaatcactgatcacagatcaccataacagatttgctaataatgaaaacagttgaaatattatgagaaatgccaaaatgtgacacagggacacaaagtgagcacaggctgttggaaacattgtgccgatagacttgctccatgcagggttgccacaaaccttcaatttgtaaaatatgcaaaatttgcaatgcacaataaagcaaagcacaataaaacaagatttgcttgcacttctcaatacctctgctgttaccattagagttcaagccaccatccatctcctggtctattgcaataatctcataactggtagctgcttccctcttgtttgcttggaatcaatcctctacacagtaaccagaattatctttttaaagcataaagtagattatgttacccttctaccccaaaccctctaatggctttccttcccactcagaataaaacccatgacctgtaaagcatgacattatctggccttagcctgcctctccaactacctctccaactactctcccctctctcactcagctcccagcacattagccttttggctatttcttgacacatcatgcttatttctagccctttatccaggtctttgcctcacttgcatctttgcgcaaacatccactcagcgaagcttttcccgaccattccacctaaaattgagccctgtctcttaacactctgtatcccttatcctgctttatttttctttattgtactaatcatatatatcatcaagtatttcttcgtttatcatatgtttctcctctagaacctaggctttagaaagactttgtctctgtaatcctaatgcctagaagagtgtctggcacagcctaagaagcccaggacttcagtctattacaaaggaaactggcattgattttagaaggaataataagttagtagccttataatatgcaaggagaaggtagggtgatcaactttcccactttgctaagggctacgaggctttctgggacataggactttctttttaaaaacaggacagtcccaggcaaactgggactggtgatcaccctagaagaacgctatacatttttttaaaagtagacggactcagcccggctcagtggctcacgcctgtaatcccagcactttgggaggccgaggtgggaggatcacctgaggttgggagttcgagaccagcctggccaacatggagacactccatctctactaaaaatacaaaattatccgggcatgatggcgcacrcctgtaatcccagctactcaggaggctgaggcaggagaatcacttgaacctgggaggtggaggttgcagtgaggcgaggttgtgccattgcactccagcctgggcaacaagagtgaaactccgtctcaaaaaaaaaaaagtagatggactctacttgagtccaatctgatgtactcatacctggataataataaaaatagctaccttcacttagtaagcattggctatataccaaatattgtgtgagtactttaaatacattctctcatttaatttttaaagtactcttatgagataggcatttagttaacaaactcacctaaagttgaacagtttgagtgaaagagctatagaattaataaaaatatacaacttggtaagtaccgaaatgaacatttggagcagatcttgtataattctgaaggcaagactttgtcctcagatactttatttagcttaagattttttttttttatcagtttcattgtttaagggaagttagcaggactcagtcaaaaagaggtctgggatcttttgcaaaactgggggcaattgatcttggtcggtaaaactgagaaaagtaaattgtttagwtgttgaatggggtctgggattccttggtctcactgactgaattcatactgctagtaactagaccctcaattcaattttcatactagaactcaggtccaaattcagttcacctaaaatgatttattttacctattatttaatgcagtgaccatagtaggatataaattacatgagatcctagatgtactggtctgaatttcattccccatatgacttcactcacagagataactgtagggataggcatagataaaagttagagtgggctttggaataaaataatcctagatttgacctctggcttcacaatttactatctatgtgacttttggcaagctactttaccactctgcccttctgtttttttctttagtaaaagaagataatattcacctcacaggatgatgattaaattagataatttatgttaatctgtttggcagagtaagtgctaaataagtggtgtctattaatattaataatagcctggccggattcttgttattgcttttgcttatcaaactggatattaaaagagcattgctacagcctgggcaacatagtgagacctcttctttactaaaataaaaaattgggccaggcgcagtggctcacgcctgtaatcccagcactttgggaggctgaggcgggcagatcacaaggtcaggagatcgagaccatcctggctaacacggtaaaaccccatctctactaaaaaatacaaaaaaattagccaggcgtggtggtgggcgcctgtaattccagctactgaggaggctgaggcaggagaatggcgtgaacccgggaggcggagcttgcagtgagccgagattgtgccactacactccagcctgggccacagagcaagactccatcacaaaaaaaaaaaaaaaaaaattggccaagcatggtggtatgcacatgtggtcctagctacttgtaaggctgaggcaggaggattgcttgagcacaggaggtcgaagctgcagtgagctgtgattgcaccaccacactccaaccagggcaacacggtgagactctgtcaaaaacaaacaaacaaacaaaaaaacccactacagccagtggtttattagaggtgacgatggagtttgaattttattgtaaaggcatggagagccattgacaatttctaagcagtggagtggcaattaagtgaaaggaagtaaagaaaggagctcatgaaaatgtttgagaaggactgaccagagagagataagaaaatcagaacatagtagtgtcttgaagccaagagaccagtaaggtgggagtagacaagtgtgttaaatggtacagagagaaaaaaataggacctgcaaaatgtccaatgagggctgatacatagaatatttaaggcctcttaaagcacagtccttttaaatggtgtcatttgtcttccaacaataaaccagcatttcttaggttctccactgcatgcaaaaacacaaactttgagtccctgagccaaaatttctaacagcttccctttgcctttgtaattgaagtacatgttcctccacctgctgttctaagctgttcacaacatggccccaaaccagctttctatcctctttttccactattctactaaagatatccagttttcctttcaactaaatttcttactgctctccagacacactaggcattttctcaatttcacacttttatttgtatcctagagcacttaatgaattttgccttgtatgatatttatatacctaccactataaaatctcagaatgataaagagcttcagaaatcattcctcttacaaggattttctaagttttttcatcagtcttggtaaagtaagaaaaataagaatattttggtgactttttcattaatataaatttatttactcaaaagactatccttaaaatagagattatgtctttggattttttgcttttggtgttaaaatgtattttcttttacaacataatggtgacagtaagtagtatggtttttatttattttctttttttgagacagtctcactctgttgcccaggctggagtgcacaggcgcaatctcggcttactgcaacctctgccttgcctcccaggttcaagcgattctcctacctcagcctctcgagtagctgggactacaggctcatgctaccatgcccagctagtttttgtatttttagtagagacggggtttcaccatgttgatcaggctggtctcgaactcctgacctcaaatgatctgcccgtctctgcctcccaaagtgctgggattacaggcttgagccaccgtgcccgaccaatagtatgctttttaaaaaagataccaacagcggggtggtggctcacacctgtaatcccaactctttgggagcctgaggcgggtagatcacttgaggtcaggagttggagaccagcctgaccaacatggagaaaccccatctctactaaaaatacaaaattagccgtcgtggtggcacatgcctgcagtcctagctacttgggaggctgaggcaggagaatcacttgaacccaggagatggaggctgcggtgagctgagattgcaccattgcactccagtctgggcaacaagagcgaaacttcacctccaaaaaaaaaaaaaagatgtccatacatgctaattttaaaattgataactgtatatctatctgtaaaaactttttgaactcctctaagtccattaaatcaaaaagtgaaacactgatctactcgaaccctaatccgacccatgatttttctctgcaacatctctaacaagtagcctctgctgcagagtaggtaaggaatacaggtgcatgccaccatgcctggctaattaaaaaaaaattttttttgtagaatcagggacttgctattttgcccaggctgctctcaaactctggcctcaaacaatcctcccacttcagcctctcaaagcacttggattacaagtgtgagccaccatgcctggctcatttttcaatagctttaattatgagaaagtcagctccacttctagatcaaaaagctctttcagagctgcatttttgttgtttgctttagaattccctgccctatacctttttcatagtagtcactcaaaaatatttcttaattgacattctctagaggaatttaagtttgatagaaaatcattacacatgatactgttatcaaaaaatttagagataaaggcttataaaggatactaatactctttctttagagaaggcatatttgcaaagtaggaggattaaaggactgggatggatcttactatagttttccttaggtattaagtctattcatcaatatagcactaaagctttccaaaccattattttgagttacctgaaatccctggagaaattattaycttatttcattctaattttgttttacggcctttcatatgtaatcacttataggagaaaaacaatgagataaaaagttgataacatggtttgattgtacgcatttgtaattttgtattatttctttttctaaagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcackgtggctcacgcctgtaatcccagtacttgggaggccaaggcaggcatatcaacttgaggccaggagttaaagagcagcctggctaacatggtgaarccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtaatcccaacactttgggaggctgaagtaggaggatcgtcttgagcccaggagttcaagaccagcctggacaacatagtgagaccttgtctccacaaaaataaaaaagaaactatccaggagtggtggtgtgtgcctgtggtccctgctatgcagatgtctaagacaggaggatcacaagagcccaggaggttgagaatgcagtgagcttgtaattgcaccactgcactccagcctgggtgacagagcaagaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcactctgttgcccaggctggagtgcagtggcaccatctcagttcactgcaacttctgcctcccgagttcaagcgattctcctgcctcagcctcccgagtagctggaattataggcgtgcaccaccacgcccagctaatttttgtatttttagtaaagacagggttttgccacattagccaggctggtctcaaactcctgacctcaggtgatccacccaccccagcctcccaaagtgctaagattacaggcgtgagccactgagcccagcctacttttcagtttttaacataatttttgttttrtccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttctcttgctaatctctcttttgttatagagatctcagccctaaacctaggatggatagaaggaaacatatgttctcccctacattagtaaaaataaaaatggaattttttacccatacaaattcataaattccctgaattctatccaaggagactttgagagttgtggctctcaagtaaagaatgcctgaactgctctccctccccctccccctccccctccccctccctctccccacggtctccctctcatgcggagccgaagctggactgtactgctgccatctcggctcactgcaacctccctgcctgattctcctgcctcagcctgaccagtgcctgcgattgcagcctcgcgccaccacgcctgactggttttggtggagacggggtttcgctgtgttggccgggcgggtctccagcccctaaccacgagtgatccgccaacctcggcctcccaaggtgcggggattgcagacggagtctcgttcactcagtgctcaatggtgcccaggctggagtgcagtggcgtgatctcggctcactacaacctacacctcccagccgcctgccttggcctcccaaagtgctgagattgcagcctctgcccggctgccaccctgtctgggaagtgaggagtgtctctgcctggccgcccatcgtatgggatgtgaggagcccctctgcctggctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcccatactgggaagtgaggagcccctcagcccggccagcccccccgtccgggagggagatgtgggggtcagcccccccacccggccagccgccccatccgggagggaggtgggggggtcagccccccgcctggccagccgccccgtaccgggagggaggtgggggggtgagccctccgcccggccagccgccccgtctgggaggtgaggggcgcctctgcccggccgcccctactgggaagtgaggagcccctctgcccggccaccaccccgtctgggaggtgttcccaacagctcattgagaacgggccaggatgacaatggcggctttgtggaatagaaaggcgggaaaggtggggaaaagattgagaaatcggatagttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagtcctttgttcacttgtttatctgctgaccttccctccactattgtcccatgaccctgccaaatccccctctgtgagaaacacccaagaattatcaataaaaaaataaattaaaaaaaaaaaaaaaaagaatgcctgaactaagcaagtagaataatgaaatactttttaaaaacttcactgtatgcccaatataaagggaaattattaacaataagtaatttcaaacttatagagataaaaaattatctaaaaatataaatttaaaacaaaaacatttagaatttattctggaacaatttctagacagtagtatgcaagatgacttgaagaaaatttttttaaaagccaggtgcagtggctcacacctgtaatcccagcactgtgggaggctgaggtgggaggatcgcttgagccagaagttcaagaggctggtctcaaactcctgggcgcaagtgatcctcctgcctcttgttatgagcacataaaaagatctccatctctacaaaaaataaaaaagttagccaggtgtggtggtatgtgcctatagtcccagctaccaggggaaaggctgaggtgggaggatcacttgagcccaggagattgaggctgcagtgagccatgatagcgccattgcactccagcctgggtgaccttgtttcaaaataaataaattggcaaataataaaataaataaaattttaaaatgagacaacctaggccgggcgtggtggcttacgcctgtaatcccagcactttgggaggccgaggcaggcagatcacttgaggtcaggagttggagaccagcctggccaacacagtgaaaccccgcctctactaaaaatacaaaaattagctgggcatggtggtgggtgcctgtaatcccagctacttgagaggctgagacaggagaattgcttgaactcaggaggtggaggttgcagtgagccgagatcatgccattgcactccagcctgggcaacaagaacgaaactctgtctcaagaaaaaaaaagagacaatctaaaagatattctagtagtctatatgtgtggtgataaagccctaaactaaatacatcatttctgaaaacagcaaaaaaataaaaaataaagcaaatctgggagccatcacagagtaaaagttgacagaattttaaactgtataataaaagtaaagaaacggtgcttgctttggcagcacatatactcaaatttgaatgatacagagaagattagccaaaaaatttgaaaaattatattaaaaaaagaaacaagaagatttaaatattccagaactaggcatccatgagacaatgccattaaaacatataacataaatgtgacagatacttagtatttcctttctcttttcttttttcctttcttatctttttttttttttttttgagacagggtctcactctgtcactcaggctggagtgcagtgatgccatcactgctcactgcagccttgaactcctgaacttaagctattttctcacctcacacaccttccccacccctccagtagctgggactagaggtgcaagccaccatttctggcttatttgtgtgtgtgtgtgtgtgtgtgtgtgtgtgtgtgtgtagagatgggagtctcattatgttgcccaggctggtctccaactcttggcctcaagtgatcctcccactttggtctcccaaagtactgggattacaggcataagacttactatttctttgaatcaaattattattttttgactcttctcttctagatgagaatcttgatgatgcttcaagtatgcatactctaagttaccagaaagactataaatcagaacatgtaataaagggggccgggcgcggtggctcatgcctgtaatcccagcactttgggaggccaaggcaagccgatcacctgaggtcaggagttcgaggctagcctggccaacatggcaaaatgccacctttactaaaaatacaaaaattagcctggcgtggtggtggacgcctgtaaccccagttacttcagaggctgaggcaggagaattgcttgaacccaggaaggggaggttgcagtgagtcgagatcacgccactgcattccagtctgggtgacagagcaagactctgtctcaaaaaaaatgaaaaaaaatgaaaataggcctggcatagtagttcatgcctgaaacactttgggaggctaaggcaggagtattacttgaggccagtagttcaagatcagtctacacaacatagcaagaccctgactctacaaaaaaattaaaaagtagccgagagttgtggcacacacctgcggtcctagttgttacagaggctgaggagggaggattgcttgagccaggagtttgaggctgcagtgaggtatgattgcatcactgcactccagcctgggagactgaaagagaccttgcctctaaagaaaaaaaagtggctgggcacagtggctcatgcctgtaatcccagcattttgggagtccaaggtgggcaaatcacctgaggtcaggagttcaagaccagtctggccaacatggtgaaaccccatctctactaaaaatacaaaaattagttggatgtggtggtgcgtgcctgtgatcccagctactggggaggctgaggcaggagaatcccttgaacccaggaggtggaggttgcagtgagccaagattatgccactgcactccagcttgggcaaaagagtgagactccgtctcaaaaaacaacaacaacaacaacaacaaaaaaaaacacacaaaacagtgacttaattataattcaaaataattattagaccaagattttcactatttttaaccctaataacaaggttctagtcttcatttctctcctagttgaatgactttgggcaaatcttttcatatctagtggctgttttctcctttgtaatgaagatatgtcaaagtttatgagtacaggcttatcttgttttattgtgctttgctttattgtgctttgcagatattgcattttttttacaaattgcaggtttgtagcaacccagaatcaagtaagtctgtcagtgccgtttcccaacagcatatgcttacttcatgtctttgtgtcacattttggtaattcttgcaatattttaaactttttcattattattattatctactatggtgatctgtgatcagtgatctttgatgttactatgataattgtcataggatgtcaaaagccgcacccatgtaaaatggcaaatataatcaataaatgtgtgtgttctaactgctccatttactggctgtgtccccatctctctccctctccttgggcctccctattttctaagacacagcaatatttaaattaggtcaattcataaccctacaatgttgtctatgtgttcaagtgaaagaaagagttgcatgcctctcacttaaacgctgaaaatgattaagcttagtgaggaaggcatgccaaaagccaagataggctgaaaggcctcttgtgccaaatagttcaccaagttgtgaatgtaaagggaaagttcttggaggaaattacaagtgctactccagtgaaca

SEQ ID NO: 12403 - DNA, 23289 bp, Homo sapiens
caggctggagtgcaatggcacagtctcggctcactgcaacctccacctcccgggttcaagcaattctcctgcctcagcctcccaagtagctgagattacaaaccccgtctcttaaaaaaggaaaaaatcacatggcagagtagcattttaaaataaagtcacgaggctgggcgcggtggctcacgcctgtaatctcagcactttgggatgctgaggcaggcgaatcacccgaggtcaggagtctgagaccagcctgacctacgttgagaaaccccgtctctactgaaaatacaaaattacccgggcctggtggcgcatgcctgtaatcccagctgctcaggaggctgaggcaggagaatcgcttgaacccaggaggtggaggttgcggtgagccgagatcacgccattgcactccagcctggacaacaaaagcaaaactccgtcttaaaaaataaataaataaataacattaaactacgtcactcagcctgtgaacaatggctcacgcttataacccagcaatttgggaggccgcagcaggtggatcacttgaggtcacgagttcgagaccagcccggccaacatggtaaaaccgcatttctactaaaaatacaaaattagctgggtgtggtgatgggcgcctgtaatcccagctactcatgaggcaggagaatcgcttgaacccaggaggcggaagttgcagtgagctgaaattgtgtcactgcactccagcctgggtgacagagcaagactccgtccaaaaaaaaaaaaaaaaaaaaagggaccatgttctagtgtaggggtaagtggattgttttggccccaaccccaagaggatcaagggagaccactgcagctgcccgagaaattcttgccctctgacaagaaacaccctatccagtctggggaatttgccagtccaacccctccccttggctcaagattctgggaaatcctaaatagtgtttaccattggccttttatcagctccagtataaatgcatctggccagacttgctttacaactatgcataatggatagttgggccaggcttggtggctcatgcctagtgctttgggaggccgaggtgggaggatcacttcagcccaagagttggaggccagcctaggcaacatggtgagacaccatctctacaaaaaaaaattttattttctgttttttttttgagacggagtgtggcgctgtcacccaggctggagcaacagagccagactttgtctcaaataaataaataaataaataaaacctgcaaaaaaaattttttaaatgccatttttctttctttctttctttctttttttttttgaggcagagtcttgctgtgtcacccaggctggagtgcagtggcgtgatctcggctcactgcaagctctgcctcccgggttcacgccatcctcctgcctcagcctcctgagtagctgggactacaggcgcccgccaccatgcccggctaattttttgtatttttagtagagatggggtttcactgtgttagccaggatggtcttgatctcctgtcctcgtgatccgaccacctcggcctcccaaagtgctgggattacaagcgtaagccaccgcgccyggccatttttctttttaatcaatcctgccacttgaagattatatggtaagggaaatctgcagtctatacacaatactgagttgctccaagcccttgaggattgtgagggacccagtgttctaattcttgctagagtgtctacctccatgttaccagaggcgagtctgaccgggtactgacatgtgatataccattaagtgtgcagtgggttcttttagcctttcccaaatgtctttccacatggcagcgccccacagcattttctttttcttcttttttctttttcttttttttttttttcttttttttcctgggcaacagagtctcactctgttgcccgggctagagtgcagtggcgtgatctcggctcactgcaagctctgcctcctgggttcaagcgattccagtgcctcagcctcccaagtagctgggattacaggtgcacaccaccacgcccagctaatttttgtatttttagtagagatggggtttcaccctgttggccaggctggtctcaaactcttgacctcaggtgatccgcccgcctcggcctcccaaagtgctgggattacaggcgtgagccactacgcccgccctcttttttcttttttgagacagagtctcactctgttgcccaggctggagtacagaggtgccatcatagcttactgcagcctcaaccttcccagctcaagcgatcctcccgcttcagcctccctagtagctgggaatacagatgcacaccaccacacctggctaattttttgcaggttggtctcgaactcttgggctcaagagatctgcccgccacagtctcccaaagtgctgggattacaggcatgtgccaccgtgcccggcatattttcttttcagtgtttacctttttgcctcctctgaggtgctggagtgcagcaataagaaagtaataattttaggccgggcgccagtggctcacgcctgtaatcccagcactttgggaggccgaggagggcggatcacgaggtcaggagatcaagaccatcctggctaacacagtgaaaccctgtctctactaaaaatacaaaaaattagccaggcgtggtggtgggcgcctgtagtcccagttacttgggaggctgaggcaggagaatggcgtgaacccgggaggcagagcttgcagtgagctgagatcgaaccactgcactccagcctgggtgacagagcaaaccttcatctcaaaaaaaaaatatatatatatattatatatatatatttttttttttagaccgggtcttcctctgttgcccaggctggggtgcagtggtgtgatctcggctcactgtaacctctgcctcccaggctcacgccactctcctgcctcagcctccagactacaggtgcccgccaccacgcctggctaattttttgtatttttagtagagatggggtttcaccgtgttagccaggatggtcttgatctcctgacctggtgatccacccatcttggcctcccaaagtgctgggattacaggtgtgagccactgtgcctggccgctgagtagtattttgttgaatccactggcagcttaaaggacatttgggcttgagctatgtacagctgctaacacctgtgcactggtttgtgtgcaaacatgttattttttctttctaggacaaatacctgggagtatcaaaattattttttgatatttattattaaatgattttttctttttcttcatagtaatgatattgtgtcctatgtggatttccctccccctaaacctttttttttttttttttttttttttgagacagagtctctctctgtcacccgggctggagagcagtggtgcgatcttggctcactgcaacctcctcctcccaggttcaagcaatttacctgcctcagcctcccaagaagctgggattgcaggcgtccgccaccatgcttggctaattattttgtatttttagtagagatgggggtttcaccatgtttgccaggctggtttcgaactcctgaccttaagtgatccgcccaccacggcctcccaaagtgctaggattacaggcatgagccactatgccctgccccctccccccactttttttttttggtagagatggggtcttgctttgttgcccaggctggtctcaaagtcctggcttcaagcattcctcccatttgggcctcccacagtactgggattacaggcgtgaaccaccgtgcctggtcccatttgtgtttctattcagcagtttgtgtaaacttgaagtctgtgaatccatgtgtgacactcaggtcttaattattgtctaccaagtaagagaaagtgacaatatcctgccctgtgtgaagctggccagccagttaggaattatcatgtcccaaccagcctgggaaacttggcaagaccctgccttgataaaaagtttaaaaatcgactggacacagtgtctcatacctataatcccagcactttgggaggctgaggcaggaggattgcttgagcccaggaattggagaccagcctggacaacaaagtgagaccttttctgtacaaaaaattgctgggcatggtggctcatgcaggtaatctcagcactttgggaggccaaggcaggcggatcacctgaggtcaggaattcgaggccagcctggccaacacagtgaaaccccatctctagtaaaaatacaaaaattagtcgggcgtggtagtgggcgcctgtcatcccagctactcgggaggctgaggtaggagaattgcttgaaactgggaggtggaggttgcagtgagccaagattatgccactgcatgatcaccccagcctggatgacagagcgagacttcgtctcaaaaacaaaaaacaaacaacaacagcaacaaaaattagcaggctgggtgcagtggctcatgcttgtaatcccagcactttgggaggccaaggcaggcaaatcgcaaggtcaggagatcgagaccatcctggccaacatggtgaaaccctgtctccactaaaaataaaaaaaattagctgggcatggtggagggcgcctgtggtcccagctactcaggaggctgaggcaggagaatcacttgaaccagggaggcggaggttgcagtgagctgagatcacaccactgcactccagcctggggatagagtgagactccgtctcaaacaaacaaacaracaaatagcggtaagtggggcacatgcctatactcccagctactcaggaggctgaggcgggaagatagcttgagcccaggagtacaaggctgctgtgagctattatcacgccactgcagtccagctaggtaacagagtgagaccctatctctaaaataattaataaataaaacaaaataattagccaggtgtagtagccagtagctactttgggtcccagctactgtagtcccaggtactagggtggctaaggcaggagctaattccttgagctaaggaatttgaggctgcagtgagctatgattgtgccactgcactccttcctgggcgacagagcgagaccctatatcaataataattataataatacagtatattttacataatagaccatagagctcaatgaatcctcctcacaaccctatgtaggtagatgttatcatgatctctgctttccagaatagaaaagtgaggaccagagagggcgacctcttgtccaaaagcaatacagccaagaaggggcaaggagggttttgaaaccagtcggccaggctctggggctcctaacaagcaaagcagcctggtttctaaaactatagcttctggaagcagccaattcacaggtctttacctcctgactgtgagacctccaaaaaatgaccagggatcttggagtctgtttccccctttgtgaactggggacaatagaagctacttcccaggtctgcggggagaaattaggaacgaagaaggtaaagcgcagagctgaggagctggtctacaggtgctctatacatattagtaataattattaagtttgctgttacaatcctctctctctctgtgaacaacccctaatgatgcgtggctttgagagcaaaaaagtcagggcaaagttttgccacaaagtccagagggcaagacattaaatctaactctcaaggattggtgttggcaagaaagcaaacctctcctccccacgctgtccttaccccgcgtatccgacgagcctaaagtcataggtaagagatctgtagaagcgacgtcaaggtgtggttccctctgtaaggcggagctaaacggtgcattcgcccagcggggaagctagaactaaatgaccgctctgccgactggagccaacgagaatcggcgtaggcgcaatacgggcggaggatggggacccgcccccggggtgggcggggcgtcaggtacttaattcgcgcctggagggaccgaaggtgccgagggctccgcatcgcaaccawgscgctgcgctggggcatcgtgtctgtcggcctcatctccagcgacttcacagccgtgctgcagacgctgcctcgctctgagcaccaggtctgcccgccctccggattctggggaagaggaggcggggggcgggactccagartctaaaggaggagggagtttagggttcaggactagtgagtgggtcgtcattgcagtgaaacgtctgtttccttgctacctccttctccatctctgttctgcaaacctgtggggaaaagaaagatcagattgttactgtgtctacgtagaaaatgaagacataagaaactccattttgaactgtactaagaaaaattgtttctgctttgagatgctattaacctgtaactttagccccaaccstgtgctcacagaaacatgtcctgtattgaatcaaagtttaatggatttagggctttgcaggatgtgccttgttaacaatatgtttgcaggcagtatgcttggtaaaagtcatcgccattctccattctctattaaccaggggcacattgcactgcggaaagccgcagggacctctgcccaagaaagcctgggtattgtccagggtttccccccactgagaaagcctgagatatggcctcgtgggaaaggaagaccttacatcccctagcccgacaccagtaaagggtctgtgctgaggaggagtagtgaaagagggaggcctctctgcagttgagataagaggaaggcttctgtctcctgctctccctgggaatggactgtctcagtgtaaagcggaccattcccattccttctattctgagataggagaaaacctacctgtggctggaggcgagatatgctggcagtgatactgctctgttactctttgctacactgagatgtttgtgtaaagtgaaacataaatctagcctacgtgcayatccggtcacagcacctttccttgaacttattcatgatacagattccttttctacatagacacagtaacaatctgatctctctttcttttccccrcacaaacctgagtgtcttgaggtttggaaaggccttgatgtaagctactatgaagataatttcaatattgggggatttaataacggctttcccccagatctctctttcccagggcccaaatgtccagcccccgtcatctcttcccccaggaccacgtctccccttcccctggccagagcctcctcctttgcctcccttccacccagtttccacgcctgcctcagcccctcaaatccgattcttgtgcccctccaggtggtggcggtggcggcccgcgatctgagccgtgcgaaggagtttgcacagaaacacgacatccccaaggcctacggctcctatgaggagctggccaaggacccgarcgtgggtgagtggcgagggcgatgggggtgctggccgccgcccctggagcggtgccccctggctgccccstgggagatgcaaggctcctcaggatggtccaatccctttgggttccataaagacctttggctgggaggagaactataaaacgggcttggtctgggactggctgtctagtaggtgttaaactacacttagcgttcgagaccagcctcggcaacgtagcaagacccaatctctacaaaaaataacaataaaaataaattagccaggtatggtggcacgcacctgtaatcccagctactggggaggctgaggcaggagaatcacttgaatccgggaagcagaggttgaagtgagccaagatcgcgccactgcactccagcctgggcgacagagtgagacttggtcttagaaataaataaataggccgggcgcggtggctsacgcctgtaatcctagcactttgggaggccaaggcgggcagatcatgaggtccggagatggagaccatcctggctaatacggtgaaaccgcatctccactaaaaatacaaaaaattagccgggcatggtggcgggcgcctgtagtcccagctactcgggaggctgaggcaggagaatggcgtgaacctgggaggtggagcttgcagtgagccgagatcgcgccactgcactccagcctgggcgaagagtgagactccgcctccaaaaaaaaaattaattaattaattaaaaattttaaaaaagagagcgagaatggcgagaggtaacagccccttcctaaggacagctccctaagggagacaggggtgtgaccgaccacctggtccctgggtgctagggcggggcctcgaagttgtgggcggagctmggctgtctgggtgggcggggctgctgacctcttgacctactcccaccctagaggtggcctacattggcacccagcacccccagcacaaggcggcggtgatgctgtgcttggcggcgggcaaggcsrttctgtgcgagaagcccacgggcgtgaacgcrgcggaagttcgcgagatggtcgcggaggcccgatcccgagccctcttccttatggaggtgagggcagaggagcccttccaatatccagcgtaaaagtgcttgccattaaatatggttgccagtgcgcggacggggtcagtgcatttgccaggatgtatctgaatctccttggcagcatctattaccgtgaaagccattgcttttggcccttagcaaacacggcaaggcttactgaaattgcttggatcttttgtcagtctttaagaaaaagatgccggccgggcgcggtggctcatgcctgtaatcccagcactttgggaggccgaggcgggcggagcacggggtcaggagatcgagaccgtcctggctaacatggtgaaaccccatctcttctaaaaatacaaaaaattagctgggcgtggtggcgggcgcctgtagtcccagctacttgggaggctgaggcaggagaatggcgtgaacccgggaggcggagcttgcagtcagccaagattgcgccactgcactccagcctgggcaacacagtgagactccgtctcaaacaagaaaaaaaacaaaaaaaaaaaaaaacaagaaaaagatgccaagagtgaaagtggcatagaatggcaatggcttagtttgggtggggttccaggtagaggttgaaaggaccaaggaaccccctacaaacctgcagtgcagtggcgcgatctcggctcactgcaacctccacctcccaggttaaagcgattctcctgcctcagcctcccaagtagctgggactacaggcgcccgccaccatgcccagctaatttttgtatttttagtagagacggggtttcaccatgttggccaggctggtctcaaactcatgactgcaagtgatcctcctgccgcggcctcccaaagtgctgggattacaggcgtgagccaccgcgcccggcccctacctcaaggtctttcatgtaatcctatccgccaggaccccttagccttgtaaagtcacacattcacagactccggggatcatcaggtcgtggatatctttgggggcaccagtagcctactgccacaacacccaggctcagagcctgcgcagagcctgcccccggctccccagtgccctcaggcctgtgttcacgctcctctcgactgctccgagcccgggcggacctcggccacatccgtcctgccccgcccttcccccgtgagccctgacactcttgcgtcagcatttttagaaattgctggtgtgggccagatgcggtggctcacgcctgtaatcccagcactttgggaggccgaggcgggcagatcacctgaggtcaggagttcaagaccagcctggccaacatggcgaaactccgtctctactaaaaaagtacaaaaattggccgggcgcggtggctcacgcctgtaatcccagcacttcgagaggcagaggcgggcggatcacgacgtcaggagatcgagaccatcctgtctaacacagtgaaaccccgcctctactaaaaatacaaaaaattagccgggcgtggtggcgggcgcctgtagtcccagctactcgggaggctgaggcaggagaatggcgtgaacccgggaggcggaggttgcagtgagctaagatcccgacactgcactccagcctggacgacaagagcgagactgtctttaaaaaaaaaaaaaaaaaaaaaagaaattgctggagtgcagccttgggacctttgcccattctcccggctctcccgtgacattctttctctgggctctttgcctagtccacggagcttccgtctcccctggaatgtcacctcctcagggtgtcaccgtcccggctgtcctgcgtgaaggaccctccattttatttgtgtccttggtattcctttgttcatcccttggttgcctgttctctgtctctctagactgggtgctccaagaggtagaactctggtttttgttgtcattgttgttgtttttgagacagagtcttgctctgtcgccaggctggagtgcaatggcgtgatctcggctcactgcaacctccgctgcccggctttaagtgattctcctgcctcagcctcccgagtagctgagattacaggcatgcaccaccacgcccggctaatttttgtatttgtagtagagacggggttttgctatgttgtccaggctggtctggaacttctgacctcaggtgatccgcccgccttggcctcccaaagcgctggggttacaggcatgagccacagcgcccrgcccccagttccaggagtttttttttgttgttgtcattttgcatttttctacatagatgatgtcatctatgaacaaagagttttatttctaccttctgtatctatatgcctcctttaaggagtttcactaggagatgcacacgtaactcttaaacccactggcctgcatgctctatacctacatctaatctcttcttataaggacaccagtcatattgtcatattggataagggcccaccctaatgacctcatttttttttttttttttgagttggagtctcgctctgtcgcccaggctggagtgcaacggtgcgatcttcagctcactgcaacctccacctcccgggttcaagcaattctcctgcctcagcttcccgagtagctgggactacaggcgtgcgccatcacgcccagctaaaattttttgtatttttaatagagacggggtttcaccgtgttggccaggctggtctcttggctaggctggtctcgaactcctgacctcgtgatctgcccactgtggactcgcaaagtgctgggattacaggcgtgagccaccgtgcccagccttgaccttattttaacataattatctctctgaaaaccctgtggccacaacagttgctttcagaggtactagggagttaaggcttcaacacgtgaattgtgtttggcagggcagaagcgagagggagagagacacaattcatcccataacatggggagactggggcaatggtccagatgaaaaagaacaaaagtcaatagggcacggtggctcatgcctgtaatctcagcactttgggaggctgaggtgggaggactgcttgagcccaggagttcgagaccagcctgggcgacatagtgagaccctatctctattcaaaaaaaaaagaaaaagaagaaaagtcaagagggtcaggagcaagagggatacaacctggggactgatgggctgtgtttggagactgggttgcagtgggtatccccctatgattgggaccccagaagggattagaactggttggttaactcctttccttgtggtctgcaggccatctggacccgcttctttcctgcctcygaggctctgaggtctgttttggcccagggaactctaggasacctccgggtggctcgggcagaatttgggaagaatctcatccacgttccccgggccgtagaccgggcccaggctgggggggccctgctggacatcggcatctactgtgtccagttcacctccatggtctttggagggcagaagccagagaagatttcygtcgtgggaaggcgtcatgaaacaggtaccatctatcctggaatatttcatggtgatgggaatgattctgtctctctgggagcactgaactgaggacaagtctccaagtcaatgagaattagatcagacacctagaggaacaactttccatgaagccagagaggatcagagtcaagactgcaggtgggcactctcctgggactttgctgtgtgatcttagccagcagacttaacatctctgaatcttaattactttactggtaaagtgtcactaatagggttgtcatgggagttaatgaagtaactgctgaggcaaatggcagttaataaatataaaattattattttttgaagttgtctcagtgaatctttgctacaaaaaagactaccccacttggccaggcgtggtggctcacgcctgtaattccagcactttgggaggccgaggtggccagatcacctgaggtcaggagttggagaccaccctggccaatatgatgaaaccccatctctactaaaaatacaaaaattagctaggcattgcggcaggcacctgtaatcccagctatctgggaggctgaggcaggagaatcacttgaacccagggggcggaggttgcagtgagctgagatggcgtcactgtactctagcctgggcgacagagtgagactccatctcaaaaaaaaaaaaagctgccccactttgcagaagaggcccttgccttrgcttccactcagctggaaagtatccaagagtgcctgagccacccagatgtgatgcccttcatctttgacctttaaccccaaggagcaagaggcagttcatgcttcattaaagttacattcagccgcaaaaaaaaaaaaacataacactaccccaaaacttagtgacttcaggctgggcatggtggctcacgcctgtaatcccagcactttgggaggctgaggtgcgcggatcacttgaggccaggagttcaagaccaccctggccaacatggtaaaaccctgtctctacgaaaagtgcaaaaaaaattagttgggcgtggtggtgtgcacctatagtccggctactctggaaggtgaggtgggaggatcaattgagcctgggaggcagaggtggcagtgaactgagatggtgccactgcattccagcctggggaacagagccagaccctgtctcctttttgtggagaacagagtctcgctatattgcccaggcaggtctcgaactcctgggctcaagctatcctcccgcctctgcctccccgagagctgggattacaggtgtggccaccgcccccggcaagccagaccctgtctcaaaaaaaaaaaaaaacttagtgacttcaaatagcaatcatttattagcttgtgattctgtgcattggcaaattggggctgggctctgcttgatggttcttctgctggtcttattcctgcagctgcagtcagttggctgttcagctgggactggacagtctggtaggcttcatttatatcttacaggtggcaggcaactgtctgggaagccttgattctcctccacctggcctctccagctggctagataccattcatatcgtggtgtgagaattcctgatgtgcaagcacttttcaggcctctaattacaccatatttgctactggcccattggccaaagcaagttacatggccagctcagttttcagagatgggcaaatagactgtaatttttgtttttttttagatagtatctcactttgccacccagggtagaatatagtggtgtgatcttggcacactgcagcgtcaacctcctaaattcaagcgattctcctccgtaagacccccaagtagctgggcatacagatgtgggccaccacgcctggctatgtttgtttgttttttgtagagatggagtttccccatgttgcccaggctggtctcgacctcctgggctcaagcaatacacacatttggcctcccaaagtgctggggattacaggcatgaaccaccggctttttttttttttttttgagacggggtctcactctgtcacttaggctgagtgcagtggcacaatcattgctcactgcaaccttgacctcccaggctccagggatcctccacctcagcctcctgagtagctaggatcacaggcacaagccaccacacccaactaaattttttattttttgtagagacaaggtctcactatgttgcccaggctggtcttgaactcctggactcaagggatcctcctgcctccacctcccaaagtgctgagattataggtgtgagtcactgtgcacagccaagactgtacttcgtggtgtgtgtgtgtgtgtgtgtgtgtgtgtgtgtgtgtgtgatggagtctcgctctgtcgcccaggctggagtgcagtggtgccatctcggctcacttcaagctccgcctcccacgttcacgccattctcctgcctcagcctcccgagtagctgggacgacaggactacaccacgcctggctaattttttgtatctttagtagagacagggtttcaccgtgttagccaggatggtcttgatctcatgaccccacgatctgcccacctyagcctcccaaagtgctgggattacaggcgtgagccaccgcgaccagccagcacttcattcttttgccttgccatgcaagaagtgaagtctcttgcccaaggttccacaggcaggatttggggcctgtgcagtctcagagactctgccctgagagaccctgccctgayccaggacttccctccaggtgtggatgacactgtcacggtgctcctgcagtacccaggggaggtccatggcagcttcacctgcagcatcaccgtgyagctctccaacacggcctccgtgagcggcaccaagggcatggyacaggtgaggcatggygggcccaagcgctggggatcgtgcccctaaaataggagggggacaaatggcctctggagctagatgagagcttaaccagccaatttcacatcattgctaaagagttcctccttaaccaagccaagaggtgggttctgggcctctaggctctccttacttaggatgaacctattgctctgtcaaatattcttgggcctggctggcacggtggctcacgtctgtaatcccagcactttgggaggccaaggcaggcagatcacctgaggtcaggagttccagaccagcctggacaacatggtgaaacgccatctctactaaaaatacaaaaattagctgggtgtggtggtgggcgcctgtaatcccagctactagggaggctgaggcaggagaattgcttgaatccggaagatggaggttgcagtgagttgagattacgccattacattccagcctgggtgataagagcaaaactccatctcaaaaaaaaaaaatatatatatatatatgtatccttgggcctggccggcacggtggtcacacctataatcccagcactttggaggctgaagctggtggatcacttgagccctggaggtcgaggctgcagtgagctgtgattgtgccactggactccagcctgagtgacagagtgagatcctgtctcaaatatctatctttagtcctgaggagaagccagttattatcaaccatgcttagtgggcagttgtgaatttcggaagtgcatccgggggaggatctgggtgttaccaaaggtcagcttaactggtcttcctggggccttgttgctagaaaaaaaaaaaaccctattttatagccaggcatggtgacttacacctgtaatcccagcgtgattgggaggccaaggcaggcagatcacttgagctcaggaattcaagactggcctggccaacatggtgaaaccccgtctctactaaaaaaaacatacaggctgggcgcggtggctcacacctgtaatcccagcactttggcagcccagagcgggtggatcacctgaagtcaggtatttgtgaccagcctgaccaacatgatgaaaccctgtctctactaaaaatgcaaaaattagccaagtgtggtggtgcatgcctgtaatcccagctactcaggaggctgaggcaggagaattgcctgaacccgagaggcggaggttgcagtgacccgagatcgagccattgcactccaggctgggcaacaagagcgaaactccgtctcacaaaaaaaaaaaaaaaaattagtcaggcatggtagtgggcacctgtaatcccagctactcgggaggctgaggcagaaaaatcacttgaacccaggaggtggaggttgcagtgaaccgagattgatccactgcactccagcctgggcgacagagcgagactccatctcaaaaaaaagaaagaaagaaagaaagaaaataaataagaagaaaacatggttcacagacacacaaagataagccctcctctctagaccttaagaacaccttgtttctaagctcctaaggttagggagaggtttgctcctggggagacagacaggatttttgtgtcacatcagcgttgctaaggaacaaacttctagcaactagaaatgaaggagggtccaaagctccccggggatggacagggcaagctcttagccaccaggttcaagagggaggcccctgtgcaccacctggcatgttcctggaggcagcctcagcagcaccgttrgtgaaggcagcagtgccacttcttctctccctccagctcctcaacccctgctggtgcccgaccgagctggtggtgaagggggagcataaggagttcccgctgcccccagtcccaaaggactgcrattttgacaacrgggcaggcatgagttatgaggccaagcacgtctgggagtgcctacgcaagggtaaggatatggatgcggggcaggcgccaggcctggtagggggatgttgggcccctccccacctgctctgtcaccctgctgtttagaactacatctcccaggaggttgcagtgagccgagattgcaccactgcactccagcctgggcaacggaacaagactctcactccaaaaaaagaactatatctctcaggaacccctgcagcatccatctgcctgaaccatgtatattgtgccacatggaattctgggaattgtagttctttgggtcttgggcgcgtgggtaggaggggtccctaactacactctccccacaggtatgaaggaaagtcctgtgattcycctgtcggaaagtgagctcctggctgacatccttgaagaggtgaggaaggccattggagtcaccttcccccaagacaaacgctgatgtatccccgaataaataaagacatcttacatcttcgtggtagtggtttggcagaagctggagaacccagtatcaaagggtcactagaaaagaatttgggcagggctgggcatggcagctcatgcctgtaatcccagcactttgggaggccgaggagggtggatcacctgaggtcaggagtttgagaccagcctgaccaacatggtgaaaccccatctctactaaaaatacaaaattagccgggcataatgacgcatgcctgtaatcccagctacttgggaggctgaggcgggagaatcacttgaacctgggaggcggaggttgcggtgagccgagatcgtgccattgcactccagcctgggcaacaagagcgaaactctatctcaaagaaaaaaaaaagaaagaaaaaaaaaataattcgggcagaatgatgagggaaggccgggcatggtggctcacacctgtaatctcagcacttcgagaggccaaggtgggagacttgcttgaggccaggatttcgagaccagcctgggtaacatgacaggaccttgtctctacaaaaaataaaaatattatccaggcatggtggcccgcacctgtagtcccacctacttgggaggctgaagtgggaggactgcttgagtccaggaggttgaaactgccgtgagtcatgattgcaccactgcacttcagcctgggtgacagagacagacccagtctcaaaaaaaaaagaatgattttggagagggaggaatgtgcagggtcaggaccacattcccagaagctcctggcacagacacctgtgggaagatccaccgtttgcctgtcacggcctctctggggtttgaccctcattgccttggagtgacttttgcaaaacaacttgatttctcacctcaaaaatcagtctttttctggactcctgaaagccacccagcttttgttcttgttgctcttcctgcctgtaattgtctctccttgaattcaatatagtagtcaggctgttcctttggacagtgtcagaaacacaactcagaatgtctccacaaggccaggcatgggggtcacagcactttgggaggctgagacaggaggaccacgtgaggccaggagtttgagaccaggctgggcaacatagtgagaccccgtctcttaaaaaaaaaaaaaaaaaaaaagcctgcacaggaatggaatgcttggtaattaaagccttcagggcagggcaggcatcagcccaggactctgtttttctctatctctttgactttccttggcatgggttttaatggcagcagtgggccatctggtacagccggggccatcatgctggctgctgccgggagggcacagaaaagagatggacagaccctcacccctgcagtccgctgcccggggggctgcccccacagagctgggccgggttttgtgccaggtgagggggagctccaggccgtctctgagtgccagggtcacaggaggagctcacagccatgttgcttcggcccccgatgccagcccagtcctagtaaggacccagagctcccacccctggctgcacatgggtacagtcaggtgccatgcttcatggagctggcaggagctggggacacacgggagccctgccccttccaagatcaggagggtgagagctccccaggagcaactgcagctgcccaggccgtggctgcaatccagacacccccgtgctattgggagctgggagtagacaggagccacacccagttgtgtctatggatgtggatgtgggcctcctgctctacagagcaggcaggagccccgccccccaaggcacagctgcagcccccaaaccggggctgtagacccaggcattcctgcactcctgagaggcctggaaaggcctcccttgtccttgtaggctcagaggtgcctgctaccactgcctggcctctccccactccctctcttgctctgatctcagagtggggttggggctgagcccaggtgctgacattgtccaccaggtgtgcacatgctcagggtagtgctaacatgtgcgagcactctgccaccttggcctcctccagacattgggtgccgaggagcacaagaggggaacctgagggggtgctaagggtggctgggtgctggcgtgaaggtgccccttggtgccagcagcctgggcaccatggatggccatgggaggcagacaggctcctgggcagaagggggcaggtccccagtgaagccccaccttcaggccaggcaggtttgaagcctgggggccagggtgccagtcctgtggactgaagggggaactcatggtgctttttcctgggcccacccatcctgccatggaccaataagcatgcacttcccctctgtgaggcccataaaagccccaggctcagccagagccagcagaggacagagagacaacaggatgaccagctacagagcggagctaccctctccagggctcctctctactgagagctgagcacttggtgggacaacctgcctacagagaagaactacccactgcgggtctcccctgagctgttgtaatactcaataaagctcctgtttgtctttttcacccttccgttgtctgcatacctcattcttcctggacacaggacaagaactagggcaaaggcaccaccagccacagaggtttctggccagaaaagcaacaccccaaagatcctgtaacagtttcaccagttaagtgtaggcctgggcactggagccagatggtgcctgtgacctcaggaaactaatagcgtgtgggtaggaagtgtccctaaatacactctcccccagcctctgtttgtctcttcatcagtaaaggggtactactaactttcctctgctgaggaataaatgagatggtgactgatggggccgggcgcggtggctcacgcctgtaatcccagcactttgggaggccgaggcaggcagatcatgaggtcaggagatcgagaccatcctggctaacacggtgaaaccccgtctctactaaaaatacaaaaatattagctgggtatagtggcgggcgcctatagtctcagctactcggaaggctgaggcaggagaatggcatgaacctgggagtcggagtttgctgtgagccaagatcacgccactgcactccagcctgggtgacacagtgagactccatctcaaaaaaaaaaaaaaaatgagaaggtgactgatatgtagtttggatctgagtccctgcccaaatcccatcttgaaatttaatttccagttttggaggcagggcctggtacaaggtgattggctcatgggggtggctttctcgtgaatggtttagcaccatcaccttggtatcaccctcacgacagtgagttctctcgagatctggtcatttgaaaatgtgtagtgttgggaatagacccccaaaatctggccataaactggccccaaaactggccataaacaaaatctctgcagcactgtgacatgtttgtgatggccatgacgcccatgccggaaggctgtgggtttactggaatgagggcaaggaatccctggccgacccagggtggaaaactgcttcaaggcgttcttaaaccacaaaaaatagcatgactgatctgtgccttcaggacatgttcctgctgcagataactagccagagcccatccctttatttcggcccatccctttgtttcccataaggaatactttcagttaatctataatctgtagaaacaatgcttatcactggcttactgtcaaaaaatctctgttcgaggctctcagctctgaaggctgtgagacccctgatttcccactccacacctctatatttctgtgtgtgtgtctttaattcctctagcgccactgggttagggtctccccaaccgagctggtcttggcagtgtagcaccttccccactctctcctgctccttctcccgccttgtgagatgcttgttcccccttcaccttctgccatgactggaagcttcctgaggcctccccagaagcagaagcctgtgttacacttgctgtacacagtctgcagaaccatgagccaattaaacctcatttttttttttttttttgagatgaagtctcactctgtggcccagggtggagtgcagtggcacgatctcacctcaccgcaacctctgcttcccaggttcaagtgattcttttgcttagcctcccaagtagctaggattacaggtgtgcaccactgcacacggctaatttttttttgtcttgaactcctgacgttaggtaacctgcctgccttggcaaatccaaagtactaggattacaggtgtgagccactgtgcccagcaaacctcttttgtttataaattacccagcctctgtcaggtgcagtggctcatgcctgtaatttgagcattttgggaagctgaggtgggcagatcacttgaggtcaagagttcaagaccaacctggccaacatggtgaaatcccgtctctactaaaaatacaaaaattaggccgggcacagtggctcacacctgtaatcccagcacttcgggaggccaaggcgggcagaccacctgagatcaggagttctagccagcttggccaacatggtgaaaccccatctctactaaaaatacaaaaatcacctgggcatggtggtgcatgcctgtaatcccagctactcgggaggctgagacagcagagatctcttgaacctgggaggcggaggttgcagtgagccaagattgcaccactccactccagcctgggtgaaagaaaaaagaaattaatgggtggcttagctgggtggttccagctcagggtctccctgaaaattgcagtcatgacatcagtcaggactatcttcacctgaaagcttgactggggctgaagaatccctttccaaaatgattaactcacctggccagaggacttggtttcctgccacccgtgtttcgccagagtatgactgcttgagtgtcctcactgtcacacgtgtccgtgcaaagagaccacctaacagactttgtgtgagcaacaaggctgtttatttcacctgggtgcaggtgggctgagtctgaaaagggagtcagcaaagggtggtgggattatcattagttcttataggtttgggataggtgtacaaattacattctcaagagtggggagaatattgcaaagtaccttcttaagtggggtggaggggagaatatatcatatcagttagagtggggcaggaacaaatcaccatggtggaatgtcatcagttaaggctattttcacttcttttgtggatcttcagttgcttccggccatctggatgtgtacgtgcaggtcacaggggatatgacggcttagcttgggctcagaggcctgacactcaccacatggcagctggctttccttaaaggaagtgatctgaaagggaacaaggtggaagctgtagtggcttttctgacctgtcctgtgaaatcacactctgtcatttccacaatatcctcttggtcacactgtttagccctattgagtgtgggcagagaccacacagcagcatgaatacctggaggtgtgactcctcaggtgccatcttggatgtgggcttaatagttttgattcagcatctttattattataaagagtttggctgggtgcggtggctcacgcctgtaatcccagcactttgggaggccaaggcgggcggatcatgagggcaagagatcgagaccatcctggccaacatggcaaaagcctatctctaataaaaatatcaaaattagcagggcgttgtcacacgcctatagtcccagctactcaggaggctgaggcaggagaatcacttgaacccggaggcggaggttgcagtgaactgagatcacaccactgcactccagcctggcgacagagcaagactccgtctcaaaaaacaaaacaaagcaaaacaaaacaaaacacacaaaaaagagttttagtcaggcacagtgacgcatgcctgtagtcccagcactgtgggaaactgaggcaggtggctcacttgagcccaggggtttgagaccagcctgggc

SEQ ID NO: 12404 - DNA, 30559 bp, Homo sapiens
cctcagctctcttctttccaggggaaggaggtgctcaggggtgggtatccagagagccatacttctgagggaagactggctggcaataaagtcaaattaagtgaccacaactctgcaggagctgtgttgggtccttccgtcctcactgggtggctctggcaaaacccactctgctgtctttgccccaactcccagtgccttcccccaagtccacgtgctttttcaggccctcctttggggagaagagtgggtctaaagggccccctcacagggaagttttggtatgctgtcactcaccacctatcccgttttccaccaacatgcttgctatttgttcatcagataagaaatgtgagagatttctttgaacctaactgaacctgtgacttgagaatttcaggcattttgaatcctgcataaaagtggccttattcctgttaagattcttctgctcccttaccccactctcatcctggcagatacatttgcttaacaactccatccatcccagactagtctagaagctctcctaaatagggaggtaggaaggacctcattcagaccttccctgggtctgagttgagctcgcaacctctccgtcatctccctgatgccagttgctctgggcctctggcgtctaccccatagggatgctggattattagccgagatcgtggagccttgacttctgcttgtgattagtattactgtcctgcctgtgtccctgcctatagatttccatgtcttaggccttctctttggagtcttgtcctgggttaatgcccacccccaactccctggcaaaggcccttaagtttatgttcttgctctttccctagaccaatgatcagcctcccaggcctaatgtgtccctgcccaagtctctagtattccctccaaatcagatcttgtggatgttacttatgcagttgccatggggcagggggttagggggaagcgaggactggggagagaattagaaaacacccaattgacaggacaggtgtacgcagtgggtgaattgcaggaagtggtgaaggctgtgatgtatggctgggagcctaggtgacattttggagctctgggctttgatctgctactcgcctctggcctgtgaccctgtgttcagcaaacttccattgagccacagcctctttctccaagaagtgcacactggaagagagaagcaggcagagaggcagcttggagctcctacagagacacagttaggcaagcgacttggtgccacagagacagggtgggttgggggccctggggagtttcagaagaggtgtctgaagggtggggagagggccgcatggcaggaggcatgcctaacattgctgtgggtctcttcttcctctttgtttttgagggggaggatgctgatctccaaagtatcttccaaaaaaggaacaagaagtatgtgcaggggtcagtggaatgcattcaactgggcaaccaatgagaccaaggataccttccttttaggaaagtagaacacatgggctggcacaggaccacccaggaggagagtcttgagagcggcgtggggcagggctggaagccaagagtaggggtctccctaggtatttgtgcaggagatggagccccttggggcttgggaaggaggtagtaaggttgggaaaccagccccaagagctcctagtgctggtaaactggtcccctctactttctgagggcctgaacccttgtccctctggaaggcagtcccttcttgaggctggttctctgggcttcccttaggccctgagcagtcttgcttccaaaaaaggccagcagcccccaatccctttgattccttttatatctttcctaggaggcaccactgcagggatggggactgactggaaaggccaccttgagtccatcttgcacataaagaggcagctcatttctcatgttattgcaggattgaattcatagaaagtaaacaaaaggatgaataaataaaggaatgaatgtatgataggcccagggatttccctggaagttggcaaagttccttcttcttacagccgatctctgagcagagaagggttgaggcctcaaaagaggccgagcttctggaagaggaaggatgagatcttaaagaaagttgaatataaactcagagaggcacaagccgctacctctgcaatatgccaggaacttggcaagcactggggaggcagaagagacacctctgccttcaaggaatgttttgtggagtgtgtaaagatacaataacaaggtaggaaaagggctggggtgaaggtgagggcgtggtgggaaaagtcacggaatgtgtcctgaagggaacagatcaacagaaatttgacctgtggccagcagtgagtctggaaaggagaaaagggcattctatcgagacagaagctaagtgctaagacactggtatgtgaaagagcacagtagttctaaggcctgcaaagtcatgcacactgcgataaagggataagtgagaaaccaggctggaaaagtaagcagggcctttctgaagcaggaattcaaagacaaacaggacaatatccacacccttgtggggctaagtgtttcattgggatagaagataggcacacaaaaagttaaatgacaatatatgagaaaccgcacttctttacggatctggtaataagactgctgcttacaggcatgtggtcaacagagtccctggatgacaatcttttcttttcttttttaactcagatataacttaatatatgcctgattaacaacatccctattatcgattattaaagccaccctttctattctagaatatgggatagttatgtggtgcttaattggtacaagcaatgttaacacatcaaatgtggtcactactaaaagcccatgtgttccacctttcagggttcatttgatatcaagtaattctctgcttatctatagacaatgagaaactttgctgattaggaacacctgtgcttaacgatgccaagcagacatctctgaggtcacaccatcttctttgtgcagggctatggagcagctcaggtcctttcttcccaaggcctgctgaaatattaggtatacaccaggaagacagaaccaataagatagatagatacagatatagaaatatgagatgggatttattaggggaattggcttacatgatggtggaggccaagtcctacaacatgcacaaagaaggccctgggatggcaaaagtgtggctcagtccaactccaaaagcctcacaaccagggaggccaatggtataactcacagtcccaagtctggagagcctggagttttgatgttcaaaggcaagaggaggagaataccccagctctgagagacagagagagagacagagagagaaaagaagaagaaggagaaggaggaggaggaggaggaggaggaggaaaagcagcagcagaggaggaggaggagaaggaggaggaggaggaaagaggaaagaagaaagcaggagaaggagaagaaggaggaagaagaggaggaggaggaggagggggagagagagaatattttctgatatccttgtcagcaatttgaaaatatgggggctgcctgatacttaggttaggtggaatcctcgttggttgaataagctttcccagagagtaatgactatgaatcaaggacaacctagaggaaagtcttttgttttgaacctcagggactattttttaaatcagctttcactcctggcacagtgagggaacaagttatagggctaggttccttttcttaacaaaaaatctccaatatacatataaatcagacaaaaaatggcaataacaataaaactcacaaaataagtttccagaaaaaaaaggccatatcataaacttttaaaaattgaaaaccattttaaatgtcatttaacagaaagttattttaatgtctaaatgagattagtttatcctcaagaaaccactggagacagcagtttagatcaaaggtgtggccaattctaacagcggggagggagatccttcccaatgattggtaaagatccaaagactaaaaaacacttggctcggccgggggcagtggctcacacctgtaatcccagcattttgggaggccgaggtgggtggatcatgaggtcaggagttcaagaccagcctggtcaagatggtgaaaccccatctctactaaaaatacaaaaattagccaggcatggtggtggccgcctgtaatcacagctgcttgggaggctgaagcaggagaatcgcttgaacccgggaggtggaggttgcagtgagccgagattgcaccactgcactccagcctgggcgatagagtgagactctgtcaaaacaaaaaaacaaacaaacaaaaaacccgcttcactcttttaccatttcttctagccttgcttccatgctgcattcattaacatgtttccattatagtcttatcaatagatcagggtattatgttgaaatgcattgttgaaaagctgctactttgggactatttgcaggagggatggtgggagagactggcccactgctcctgcctcttcccttccatctcagtcacccaaaagcactaaaacctttacacctggaagaactgtccagcaggcagagcttactaaggatggaatgggtacaacagtagtgctgagcttcctggcccaggatgtaatgagataggggcttggatgactacatggagaaatgatgtgccagggattctggggccaagtagtgcttaggcccatcccggaggttctctcatgatgctgcagcagtgattctgtgagtctgatgcctggtgcactcagtttgagtcttagtacttcggattgggatgagatcagcacgttgctttcatggaaggcttccaagggagccaactgaatgggaaggacctggacaggcaatgttgcttaagccgacccagcatccctacagcatcaccaggctgaggaggtggaatctctgaggggcaagatatgcaagatatctttgtgtctgagggcgaagcctccaagggagtaggtttgatgaagtttgggttgggtctcaatccagctctgccataacctagttgggaaagcttgggccaagttacttcatctccctgagcctcagttttctcattagtcaaagggagctctacttacttcgcagggtttctgtgaaggttacacaagagttataaagcatctagtccagggtctggcaccctgcatgggtccagtaagtgatcttgtatttcattcctccctttcaatctcccgtgtcaggatatctgtcgtttctcccctctgggcctgtttctctgggtcgttggtgccagagctgccttgggagctgacttggcaaccccacgctcagagcacagccttcctcagctgcacacggtgggaggcgcctgggcaagatttgggagctcgccartgcagacaggtatttccagtcctgctagagaagcaatgggtggaggtagaaatggggatgggggaggagatcggatgagcccsggacctgggtggatcccctgggaggagggcggsgagtcatgctccccgcctggttctcctacccccaggctcagatttcaaccctcgctgccgcctctgtggcgcgcccgttcggggagcggagagggtcgcccgtaggttccgaaagaaggacggcgtaccagtagcctggcaaggggccagctcccgcagccctggagcgcgagccggaccctgctgcccctcttgctggcggcgggaagcggcccaccggcctttccacgcttggctgtgcagaggtccacgagggggcgacctgagcccacgtgcagccgagctcttccctcctgaaactacaactcccaggccgctcaggggtcccgcccgcctcgccgtgcctctggcggctccaattggccgccgcgggagggggattggcggtctccagggcgacgggaggcgctcggggcatccgaggckgggaggcgggtccgccccctattgtgtagcggcgagagtggagccgagcggtgcggagcaggtgagggagggggcgtactggaggtatagaagtggtggtgctggtagtgcggagttatgggggacaggagaaagcggggagttctagagagaagtggaattcgttgcaggagtagaactaggggagttctggggagtgaagtggaattcttggcgggtgggtgggagttcccggagaactgcaggagttctggaggcaatgtgggggagttcttggtgggttctaagagaaaggaggagttccaggggaccagagaatgcgagggagaaaggaattgttgggggtggggtatcagaattgtattgtgggctgatgcaggagaatcccagggaggggaattatcgggaggagaggatggggagaagtggctggggggtggggagaccagaagggagttctttatagtgcaggagacctgctgcaattggagatcaggtgcgagaagctggaattgtggggggattgtgcgtagtagcgataactgggaagggagtaatgggaggacgagggagtggtgtgtggggagactagaagggtgaggaaatagtggaggccgggggagttggaaagatattaagagactgggaggaattctagggatgcctagttactcagagtctcggaaaacaaccaggagagaactagggggttcctatatacttggaaaaaggtttttcagggaagtgtgggagagctgcctggaggcagtgggaaacagggggcttggttgctagtgaattgccagaagttagacatacaggatcattaagtagaggcaaggatcagactctgtggaggatgttttatagtctgtcctgaactttgcggccaagagtgggttggaggactcagagcagagtccacttggcagtgccaggccctggcatggaccctctggctctctgagactgccctaggatctgtggggctgtcagaagctcctaccctccatgccccagggttaattttgtacacttcagggactcacaggcttttttttggaccatgcctctggggttggggaagaaagagcttgacaaaccctggcaccccgaagatattggaggggagtgagtgggagggatttgggtgaggtccttgggtggtggtgcctggcagggggagggctgcttggcagtatcgtgaggaagtggcgccagctgccagccccgggacctgtccagacctggaggatgctgcctggatcccccatactggcaggtgggggaggcagctcctcctctcccaagtgcctgactcactcactgccaaagcagtgtagggagactgaatggagaaaggcctcgggtcctcagcttccagagtttttcatagaggctggggaaatgggacaagggattgtatcggggtgtcctggggaccactttctgaggcttaagcgccctggatttgcccttgactggctctctgcccctgagcagatatcctcagggcccttatttgtcacagaggggtgaaggcgacagcactggttccatcttgctgctataccttgtgagcatcaagagtaaggaaagaagcgagagcagsctaggccatgagagtcttgatctaccatacttccttcaaaaatatttttccaagcatatgaggaaccccagttctcttctggcttagtttttcaagaccctcagaatgcaggcatccccagaatccttccacatttcctaagaccttcccaactctcccagcctcccccatttcctcacctttctagtatctgcattcagcactcaccattctcccagtactcctacccctgctcttactccccagggcttcaagatcccccccttccccctacccctcacttaactacactcctccctcctttctcttcccagtgcctttctctaatggwggggtttcttctgggctccagtattggccaactctgcatgttgccttgtacttttcatttagatctggtggttctccggagagcagcttcctygggtgttacatgagccaagccctcactgtacagaagagtgagagctgaaacctgttccctgagctgatcagaaggacatcccttggcccctccatctgggctccygtggataggaggggctgggtgagcaggccagctgggctatggtgtggtgcctcggcctggccgtcctcagcctggtcatcagccagggggctgacggtaagctgagctcttgggctcaagaatgccctgttagccttggggtgggtatgggggtgttcctcaagggttcctctttgagcatgtgagggcaggggaggaatagggctggttctggagaagctgaactgggrgtttctccagtcacccaaagtcctaaggtgcctacagagatactgatggcactccccctcccagcactgaccctagccccccgttgtgccctcatgccacccatcatgcaggtcgagggaagcctgaggtggtatcggtggtgggccgggctgrggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggtaagagttctcctcaggtgggaggtagggaggtatcagcaagaaaggtgggctgggtagagtcgcacaaggcctcctatgaacggctttgtccctgctctgatctcatctccagctctgctgccttaactctgcttaataagcatggctgtgctcccaagcagtgttaattcattgaaagattcattcatttacacacacacacacacacacacacactcacactcttatagctgtgctatttaggactccacgtggtctgttccaaaggagatcctgcagccctattccaaatatccattctaattctgtaactgctttttctacatctcatcatgaaacctcccagacttcatcctgatctgtagtctcccctcttggccctgccttggtcctggctctactayctgctcactcctctgcsctctcccccttcctcatcgtcttaaatgctagttcaggggttcaagtcttctagggagtgggctgatggggcagcagggtaggtgcggctgtgacctctctgcttttccagggacactcagyctgcttctgagtagagaagcacaggtgtacagagagggtggctggggagggcccaggatccccaaaggtcagtgactggatggggctggcctgggttgctgctttaggtggcacctrttgggacttaaaatcgtgtgtagcctccctgggcgccttctgctgcaccccagctggctccctagaatggctacaatggctctgcttcctcctaatcccggatggagccttaatctaagcggtttagtgccaggtctcagagggcagtctgcaggaggccctaaggacaggtctgggctatggggcgagagagagtcttgttgcctcctcttcagaggggagacccaggaaaggccacctgggaggatgttgatggggagacccccaccttttccctctttagtttgaatcctgagggaaaccccgggattggctgagccttgccacagggcgggctgagcagagaggggaggaggtgcaggcaggtgatgcagaagggaagtttcttttcaaactgggggcagttattggcaaacagcctggkgggagtgtatgtgtctacacaagccctgtgggaatggatgaaagcgggccccaattagcaccagtggagaaaaaaacggctgtgcccaccagccctccctccctgcctccgcctgcccaggcctgggaggggtctcgggctgccgggctgaggctggacagattcataatgttgcctgactgagggcaaggcaaggggaggtggaagagggaggggcttttcctgggactccaccagggagacttgaagctcttccttctctccagcttgtgtcctgccttgaggtccctcaggcctgaagccactggatggttagcaactttgtctacctgtgggtcttctgtctgtgctgttgcttgagctacaggggctgtgagcagtagcctctgggacttactgtctgctcctatcctttgttcacacccctacctccgtctggagctcttggtcaggccagagccggctgagggagttgggacctgagggaggcccctgagcccattaacccttttactgcctcacagtgtggaaggggcctctcagcctttgtgtaggggactcggaactgcagttgctaagcaacaggaggtagaggttgctaaggacaatgctcttctgtcataagccctctgggcagtgaaggggagatgggtcggggactgttgtggggctggtggcctagaatgtgtgcggaaccctgagagagactgttggattagggaccacacagaagggaaggcttcccatctttgaggactctagaagcatctagtagaggagactggatttatcaacgatgccatggagtgaaagcaatataaaacaagctaggactaaagaggaggattcagttagctgctgtgtgtaaagcgccccagcctgtgcctgcacagtgcctgtgtggtgtgaacccatgaccaggcctctggagggaaggaaggttaggcttagtggacaccagctttcctaaggtgggtcttagaccaactcattaaaatggcaggatgggcttttgtgctgtatttcttgggattttcaagatgccccacacagcagaagggatgtgcatttttttctctgccctgagttgtttgataaaaatcagtgacctcgttctccacttagaactcccctgcttgctctagtcacctcccctcaccaccttttattcttaatcctctgcccagtcacagcttcccagaagccttccttactcctcttgcttcatagtgcaatgtctgggcgcagttagcaccattttttgaacttctttgtggatgtgtggacgtgaacttgcccatttaggtgactgtgggttccctgccttcygagagcttaagagagcagagactgtgtctcctgttttcttcacacgccgctgcatatgggaagatctgaagtcaacaggctttagccctgcaggtggagggaggcctccaggaggtgggcccaggactcaggaggactcagggctgccctgctggcgatcttcctgttctgtaacactacaggtctagcagtccagctgtcacagaaaagctaggacatgcagtatgcttctttggatattctgagtaacatttggactgttacccattggctaccagcatctcccaagtgagaatacatagattacccccagtgccctgaacagcactcggtcctaacacccgtgtccatggaaagcacgccgcgtctggagaaagaagcctggctttgtcacttactagccatgtgattttggaaagaaacttaacattaattccttcagctacaatggaattcttgggaggattaaatatggtgacaacgcctaatattagatggcctgtattccacactcaatcttccttccctcttcttccttctttgtagagctataatgaaaagtatcatgtgggacacagaagaggttgcagtctggggtctgcagggcttagcggccaggcagattagctttcttgaggaatcctgacagtgggtggaagggtatgatgatgttaaatatttacccgctgggcctagtcttatctccggggtggggatttcaacacctagccctttaagcaggtccacccatcctagagaatccacaccctggaactcattctaagtagaaaaagactcttggctaagatcacaaagcctgcctcaacttgatccttctcttctttctgaaatagattttcttatttctgaaacagatcactctagaggtagaatggaagcaaactggaggggctgagcactttcacagcttcagaatttctagcattaggaagagctggagtggacactatgcaaagggacttggagctgcatttgcaaacaacataagattaagaaaatgcagccaggcacagtgactcacagcttaatcccagcgctttgggaggctgaggcaggaggatcccttgaggccaygagtttgaaaccagcctgggcaacatagcaagacccctctcttcaaaaattaaacaattagccaggcatggtgacacgtgcttgtactactagctacttgagaggctgaggcaagaggatcgattgaggccaggagttcgaggctgcagtgagctacaatcaaaccactgtactccacctgggcaacagagtgagaccctgtctctaaaaaaaaagaaagctccatttgttcatagcagaggtcaaggtggggatgagcaatgtgatgtagaggggaggaggctggaggcagggagactggcaagtaggctgttggagaaacccaggtgagacatrccacaggtgtaaaggtgaggacagcagagaaggggaaatgtttaggaggtaggatttgaaaaacctaatgagcaagtagatatgggaggtaatcgaggaatctaggagatgccaggttcctgataaggtgacttggtgtgtggtggtgcaggaagagaaaaggaaggtgacgtgtgatcagtttagggacagggtcaggacttgagtgcagctttctgatttcaaatctagagctcatttatttgttcaacaacttttatttgagcatccactgatgccaggcaccatgctacatgccttccctacattatttctctcctccaccccaccccaattttgtttctttctcttctttttacagatgaggaaactgaaattgagagaggttaagtaacttgcccaaaagagtacacagtcgagctggactcatgcctaggtctatctggctcccaagtgtgtgcttgtatcacgaggctacactgccagggacccatgaagctgtctggggtgcayagttgcatccagggagggtgctgagggcttgggtaggcaccctcggtctgagcctggcagtgtggtgtggatgctgactaagagtgggattgaggtgtctggttgtgctgtggttgtgtggctttgtggaagtgtatgtgatcagccagctgggactggagtgccccggggcatggagaggatagggcgaggaggctgctgactttgctgcttgctgggctggactctggccaccctaaggcgcttaggctgctgataatagccctgagggattaggggctttggcaggcggggtctgggttccccctgctagggcctcaaacactgctgaggttttcagggaaacartcctctatcaggagtactcccaggagctcacaccttcccctacataaagagcccagaggtggacagatcctgtaagagtccagaggagactacatgctggctcttcacttccttccccaacagtcctagacaccgagtgcagttcaggggaaggttttgtccacctgctgtccccctaggtttctctttgtctagacagggtcccagctgtcgaatggcaagagtggtcagaggggccgaatggagggacctgtcctgaatgaccccaacctcatctgcgtctctctggaccccacactcagagtaactgggagagactgagcctgttcttacctctaagaattaccagtgtgaccaggggactggggcttccatggggttccttcagcacccttgattcagggctcctcccccaggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattgtatgaagctggggggcaggtggtggagaaggacrgggaggaggaggatggggatctctggctggtgggagaaaggggaagagggagttctatttccatcccacaaacrgctcygatgccccacccttcctgagagcccttgtttgctcacttagtagttgcatctcacccctcccccacactcctgcccttttcagttcttcaaatataaattcaatcagccttctaggctcggtgtcaggaactccctctttctcttccctcctgcttccctggccagggaagtgggtgggagagaggggctcttgggccctgagtgaaacacagctcacatatatatagcaccttgtgttttcaaaataccttttcacccaagcccttattatttatctctcactcctaagtaggaaggaggtcataatcattcccattgcataggtgaggctgagtcatgccactgattagtggcagagcagagtctaggacccaggcctcctcactcccagaacagtgctcctcctgagggggcttggctctcccccaggctctggacatccaacctgggttcagccccaggccagtgtgtgggggtgggttgacagaatcctcatttggcctgggtgcagyagacagggtggccctgggctgaggactcctatgaggcagggctggtgggtgggcagcaggctggagccctgagtggtctccctggcccttggacactgctttttgggctgacagccccactggggcccctgatgcctgtctcccttgcagcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgagtcctgggggtggacagagtgagccatatagagtgtgaagggaaggtgggggcctggcagtggggccagaggacagaggaggcaaaggccaggctggaggatgggccagaagaagggcttggcattgtttgccccgagcctggggtgctgcctccctctgctggccaaactcggaagtgcaggatctgaggctggcaggggaaaggactcttcctcacccactccttccctaggtgcagaacgggacgctgcggatccgccgggtagagcgaggcagctctggggtctacacctgccaagcctccagcactgagggcagcgccacccacgccacccagctgctagtgctaggtgctctctggcgggagggctgsggtccagggytacctatgcaagggggctgtgacctgtggctgaattggttcacagcaagataggagggagatttgtgcctgagggcagggcccgtggaagctaagggggttcccaatgcaggctrttgctctgaaaccagcaccttaattttaaaaggctcagtaagcagacaaagcgatcttagtgcccagtagtgtgttatagtggaaaggacatgggtgcttgtgttaggctgtgagccagttaactccttgagtcccagtttcttcatctttataaagagactcatctctacctctcaggtgtgttacaagaatttacttaggtgcagctgagcccagtcactggcacatggtaattcctggccaagatccttcctttagaagggaaactgagaagcagaaggcctggactgtgccttcatagagcctattatctttgtggggaagtgagactaattggggaaacagggaagtgttgctgtccgtggtactgtaagaaaggcagtgccgggtaatggttaaaggtgtcgtctgtggcatcaggaagcctaatatgaatgttgcctctcctgctgtccttgggcaatcacctcacaatctctctgcctctgagccttcacttcttcatctagaaaatggagacaattcccaccacaaagcttttggtgaggattaaacgaggtcgtgcaggtaaagtgcttagcactcagtgtcccgcatgcagtcagtgctctgttgtgtcagctcgcatcatgacctcttcttactgactgctcatgcggtaccggcccagagaggggaaggagtagtggaactgtagtagccagaggtgcttttgcaggaggtatgtggcgcggccaggcccttgggaggggcattccagaccgggggtgcagggagcaaaggcatggagatgggggacagccagctgcccatactgacctgaaagagttcatgagggctgacatatggaaagatggctggccacgtagggagggtttggatcgcaggggtccacagggctgggtttgagcttagtgtagtaggagccaggtgctgttgcaggttcctgagcagaagtgttctgtggctcaaggggctgtttctgtatgaatggccattagagtggcagctgcaggggagcctggagtcaggggctgctgcagcatcttgaggtgaggtattgggcacctgggttagggccagagacagagaagtaattcaagaggtgacaagcagggatacaaatggtaaatgagcagagttaaactgackcccccaaacacacacaccattcctaggcagtggaactgcatgaatggagttgctcttgatggaacagagagaatttggaaagaagaatgggtctcagggagaggatgaattcttgttacatacagggggaagcttctgcttccactccccaaagccctgtaacaacgagccctaagattccagagagcagagctgggaagagttgtagaggtgacctcagggttctgggaagactgtgggctgaggccaccttcctccccttgtgcatcccacaggacccccagtcatcgtggtgccccccaagaacagcacagtcaatgcctcccaggatgyttcattggcctgccaygctgaggcataccctgctaacctcacctacagctggttccaggacaacatcaatgtcttccacattaggtggggtcaccctcattaggaaggtggaggtggggaattcacaaacagtctctgaagagccgcttggctgggcaaggcctggacccctcctcacacatgccacattgcagccgcctgcagccccgggtgcggatcctggtggacgggagcctgcggctgctggccacccagcctgatgatgccggctgctacacctgtgtrcccagcaatggcctcctgcatccaccctcagcctctgcctacctcactgtgctctgtaagcctgaccycagcttctccctcagcctgctcccttcccctgggccaggccaagcccctctcccccaacttgccactactttcccccagacccagcccaggtgacagctatgcctcctgagacacccctgcccataggcatgccgggggtgatccgctgcccggttcgtgccaaccccccactgctctttgtcagctggaccaaggatggaaaggccctgcagctggacaaggtacaggcttggggcaggggaaggagggtcttagcttggcgttattctgctcaggacagcagggtggagttagctcggtttaattcagttcagtgactggggacacacatcttttgtgaatttaatttgtgttataagacatgttgcataggaaactacttaaaacccctgaggaaaaatttccatggtttaaagtggtggttttgtgtcttctttggggaaagaagagagatgatctctggggaaaatgatggcaaagagtcaagaaggagaactgaagtttctttcgtgtgatgactgggaaattgtgtgtcccgggggaacacacacttcttaccaggtgctrtgtggggtagtgggttgagggcaggggcaaggaggcatccatccttaaagtgggcaccatctgggcagaggacagcaacactgtctggaaggccagggatggagctcgtgccttcctcttagggtggttgaggatagaccagcaacagattctgggactttggtgatgggcctcaaagaggacacagtcattcccttgcagaaaccagggtcaagaggcaggaagtagtatagtacgtttatggaatcatggatcgtccaattgggtgggagccggagtgcctgcagggacatgaatggtgcagagaaagctggaaagacaggttagcatcaaaaggaagaactggatgccaagttactattgcctcattccaaggcaattgggatcttttgtctgcagagactataaatttttgaggcctagtattgcatcttttcatcatagtgtacctggggcttctacaacaatagtactcagtatatctttgttgaatatttaagaaaaaagtctacaggcagttggagccactggaatttgttgagcattggtgtgataggatcagagctgtgatcaggggttgagcttgcccagtggaatgtagcgggagatactggacataggaagaggggttctgaagctgctgaaatggcccaggtgagagttatggagtctgatttacagaggacatgaagatgaatgggctcatgctctgacaaaagggacttcccaggatgactggcttagtgagtatttcaccagggggagtgagggaacgtgaggaggcagacttcagcaagaaggatggcgggccctttaatagagaaataggagctggttttgggtggaasactctgaacttagttgtggagtgctgggaagagagccaggtgaagtcccagcaggcaggaagccccacgcggcccaactacaggggtggccattcacagtgtattttctgtgagtggcaccccctggagttgtgcagtcacagcctcacactattgggaggggtccctctgcaggaaggaaaggaagcactggaaatcagagaggggtcaggcctagacatggagctgctggagtcttctgcacagctgtgggtttctcrtcctgccccctctcttgtactgccatcccgggcttgtctctgctgagctcctctctctagctgtcatcttctcttccttccagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggttaggccgggggtgggcgggggcctgtggtgacagtgggtcagatggctggagatggtgctaaggccaggctgatgggggtggggtggggcagacacatggggaggggtttccaagtttgtttcccatggtggccacggcagcagctgcctgatgccatcccagaggtttctgcagaggtggtgctcgggaggtgggacatcagtcacacacatccagaagtaagatatcctgtttgccccaactctcactaaccttgaccgtgctgcctccctctctggggctctgggaggaagaatgttctgcagaggtttgtacatctctgagagtcctgcctaagcctgccagcccttactacaccaccattttcctccagcccctacccactggggaacagaaacagagccagagaggaattgagagatggagagagaatgaggtagagacaggcttggtgagtgtttagctagggggagtgagggagagtgaggtgagacatggcatgacagggagcacagagagagggagtagccagccttagatgtaagagagggcccctcccaatgccagatctggcttgcaggctcccccagcttttatagagcggcccaaggaagaatatttccaagaagtagggcgggagctgctcatcccctgctccgcccaaggggaccctcctcctgttgtctcttggaccaaggtaaggctcctgagcccgctctgcctgtacccacgcccactacacccctgcctctcgtgccccagccattttgtgggagggagggtgtgggaaggagaaggctgtcagaggcagggtggggaggaactggagctgcctggagagatgaggggcgcctttggtgaggggtggctgcgtgtgtcctcagggctcaccagtggttctgtaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggttagtggctggagagagggccaggggctgggagaaactacttgggaatcgtttttggaggcccagaaagaggatcatgggtgtgggacccctgggatgatgatgggtgaaggtcagtggccctggggcccctgctactctgtacactccctcaggccctgaccaccatccctccattcccccctgcctaggcactagccctcatgttgtcaccaatgtgtccgtggtggctttgcccaagggtgccaatgtctcctgggagcctggctttgatggtggttatctgcagagattcagtgtctggtacaccccactgtgagtgacctgctcctgccatttctctgtgccaatcttgcctcctttcctctcctccttgaacctatctggccttctgccctttcttctgtccctctatccctcaccagtcctggctctgcttccctgtttccagattctgaggcattcagggccaaggtcctgagaccttggatggttgagcagaggggaggtggttagatctctggaccccagatcttctggtcttcctagctcacgaggtgccccccatgtcctcatgtctcccagggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaaggtgagaagcttctcgtcccagaacagcagagacaaggatggggaagggctgctgggagagctgggatatgggaggccctgggtgggaaggggcagaggtgctggccagcttggggtccagaggggtgtgtggaagatgatttgagcttgtcttcaggggttctgggagaagagttgggcactgggagttgtggaaggccaggggaggggcgctgggaatccttgctctgacctgcctttctgtcccacgcagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggtatgtgcgaaaggcgatacagagagaggcctcctaggggctctcctgcgtccttctccattccccaaactctatcttctcatcttgatttgagctcttcacctctgcgtcctacctcacccttccgtcccacgtgcacggtctttccgcgccccgctgggttgggcggtgctgggccctgacctccctcctggtaccccatccccatcgcaggatgttctctacgagttccgcctcgtggccttcgcgggcagcttcgtcagcgaccccagcaacacggccaacgtctccacttccggtgagcacctggcgtgagggaggagccccagggctgctccgagtccactgaccctccctcgtggacccctgcctaggtctggaggtctacccttcgcgcacgcagctgccgggcctcctgcctcagcccgtgctggccggcgtggtgggcggagtctgctttytgggagtggccgtccttgtgagcatcctggccggctgcctcctgaaccsgcgcagggctgcccgccgccgccgcaagcgcctccgccaaggtaagtccctccaccctcagccctgctactgcgcacttgggcctagcctccttaagcccctcctacctgggggaaaagccctcgctcctgtgtgatccaggtgcattctcttagtcctgcatctggtcctgcctacgcttttcccagccggatggggttgggcgcctggtgttgggtgagagagtctccgcctagagggccttgatttttgcctgtgtcacctactattctyatgcccttccagatccacctcttatcttctctccgaccgggaagtcagctgcaccgtaagtgcctccacctccttggctttcttctgcctttccattgtacgtgccagtatcttctgcttccttttttgcatctttaccagggggatgttgggtgttggggaggaacaaaagtgggagagggtaagaaggggtgtgcagtggccccagcctgaggccgttccagtatggcctgtgccttccctccacccctccaccttgttggtcctttcctcgcttgttcttcctagctctgctctgttgttcaccaaacctctcaaggcctgacgctggctcctgggagggggacctgcccctaccacagaccctgatctcctgtccttccccagctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtkatggggcccactgtggcggccccccaggaaaggtcaggccgggagcaggcagaacctcggactccagcccagcgtctggcccggtcctttgactgtagcagcagcagccccagtggggcaccycagcccctctgcattgaagacatcagccctgtggcaccccctccagcagccccacycagtcccttgccaggtcctggacccctgctccagtacctgagcctgcccttcttccgagagatgaatgtggatggggactggcccccgcttgaggagcccagccctgytgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagbgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggtgagagcagtccctgcccatccctgcctccgcctcagtcccaccccagacctctcacccctctcccaataccctgcaccttctctgctccactcccaccctgggaacgggaaaacttgtcccttttagaagcttttgctgaggtccagggatttttcaggggaaacccatgacctaacgtgagtttgcggtcgctgaattcagacttttctgaacagcctctattcctccacccacaccatatgtttgtctttttttttttttacaggaggaacacatctgtggacgagaactatgagtgggactcagaattccctggggacatggaattgctggagactttgcacctgggcttggccagctcccggctcagacctgaagctgagmcagagctaggtgtgtgagccccccggaaaggcaggcatctcggccatactgtcccacatccccccgccaccttaggacccatctattcccagtcaggccctgcctcccaggctcctctgctctagactgtgccttgcccccttgggccatctgtactggaagggcctagcragcttcacatctgagctcttcactcagtgaacctcagggcttcttctcattgtcctgccyrcctcttgcaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacrtccctratgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctstgtgtgtgtgtgtgtgtgtgaagttttttacaggtgaataaacaaagtttgaaagatgtttctgtgtgttatctgtctttgagagagtgccaggaaaatccctggacccttaaagaagaggagaatcttcttgaataaatggaggtgcattcagcattcattcaagaaacatttattgagtgcttacggaggccagctactaaaggccagccactgaagtagatactgagaaaatacaaagctctggaagcacgcctttgcccttgaggagttctttctagtcagtgaggcggacaaagaaatagttaccgtatgataagttccgtgataaagctatgtgttggttattgtagcacaaaggaagatgttgcattcaaggccacctttagtgaacgctaatatcgtgtgctgggacaaatgccacatattgggggggagtcctcaggaccctcacagatagatggtggtaataatagtattcactatgtgccaggcactgctctaagccctataggtggactgtttagttctctacaattctatgaattaggtagtactattagctctgttctatagaccagggaactcaagcacagaatgcacaacagtcacacagcaggtaaagggtagagcaggtggggagccagtcaaggaagggaaactgtcctaggcagaggaatagcctttgtaaaggcacagaagagtgagaatgcttgacaatcagtgggactggaatatagggctgtgtaggactcggggagggaacagagaataatagaaaggttggacaggactggatattgacatcctggaatctcaggttcaagggaggactctatcatgtgtgcagaactccaccccgggggactctattcaactgaagcctgaaaggatggggggctctttcttcacccctgaactgtgctgtcctccaccctcagagacaaaagaaccccagccagcctcctcgcgctgaggtctccccctctgatccctccaggatttaggaagagataccaggtcatagaaaaggagatgaaaggcagggagaagacaggtctgagccctgggtcccaacaccgaaaacacccctagggccctgggcagagtgacctcactgttagtccctgcccaggcttgaagtaagaggtgagcaagatcacgtgggggtgctgtcccggcctgcaagtcccagtcctgtcacacactagtcagttggggtcgggggaaggccttcctgtgcctccttttaccttgccagcctctaaactaggaggcttcttcctacataaacacgcccacagtgtttagctaactttctaggcagaaagtttcctactggggcacaagtctacgggctctcggtggaggctgaggtactcacgggtggagaccactgcagccgcctttgtagattcagactccccgaacctttaacccttgctctggtctactgtccctctgtctcaagcagtcctccctccttctgcgctgcggcgcctttaaaccttcttggcccttgccccgccccgggtccgccccgtctgaggcgggaccctcctgaaaatccccggctgggcagggcgcaccacttgcagctgcagcccttgccttgagtcagtgcgccgctctccagcccgcttgaacggtgagcaggtcgggggtacgggggtcggggacatgtgcgtgctgtgtagaaagcaagaagccagcgctttgaacttgctccagcgagctcggggatcaagggctggtaccaggcaagggtccggtgactactttaccccgccccgtgctgtcaggtcctgtccccaagccctgacccgacattgttggacgatgaggtcaggcgaggttagcccatgcatagacagggcgtccgtctggagcagggactcagggactgagccccacccgcgggctccatckctgagtcctcactggggcgaggggaaaaaagggcgtcggactttagctggctggccccgagtgaccccgggtcgtggcgccggccctgggccagctcgtgctcctgggctttyccgcgcgacccttcacttcctggttccaggagcacgtgtgagcactgcgtgccctctgagtccccgaggccgcccttttcattcctgttcctgctagcttgctattctggggacttgaggtcacgggctggggctagggggctctgcatgggtcgcacggtgaccttctgtgaagctccagtcatctctatgacggtcccctgacctcgggggtctgggtgctgcagccctgactgcgccccggggtgccctgtgtgaggttgtgggggtggtggtggctgcttttaccctgcccgagcgccgctgcccccaccgggtgccccctgctgctgggaaagccggtggtggccgcgggcggacgggcgggctgcccagaccactgcgtcaccccagcggcgggagggcggtgggtgactcatctgttgtaacggcccagggtgtggtcgtgggggtggggggcggcggctgggaggccggacctgcaggaccggaggtggactgccgcctccccccgcgccctgtgcctcctggggctacctgaagccggtgtcctgggagatctgtgagcagttggtatctgtggggcagagagaaacggggtgagagtggggatggagtgtgggattcgatgtagaagacctgcggctgggacggggctcccccagtgttctcattgacttcaaagcaccagacagcaatagctctctatctctagccccctcccagtttctcctccccactacaaggggcagacctacaactgcagaggaggccaaggcagggcgggcccagtagggccctaccattccagaaccaacaaataggttttgtccaaccgcaactccctccctcaccccaaggcctctgcccctgtcccccaccccgggattggcccctaatcctttcttcattccatcccttctccctccagaattttcagctgtgggttctctagctcagaacactttcccttcccaggggatttcttctcctgaacaactacttcctgagtcctcttcttcaccccaacacgggtcatttcctatcttcccccacacgctgtccatccccactatagctgtctcctggaataatctcttgcacctggctacacccgagcactgctgagacgatcccacttctgctcccgtgctcacagcctgctcaccacaacgtctgtgttgacagggtgtttctgcccggagcccccacccagcctccaacactgtttggtacacagaagccatggcaacrgcccccacctcatcccctcctcccacgcaagctttggagcttcctgtttgtgtagcctcagctttctcttctgctcctgactctcggtggtgaggggctgccctacggtggttcccttaattgtgggccgccccccatccttgctgctggctgtggcacctcgctctgtgggctggtgccctcactgtgctgctctttgagaacactccctgtcccaaatctgagttgggaagttctcctgtgttccatctgcacggtggatggagagtccctttgtcttcccaattaaacaccctagccaagaaccctgaagtcctccctgcccccacccatgtccgccttttctttggctttggctttggtgaggtaagcttccagcccagggtctgggtggggccgagtgccttgcgtggcccctccccgtttcccgcctattgtaactccagggtgagggtgagggttgttctcacagctgcagtagcgctagggtttaggttgctccctgccagtccatcccccaggttgttcagctgtcaccttcctttggggtccccagctctgggggtcccccacacctgtcttccagctgggcatatctcttctcaccctggtaggcaacttgcttactgttttctttatgtttgagggaaggcaggggcaggtcccctgggtgtccctagggtgggccttcccagctccagcagccrcagcccatsagcttctgcctgcccgtgggggtggggaagagaaacagctgctgaccaggcctggcctggttggaactgccccttctcaggaccccgccctatggytctggcacctcagagcttgagggcaatggccccagagtggagcagatacastgcagctggaggccgtgaccctgccagctgtgtccaggccccagcgttgggcggtggagggggttcctcagcatccactttccacccagtggtgggtctgggaggccaagtttgtcctgccttggggggttggggggcactggaagtgtctggcttcaggcctttctctctgctcttaaccccagtgtctaggttaatcattctcctgccctttctttacctgtgccatggtgatccccgagcctcaggccacttggtccctggaaacagccctgagcacagccactcccaggagagaggtctggaactgggctgcggaaagggggcttactggtggtagtagctcttagccccttcctcttcctacctgtcttccagccattcccctgtgcatcagaggttagaggtttctatggtggagtggcctctgggaagggcagggatgcttctcttggtttctcctcagaactcagccaccccaccccgcctgccttccccaagctgatggtgtgtgtgcctggcgctgtgggtcggggcccagactgacatttatctggcccagctttcgggctgggggaagtggagggggcgggttgctcttaatgaggtttaaaaataactgatttaggggaggatctgcyggaaatgtgcagcttgataagctggggtaaaaaggagcagccatgttggagtcgggacgggagggactggcccaagacacagcctctgcggccgagaggtgttgagggtttgaggcaggctggtccccttgtatttcgcagagccccaaggtccattgagagggggtgacrggattgtttaacctgggtgtgtgggagagggggagctggagtgacttcatccctgaaggccaacctggcctggagccagatgtggttagaaggggtggctctctttcttccccttgaacgcagatgcctgtcctgggggtcccctttcgtgagcagcctgacagctagctctgttttggagaagagagaaaagccaaaccagggtggggatgggacagaaaatggggactgtggcccattcttggttcttggctccccttggcatccataccatgcccgggtcttgctcagcccctgagtgtcagacccaggtggtgagtgtggtgggaacacactgccacagtgaggtccgccaactcaggccattggtcgggaaaccacccagttcttgctaatcaagctcctccaacgaagttaaagaaaccctcctgtgtatttccccgtcttgccttctcttctccaggtttccccaaaaatatcacccagggctcctgtattagtttcctatttctgctgtaacaaattgctacaagcttagtgatttaaagcaacacaaatacagcatcttacagttctacagactcaacaggggtctcactggctaaaatacaggtgttggcagagctgtgttccttctgggggtttttgggtgaatctatttccttcccttttctggcttctggaggccacctgcattgcttggttcatggccctgtgtgactctgacttctacttccattttgttgttgttgttgttacttctcccactctgactcacctatctcccactttcagttagtaaggcccttgtgattacactgggctcatttagatgatgcaggataatctccccatttcgagatcttaatcacatctacgaagtccctttttgtcatataagataacaatatccacaggttctgggaattaggacatggacaccttttgcgggggcatgattctgcctgtcatagctcctagaggggaaagtagaatttgtttttattgcctggtttttcataggaaattcgatttgtttgctgaaatccctcaaggacctattcaagcctacctcttccagaaagcct

SEQ ID NO: 12405 - DNA, 39792 bp, Homo sapiens
taatataagaaaaaaaaagtaaaagaaaaaatagagatggagtctcgctatattgcccaggctgttcttgagcttctgtgctcaagccatccccccacctcagcttcccaaagtgctgggattacaggtgtgagccactgtgcctggcctacctattcctgttattgaatgataggcacatctcattttattgcactgtgctttattgcgctttacagatattgtggtttttacaaaataaaagtttgtgacaacactgagcaagtctatcggcaccatttttccaacaccatgtgctcacttcatgtctctgtgtcacattttggtaattcttgcaatattccaaactttttcattattattatatctgttacggtgatctgtgatcagtgatttttgatactactattgtaattgtcctggggcaccacaaacagcacctgtataaacgccaaactgaatcaataaatgttgtgtgtatttgacccaacaatattgaaattaggctagttaataaccctacaatgtcttctaagcatttaaatgaaaggaagagttgctgtctctcactttaaatccaaggctgatccaggtgagaaggcatgcctatagtaccagctcctcaagagctgaggcaggaggatagcttgagccaaggagctggagtccagcctgggctatgcagcaagaccctgtctctctttgaaaaaaaaatatcaaaagctggaaatgattaagctcagcaaggaaggcacatcaaaagctaagataatctgaaagctagacctctcatgccagttagccaagtcgcaaatacaaaagaaatgttcttgaaggacattaaaagtgctattacagtgaacacatgaatgataagcaaaaaaaaccagccttatttctgatatggagaaagttttagtgctctggatagaagaccacaccagccacaacattcccttaagtccacctagttgggccgggcgctgtggctcatgcctgtaatcctagcactttgggaggctgaggcgggcagatcacaaggtcaggagattgagaccatcctggctaacacggtgaaaccccgtctccactaaaaatacaaaaaaattagccagacgtggtggcggatgcctgtagtcccaggtactcgagaggctgaggcaggagaatgtcatgaacccaggaggcggagcttgtagtgagctgagattgcgccactgcactccagcctgggcgacagatgagactccaactcaaaaaaaaaaaaaaaaaaagtccacctggtcaagagcaaggcccttaactctcttcaattctatgaagggtgagagaagtgaggaagaaaaaagtttgaagcgagccgaggttggttcaggaaagaggttatctccataacataaaagtgcaaggtgaagcagcaagtgttgatgcagaacctgaagcaagttgtccagaagatctagctaagacaattgatgaagatggctacactaacagattttgaatgtagatgaaacagccttctacagaagaatatgccatctaggactttcatggctagagagaagtcaatgcttcaaaacttcaaagggatggctgactttcttgttaggggttaacacagccggttcctttatttttttattttttatttttttgagatagggtctcactctgtcacacaggctggagtgcagcggcacaatctcagctcactgcaacttctgcctcatgggttcaagtgattctcatgcctcaagtagctgggattacaggcacatgtcaccatgcccagctgattttttttttttttgtatttttagcagagatagggtttcaccatgctggccaggctggtctcaagctcctgacttcaaatgatctgcccgcctaggcctcccaaagtgctgggattacaggcgtgagtcaccgcacccagccagctggttcctttaagttgaaagcaatgcttacttatcattccaaaaatcctaaggcccttcagaattatactaaattggttctgcctgtgctccatcaatggcccaacaaagcagggatgacagcacatttgtttacagcatggtttactgaatattttaagcccactgttgagacctactgcccagaaaaaatgattcctttcagaatattactgctcattgacaatgcatctagtcacccaaagactctgatggagatgtagtagaagagcaatattgttttcatttctgctaacacaatatccattttgtagcccatggatcaagaagtaatttccaatctcaagtcttattatttaagaaatacattttgtaaggctataactaccatagataatgatttttctgatgaatctggtcaaagtaaattgaaaaccttctgaaaaagatttgctattccaggtgccattaagaacattcatgattcatgagaaaagatcaaaacattgagattaacaggagtctggaggaaggtgattccaactctcatggatgactttgaggggttcaggacttcagtgtaggaagtaattgcagacatagtggaaatagcaagagagctagaatcagaaatggaacctgaagttgtgatcaaattgctgcaatctcatgataaaactggaatggtgaggagttgtttcttagggggtagaatctactcctattccattgacgatggagctttaaaacaacaaacaaacaaacagaaaagagtttactcatggtgaagacactgtaatcattattgaaatgacaaaaaagaatttagaatattccataaacttagaggatacagcagcggcggggcttgagaggactgatgccaagtttgaaagaagttctattgtgggtaaaatgctatgaaacagcattacatcctacagagaaatctttcatgaaagaaagagtcggctgggcgccgtggctcacgcttgtaatcccagaactttgggaggcggaggcgggcggatcacctgaggttgggagtttgagaccagcctgaccaacatggagaaaccccgtctctactaaaaacacaaaattagctgggcgtggtgctgcatgcctgtaatcccagctacttgggaggctgaggcaggagaatctcttgaacccgggaggcagaggttgtagtgagcggagattgtgccattgcactccagcctgggcaacaagagcaaaactccgtctcaaaaacaaacaaacaaatacaaaactaacttggtgtggtggtgcacctaatcccagctactctggaggctgaggcagaagaatatcttgaacccgagaggcagaggttgcagtaagccgagatcgcatcattgcacttcagcttgggcaacaagagtgaaactccatctgaaaaaaaaataaaaaagaaaggaagagtcaactgatgtggcaaccttcactgttgtcatattgtaagaaactgctgcagccacctctgctttcagcaagtgctaccctcatcagttagcagccattaacactgaggcaagaccctccaccagcagaaagatgatgactctctctgaagactcagatgattgttagcactttttagcaacaaagtatatttaaattaaggtatgcacatttttttagacataatgccattgcacacctgatagactacagtatagtgcaaatgtaactttcctatgcactgggaaaccaaataatttgtgttgctcacactgtattgtgatattagttttattgcagtgctctgaagcctaatctgcagtatctccaaggtatgcctgtagacacatggccaagggttcttctctgagccttgacatgtgcttacgtaaatgagaggcctgaagcttaagcattgttagctttgagataaatttttattgtattttatttattttatttttcaagacagggtctcactcttgtcacccaggctgggtgcattggcacgatcatggctcagagcagcctcaacctccgaggctcaagtgaccctcctagtgcagcctcccaagtagctgggaccactggcatgtaccactatgcctggctaatttttgattttttgtagagatgggatctccctatgttgcccaggctggtctcaaactcctggatgtaagcaatcctcctgccttgggctcccaaagtactgggattacaggcatgtaattgcctgctgggaggcaagtcccttacactgcactctgtcattccctccttcctgccataacttttttaatttttctttgagacagagtcttgcattgttgcctgggctggagtgatcttggctcactgcaatctccccctcctggcttcaagtgattctcctgcctgagcctcctgagtagctgggattacaggtgcctgccaccacccccggctaattttttgtatttttagtagagacggggtttcactatgtcggccaggctggtctcgaactcctgacctcgtgatctgcccaccttggcctcccaaagtgctgggattacaggcatgagccaccgcgcccagccctttctgcctcaactttgcaccttttcttcagagagttaccctgggctgagaaaagaatagattttcaatttggacagttttttcttggcttgtttcctctttggttacacggatagtaactatgtcatgcagatgtgcctgggagaatggggtgaatacaggaagcaccttattcacagtgggccggttacttgtcttcccttctttctgagctgcagggaacggggttctaatgccaaggcttagtaaggaaggttcccacgaacaaaacagccccttctctcagtcccaagcctcccagggactgtgctcctcctcttcaggccttcccttctccctctgattaagccttcaacacttggtgggactgggcaggggacacaattttgtactcttgatcccaaaggagataaaggctgggaaatctagggaaggaatgtgaagcctgttggagtaagtccttttaaaagcagcaagaagtgaccttgtctccctctttccattcccccggggcttgtgaatagccttcagtgcccaagttggagtaagagcttcagaaagactggctgtgagggtttggagagaggtttgagaaagcagctcagagactcacagagtcacaccaagagcttagctaatcagctaatcagcactggaggaagacaaatgtccttggtctggtgggacagcttcgtgaggcttggagcatgcagcctaccaaagtgagctcagtgccagccctgcaagttgggaggtagagaggccaaaccaaattggaaaaaatgacaaaacccctatgtactttctagaacaatacataccagctaggaagtgttaaaagacaagctccccaaagtcagttccttagcttttgacttattctaatgtagggcctccatttttaataaactctcccaggtgattcttagctgcagatttgaggcccgcaatttaagaaactgctcttgagactgcatagacatcctcagggctggaagttctttgttgacccgaccagattctctcctgctgtggaactggtttgtcctgatcctgctggcttctctgcagactacactcatcaggggttggcttggcgcctcctgggcaatggggcaagagtaatcatagcaacctaggtgaagtcccaggggaaaactgtgaccctgggccaggctcctggggccgctgacagttagaaccccctcggcccatagtaagttctttaggttcgggttctgacccaaaagtttggccaaagccaaagtggagagcagggcacgccagggcgggtcaatccttcagagccgcggttgggctggagcgtggagctgcaacggttggagcgacgggctccggttcctaagccaccagcacaaggcaactgcccgctggaggtgggaggggcggggccgggggcggggcctgagccgaagaacgcgggctagtggttgccaaggtaacgcgtcaacactagggccttkgcggcgccgaggcggcagcagaagtccggagtcagggcgtgtggctgaggagatggtgagggagaacctcagatgggccccttgtgtcctgaattgggtgggggctctgagtggggaaagtgggggcctaggggaggtcacagttgggtctaggggtcaggagggcccaggagtaaggagaacacctctagaagaagcaagggagatcctgaggtgggttcaaaagaggaattagggatagcatcgataacgattggaaatgtggagcgcgctgagcggaggagttggggagaaagggatgccccaaccctctccccgttgccattacagcggggcctctgtggaccaaagattgtggatgtggtgtgggaaaaagcactggtgggccgggcgcggtggcttacgcctgtaatcccagcactttgggaggcagaggcgggcggatcatgaggtcaggagatcgagaccatcctggctaacacagtgaaaccccgcctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacacagcgagactccgtctcaaaaaaaaaaaaaaaaaaaaaaagcactggtgaggaggccagataatgggtcgtggtacctgttttgccactaactagcaaggtgactgtgggtaagtcatctaatgtgcccgagcctcaggtttttcttctgttagcagggctttgtatccctcagtagttagtcaataaatatttggcagtgaatgaatgaatgaataaatgagtgagtgagtgaggagggtctcaggtttgcaaggcccgggagagagattgggacaggactggcagcctggggtttgctgggatggggagggctgtcagggtactgagggctgagaaggccagcaaagcctgggaggaaccatgaaggggatgcctgggcttgagtgtgttggtcccagaggggaggggaagggcagatgataagtgttggagtcttgggttattggaactgacctagaatgtctggggcacaacaggtggcaaaggttgctacttggatgtacttgtggacagacttcaggcccaggggctgcattgcttttctggggctcagtggacctcagaagaattttgttaattattaaataagtctccaacaaagagcagttcctgactttcgaggactccctgcagtgttgtaattggggtgggggagcgtcccctttcacttatgtattctatttgattcagtgtcccatcttctctcagcaccttacaaacacagtggcgtatgtatgtatgtgarcacctactgtcatgcctggtgtctaagggcatatggtaaatgttagttccccttttgtcctcttttaaaaatttcctatttccaagctctcatagggcataagttgcacctgggcaagacctgtgggcttcagagcacccagatcagggattccccatccaggagccactcagggcaggggtttgactcactcactgagcccctctgtaattcctgggacaggactgggcatatagacacctttgagaagcagtgggtctaagttagtgatctctggcaggccagctgtgtgtgttcgtgtacgtatagtgctactcactaggtttggagaatatttaaaggcatgagaagagatagtagtggtggtgagggtcacaattaggcagacttccagaactcttacaaaaataatgattaaaatcctgcagaaggagagatggggacctcagtactgactaggatgttatcttctggtggcatcctacagatggccaacttggtcccaattgaagaaagaggataattgcgtggatcactcagagtaaaaggcaaggggtctcgtgcatgggaatctccctttcttggtaaccaaagtctacagaaagggaagtagaaccaggccaagagtttgaagcctgaatttgccagcctgcggagactgtgcaaaagaagaactagayctcagaatgggtaagacatctaggaaaagacatatctttcctgaacatgtcaacctgtttagttgacaggtgttgaagttacatcagggaaacttcacactgacctattctagccccattccagctttgtcttgctgaatttgagtgaaacattctggatcccagaatatataatgctatggtttttttgtttgtttgtttgtttgttttcttttttaggtctgtactctcttgctttcagagttcgggcaccaggcccattgctatgctttgttttcaaataaaaattgttttattgttttttttttctggtcataaaattggtatctactcattgcaggaaattattcaataaagaaacatcttaagatggtaaaggttcctgacatactgttaaacatttttttgaacatgctttcagtaatacattctgggcacatacctgccatacaaacatctttacaagagtacttctacatttctttttctttttgagatggagtcttgctctgtcgcctaggctggagtgcagtggcgtgatctcagctcactgcaacctccacctcccaggttcaagcgattctcctgcctcagcctcctgagtagctgggactacaggcgtgtgccaccatgcccagctaatttttgtattttttgtagagacgagtttcaccatgttggacaggctggtctcaaattcctgacctcaggtgatccacccactttggcctcccaaagtgctgggattacaggcgtgagccaccatgcctggccaagaatacttatgtatttctttattattattattttttgagacagtgtcttgctctgtcacccaggctggagtgcagtggctcaaccttggctcactgcaacctctgcctcccgggatcaagcaatccttccgcctcagcctcccaagtagctgggactataggtgtacgccaccgtgcctggctaattttcatattttttgtagagatggggttttgccatgttgcccaggctggtcttgaactcctgagttcgatggatccacccaccttggcctcccaaagtgctgagattacaggcatgagctactgcacccagccttatgcgtttcttacagtctgttttctttacaacttaacaagttatggagatcatcctatatcaatgactgtaagtcaaaattatcatttgtttgatcagcaaatctttctgcatcagagtctctcatagagctcctagctgtggctgaattcttgtgctccaggagttggatggcttatgaagagagggggagtcagctgagtcaccaagacgaaaatatcaaagcagggctggcatctttatctgtccccagtcctcatcttccccagaccccctgccttctcagctgccttcccttcaagagttatctycctgcaagcaggactggatgtgcttctccttaggcactgttcagcttcttggcaatatttatttggtcatgcaaagaagaaaaccagcccgtcacctccttaaagaacttcttcgctattgcctctggcccagagggatccagctttacatttgtgcttgattcttcatttttttctagtatgtttacacagtgacctctctaatccttgttactcttggcaaaactgtttattctaaccctggtgtaaggctgcggcttcaaagtcagcatttccccaatgaggttttctcaaccacccaaccctagagttcagagcttccctctgtcctgctcagtggccacttttctgtggtcatctgtttttcttcctctgttctggctcaggcagtccttgctgtgacttcctcttgacctgggtaccaagggcataggaaacaggagatgcaggctcagccctggaggaacctgcagtctggcggacacttcagcacaagggaaaacctgttggagtccttgaaaacagacaggaaaacaaatggaaaacaataatactttccatctgtattccaaagccctttcacatacgttattatccacagtggagaccacatacgtgatctggaaaacatggaatggtggagtgacttggagtcaggcagttgtattcyggaaaagtatccatctcaatctggtctgcagtcctgtccttgagaggtcaccttgttcggttttattcattcttcatcaaatgcacattgctatattgttcctactacatgtgccaggcactgcaccttttcscttaattacatacaaaactcatgatccaaagccatccaccttttccagttattcccaatgcttagcctcaatcccacctactgaagtttctattcatttcctcttattctatttttggtggaaaggggagccgtagctcaccacctaccatataataacccttcagaggctgttattaggcatccttggggctgctatatttaccttttaataaatccaagcttttctgctctacagtattggggctggctgacgctgtagagggagactccctgtgtaagccttttgctggctgtgccgggcagtgagggaaatgcacatatagcattgttcaatgtacagcacagagacagctggaaaataattgtccaatcgagtgtgaaaacctgatacaggagtaacaggtgctggggtgtctggttggtaatggcagatcagagagagctttcagaacactgtccagggcttagggacctggaaagcatggtatatttccctgtctaccctgttcctttatcagctgctgattcccaggcttggggagacccaatgtgcctggcctattccttcaaggtagcccagtttagagaggtgtggggcatgtgggctcctccaaagtgaggtttgaatcagctttatcataagcctggagtcatccagtagtccttgtagacactaccttttagagatagacgtctactcttgggactgagatgaagctgcctgtcctttgggaatggaggttgtgttcgtcagattcttagttacaagcaacagagccagaattccaatttaagtaaaagagaatgtgttaagagggttttggagagctcacaaataggaacaaaagaagtttctgcagctggaaccaagaccaaaatcaaaacctagaactggtctggcaaggaccctgatgcactgttgcacccccaaaactgccaattccttacatagggtgccgctgctggtatcgttatcagtgttgcccagacgctgggtctggctgccagttctgtttgggtcagaaaggttttccttgttctgccttttggtccactagttccctagtcattgtcagtccagggycatctcattggctaagcctaggtcccttggccagkctgaggtgaatatttgatgttttcagcttctgtagttggagaagagcactatctcccacaactcattagatggggaatttgccaaaataggaagttagtagggggttaaaaaatgactaaggcacactaaaagggtcttgggagagaaacagccaaatagtgggtattatgaactggtttgcttgattatagctagtaatcatttatcattcacccactgcctcaagtttattgggcatcaaccacatgccaagcagtgggtgaggcacttttccatcctttatatcctgtggtcccaccataaccttgtaagattgtggagacacgaaggaggtcaaacagtagcgtcatttgtgagaaagacttgaagcacaagctgaaaagattggaggcaaaggggacactgtgcgtgtctcagggggcaagcccaagttgccccacaagagattgtcctcttgggaaactggtactaggcagataatgagaaactgttgcttctctcctcctgccattcctgcttcctttatccttacttccatactatgtggccgacttggccttcagcttcagggactacagaaatgctcttaaaaaaaccccacaaaaaacaaaacagttttgtttttaattgacacataatgattgtacacatttatggggtatagtgtgatgttttgatacatgtatatacattgtgtaatgattgaatcagggtagttagcatatccattacctcaaacacttgtcatttctttgcagtgagatcactcaaaattctctcttctagctagtttgaaatatacaatgtaaattaatatacattgtatacatgtatatttatatatattattgtatacatgtatattaatatacatttatatatagtaatatacattattgttaactctagtcattctattgcgctatcaaatactagaccttgccatctcatttaatcttataacatttatatttctcaaaatcctctcctagatattgtgtatctcttttgagatatacagtacattattattaactatagtggcctttctgtgcaatagagcaccagaacttattcctcctatctaactgtaactgcgcactcactgaccaacctctccccatgcccctccccttcctctcttcagcctctggtaaccaccattctactctgtacttctatgagatcaactgttttacacaaatgctgctttatgcagagctcttttttttgcagagacccttccctgctctgtggggatgccctccatctgttgctccttgtcccctatggttcagagtttacacagccgctttccctaactgtttctttttcacatgcccacccactcccccagcatgggctggtgaattgttgacttcccagggtctggatgccactcagtactgatgacccaaactttctgcctcttcctgcagccactaagcacagctggcatcctgagctcctcttctgccgcttccaacaggtcaaggaataaggctcrctatcggaccaaagccgtgagctctgaggtggatgagagcctctttggagatatcaaggtaatcctcaacaagtcctttcaagttgatgccacctgcaggcagaggcccaaaaatgtagctcagggcaaagcttctgctgagtaaccttgctctcgtaggtaactctcagactgaagacaaaggggaattctgagacctgagctgcagagctttgggatctagtggggcctatgtaaacagggacacctagcttcttccaccctagaatctctcatgtcttcacagtgtttaaaatctgttataatgtcaaaagggaggctcagctgcagagagtgcaatagttgctcagttgagctccatgatggaaacattgcagggctgatgggctaagcttgcagacaatagcaacatcttccccgctccatccaaggataatagcatcagagtacaacacaaaaccatcctcctttcccagttgctcaactaaaacaattacttagctttgggaaacgagcaggtctttatttgcaagtgttatctagaccaagaggtggacaactcctttagtctagataaagagagctagatagtagagctttgactgattttggtacatatggagtttagtaggtaagaaggaagagagggaaggagaaaaagagaatatgacatggagagaagggcagtgagagattaagagaaggggaaaagagaaagagagacactagtagtgacctgaatgcctctgccagtggggaaggtggggagaggagtgttgatgtctgtccctgctcttcaacatcttcattgtgaattgaagaggactctccagagggattgagataggcttcttaatccatttagaagactctcrctctgcagcagttttcctgttggtaagggaaaggatcaacagatgcatttattttttattatttttttaaagatagggtttcactcctgtcacccaggctggagctggagtgcaatggtacagtctcggctcactgccacctccacttcccaggctcaagtgattctcctgcctcagcctcccaagtagctgggactacaggtgcacaccactgcacctggctaatttttgtattttttgtaaagacagggtttcatcatgttccccatgctggtcttgaactcctaagctcaagcaatctgcccacctcgacctcccaaagtgctgggattacaggcgtaagtctccccacctggccaaaatgcaatttcacttacagacatttgtattgttgttgttgttttgggtacatgtggagttttctagtcaaagcaaagagagatttggaattggctgagttctccaggagtagtcatgctggctggcaaaagggggctatcagaaaaatgcttgtctcttgtccagtttctttggcctcattgatgggtaagagttcaggaagtctctcaatgggcagtagagggcagaagtggcctgtggcacgactgagttgtgcccacgtgaaagcagagatgggcaccaggtggcagcagcacacaggggactgtgggtgcaaagtgaggtaggacaagtggggccatccccctgcctctggtcaggagcacagtggctgcattaatgacacatcctttcctgtgtttagacattttctgaaacaggtgatttcatttaattgttatctaactccttcagggtcggagaattttgaaaaaaagaaaaaatcacacagttagtctgtgttcttgctgaattctaactcactgacctcctcaccaccaactcaatgagctggcagagagctacccttagatcttaagggtaggcctctgcaggtcatttagcgatttctaactccctgaatatggctttttgtgggggttaaagtaatttaatcgtaagaaagaatttaaaattaccaatatcaaagattgtaagagtctgtaacaaattatattgcttcaaacccactgtgtggtcctagagagataattatttcttctttcataaaggaaaatctttcatggagagaggaaaacctagagaacagaaatttactttaattcctgatgattttagactaagtatagacacacactagtgacccccactccttgytatccctaccattctgcgaggaatatctgtataagaacaagagacttgttttcagaaaagctggtcagggctgggcatggtggctcacgcctgtaatcccagcactttgggaggcccaggcgggcggatcatctgaggtcaggagattgagaccagcctggccaacatggagaaaccccgactctactaaaaatacaaaaattagccaggcatggtggtggtcgcctgtaatcccagctactcaggaggctgagggaggagaattgcttgaacccgggaggtggcggttgtagtgagccaagatcgtgccactgcactccagcctgggtgacagagcaagactctgtctcaaaaaaaaaaaaaaaaaaagaaaagaaaagctggtcggtacacatccagccatgctcagatacagggcatcacgctgcyctatccttgaagttaggactgaccagcaggaagtgggggtgacaagcttctaagctattctttctgaactcatagtccccagcccagggccagagcgacagccccattgtgctgctccgagataagcatacccttcaaaaaactctcactgctttgggcttggatygcaagccagagaccatccagctcatcacccgggacatggtccgagaactcatgtgagtacacygtcccckgccsttctatgtccagtcctcatccttttgctaaggatctttgtagggagatgggtaaacccacctggtttcattctgtcagtccaatccccacttctttcctattcrttttcccctttttgtttgatagttctttctttcttctccatcctggcctctcttgtttctcccattgttgtatctattattgccactgtcctttattctcagcttcattgtccttccttacttctagctggctgtgtgagctaagggactggtagagaggaggtgcttagtgagtcctctctaagtccccattagtaccctccctaaagggaagtgatccagatgagtcacttcctttcggctgcattaagaatctgaagcaaagggaaactgaccagatgcctaattagccccctggcttcctcccagactctaaggccataggaagaaattcacaggggctccctgggttcctttgggattagctcaaccccacttcctgactagagctgcccccaggcttgagcccatcctgtgggacttaggcctagctcaaccatgtgccatgagccaacactgtgctcagtggtttaactcttgtgttagtgcttcaccctctacaaccgttctccctgccctrgctccacccactaaaagccctaattcccagaaaatcctacctgtgtcacaagctggagaggcacatctagcacacaccccgggagctgtgtcggactgcggccccttactgagcatgtctggtcagccgtggcatcaagtggccagatgtggctagagccctgcagccactcctggagccagaggaagggaggaagggttccttcttggagccatctagtcctgaaaacacrttggaggacaagtggctggttatttttcagggatgctgaaagcagtataaactgctgtcttagattcggatcactgctggtcactccagatcctaggctgtttagggccacgytgctttgtgaaacacaagrtcttggctaagctgcaaatctactcactcattctgtccatctcctggaccaccctcccccaacacacacacattagttttattagatgaggtttcacttcctgtctcagatgtctgtgtcttattggcatgtacctgtcaaattggcatgtacctgcctcacccagaagcagctttcttcccacccccctaactactccctccyccatctttaatatrtgtcatttgcttgtaatcattataattagcgattggtttgttgaatgcgttggatagctagaaaggagaggtctatagacatgtctctggctattgttgatcacrgattttaattaatatttacagttcaaagcttctctctaggctggatgggcagggaagcttaggtttctaactagcatctatatcaaccttgtctggcgtccccttgccgtttttatgtcatccttgaggaataatctgtttttaaaatttaattcaacagctttgttttgaattctcactctgtaccaagcgctatgccagagactaggctaccagtgtggttaagacagagtttgtgtcctgaaggagctcataaaggaaacagagctgcccaattggctgtgatacaggcagtaagaacagagtgcagtgtgggctcagaggaggaggtgatctattggtccttggtgggggggcagagtgggcacatgtggacatgatggggggtctcagctgcacagagaaggtaacatatgagcaggacctaatagaaaaaggacttaaaatgtctctttttagccttcaatgctacctgaccccccacttggaacatctactccccagtggacccatgscacacttgccgtctcttctgccattgggggagtccactggcatgatgggaagaggggaagagagcagagaagcctgaagtgtggtgctgagagctttccctctcccctccctaactctgtttattcttgtgwcagtgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggtagttaacctccctaagccttcacctctgcagatgggtggcagaatcaaaatgcactggggaactctcatcaggggaccctgaaatgaggcacaaattatgtacttaatgaagaaatattacagaaaggagaccaaagagcaatacctgagatgagaggtgggagcagccggggccaaggggagggctgagaatgaagccaggctgtggaacttcttggctctgacatcatcactggccaaggcaaaattgtactgggtcacctgtggtagccaggctagcgcccagggcacagagcgcatgaaataatctcccactgagccagactggtctcccttaggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaaggtgggctcttcgtctctcccttccctctgagcattcactgccatccctccgccctccccttattcccgcactggacaaggccagggactggtgggggtgtgggcaggggtggggcgggggagagctgcacctgctgtggtagttgcagtgatcacagtgaggactggctctgccacctgttcgctgtgtgaccatgggcaagtcacttgccctccctgagcctcactttcttcatttgtaacttgagggtggtaaaactactttgtggaatcattggcaggatgaaataaggtagtagaygggagaggctttgtgggctgaggattggtaaattaaatgtgcagtgttacttttattttcatcctgttagttcagttctggccacgtatggtggtcgaggcaattggatgcttttggagtacccaaagcttttcctttggctgagagcctaaagaccagaggctcatttgaattctgttgtaactcatttgcatgtggttcacttccttaccaaatgaaaagtgctgattccccaatccctgcacctctgatttctgtctctcaggtaaatcttctctatgtatgcctcctttaattttctaaaggttttacttttgggttcttattcatgggcccgtggtttttcatcccttttgtgtcatgttgggctcttccagcttaaaaatcttgtggcctggcctctgcaagagtgtcttagctcccctgaggagaacaaggggtccaacctggagttcatgggtctctaagtggaacaatggacctctgaagttttatagaaattttgtgtgtacatgtataagtgagttttatggaggagagggccgttgctttcatcatatttccaaagggtgacccattaccaccaaaaccctaagatgtagctccctgaaagatgctattccaggcccctccttgcacagaccctggcacctagcaggaggccagtaaatctttgagctaaactatattaaggggaaaggtaaatataagaacattcttatttccccggacttgtgagcagtcatgcacacctccagcatgctcagcagtatagcattctgtttccatttcttccccttaaacttacacatccctaggcctagtgctacagtttaatctccactctccagattatcctcaatgctaagtgccatgccatccgggatgcccaaatcctggaraagcagcagatccaaaaagaactggrcacagaagagaagcggttggatcagatgatggaagtggagcggcagaaatccattcaaaggcaggaggaactggagaggaagaggagggaggaaagaattaggtaaagatgtggttttggcatctccctctctaagctatttccatgtatctttaggtccatgtagcctagcaaagagggaagagatgagaaatggtcattattgtcatctacttattatctcaaaactttacgaagtgatacatagaatcacagaacttttttttttttttagagggagtctcactctgtcgcccaggctctggagtrcagtggcataatctcggctcactgtaacctccacctcccgggttcaagcgattctcctgcttcagcttcccaagtagctgggattacaggcatgcacatccacacccrgctaatttttgtatttagaagagatggggtttcaccatgttggccaggctggtctcaaactcctgacctcaagtgatcccccggcctcagcctcccaaagtgctgggattacaggygtgagcccggccagaatcacagaatttttagaagcttatttcccaaatcctaggaggcacttcacagtctggctgcaatcaatctcgtttctcacccctacctgccatctactctgtgctttttcccaggcccccaacatgccaggccttgtgacaagttcttaatttttttttgttttctcttttttgaatacccttttctttccttttcctcctggaaaatgctgtctccttccctttatatatagctttgctgtcacctccctcatgtcactaggcaggcttagtggctcccttctctgtgcccatcactctgtgtttatgctccagcatcccactcttgtgctgtggctttctgaccctcctagatgctacgctcattgcggacaggtcctttcgtatccagttctgtagcttctgagcctagcagagtgtttggcctgtaataggtgcttaattcatgttgggatgaataaattcagtctccccttcattttgtgcagaaaaggacaagtcccagagcaagtaaattatagaataatagtgtcctagatttagaacgccaaccatacaatacatgaattacctttataaataatctttgtaccacactgaatggcagttttatctccccaactgtatcctgttctctggaaccattcatctctgtgtcttgtgtactatacctggtacattcacctctgtacttctggtaggtacctggtatactatagtaggttcccagtgaaaggttactgagtggctaagtggctgtccatcttctgcataaacagctccagcaaaggaaaactctgtcttgttaggcaactgtaatgatttgagctggtccttgtattgagcccaaacttgttttcatgtaacccttttactctttactcctgtttacttcatctggagtcatgaagccattcgagcactccatctgaatgtggctctcatactctttcccctcaattctgatcctaatatgtgtcttctcccgttcttccagcctttactcatatgtcatggggtctatgcttccaagtttattgacatcccactaacacatagggaatcactgacaacattgcttgtacaccctgggtttgtttgtttgtttgtttgtttggctttttactattcagctagcttcctatgattactctgggaagaattgggaggtggtaggatttcagaaactctttatatactggaaggtagaaggtgttttatcaagtggggtacccctcttggacaaacaaataaagaaggagaatctcaggaagagtgagccctggaaccaggagctcaggagaaaggaggccaacccttgaggtccttcctgggggagggactttggtctgggctcatgaagcatattcatgtttagggggcacttgtcaaattgtttcggtgacaccacccatcttgggggttgtttaggtggaggttggactctgggagatgtggaccckgggtttctaagacactgtggcactgttctytccaagaggaaggcggcaaattgtggaacagatggaaaagaaccaggaggagcgatcgctgcttgctgagcagcgggagcaggagaaggagcagatgctggaatatatggracagctccaagaggaagatctaaaggtaacaggccagacagacaatgccacgtttcaccagctgcagcatcaaaacccttcaagactctggggtktcagggtgttgactgattttctgccaggcacatgctcatttcacaacatcatcaccgtcaactttttattgccatgttaaatatttatttcaccatggtgtcacgctgcgggatgagcagtgatttggatagatattgtcccttccttccaaggacttgaggtccaagactgacatatcactgtgaatagacacataaaggaaatatatggctgcatgctttgcacaagtaaacatagggatgttttatagtcttccttcaatcacctagggatattatatactttgtagatgaacagtagcaatatcttagttccagactccctgctgttacttcactcaaagtacatagcatcccattgycattaactgtgttgtgaagccaaaccttttcttcctgttagtccaaataaaattagtaagcatatttattgcaaaagaaatgacaacatacctgcccaaactaagaagacttaaaaagtcatcttctgtatgccttctctgggctgtaacaatgtataaaaccctttagcacagtgagggacatggcaggcacttggataatttatttttttcctcaattttttattttgaaaaattttgcacacacagaaaagttgaaaaaattgtatcacacccatcaactcttcacctagatttaatgattgttaatcatttaccttagttgcttgtttctttctaggtgtgtgtgtatatatatatatatatatattttttattgttaaactatttgaaagtaagttgcagatatcttgacactctgccactaaatgcttcagcctgcagctctgaagaacatggacactctcttacatgtcaacaataccattatcacctcctccatcaaaaacttgaattcagtgattccataatatcatctaatagttaatccacattcacattccccaattgttccaaatatgtatttctggctctcttgtttccaaactagackttaatcaaggtttgcacattgcattccgttgagyctctttagtttgttttgatctagaagagttcccccattcattcattcattcattcattcattcagttcttcattcatttttataacactgatattttgaagcatctaggccagttgcctttaagaatatctcacattctgaatttgtatgattgcctcctcatggtgccatttaacttgtggaacacgtattcttttacgattctctccctcccctgtgtttatgaattgtcaagttgtcatcagctagtgcatttgatggtggtgagtgacagggggacgtgaagagtgctgcaggtgggcagacttgtaattatgaagycttctcatcacatctgcagtgtgaggagctgctagagaagtgcaatgaagatcacctgggtagttgggaaactgaaggggcacacagctctgtgaactgcatgagaaggagaatagcagggtgaaggcaatgagagacctggccaagttactccatttcctggctcaggggagagagagtgggaaagggccaagaaggaaagttatggggcaaatatgcaaggtagtgggtgagaagtgagggcaggaaaatccaactagatgtggggagtgggaattagtgggctcactgaggaagttctaggagtccatgagtcagcaccattatgttgatgttgtgtcattatccttttaatgtccttctaacaggcactccctgagtctccaggaagtattattgggcaactttagcaaggaaacctgtgccttcccagctttagacctactgtatcatctcatggtggtacgaagggcagcgtttcccaccttgctaacaaaggggraaagagtgaagggaatttatctggggttgctttggaagggcttcaaaagaaacagggaaagtcctttggtgtcttggaawtgaaatgagccaacaaaaacaacaatccaaaaagtaaataaatagggaaagaagtaaataaatacatgattgtatgtatgtcatacatcagaaatcaacagcatctttagctttgagggccagtgagattaaatgatgtctgggatacaaatagcaggcctaaaatcagtgagaagcagttaggaaggaaaggaagaaagggagaagggggaaaaggagcgagagagttggaggggcagaaagggaaaagtggagtgagcaaagaaatgagtatggtgagagagagagggaatgtctgtgactcacgcaccacatggacctcagaggcagagagttgccataccgctctggttcagaagccttcctgaaggaagaagccttgaactgggcagtgagccaagctggcagagagccagcactacaggaagacacacagggagagttaccttggttagatgaatcagggcagcagctgggctgaggaagacctggaaggccagggagggatttagtctttggagaaatggagggagctggaaacagtgtgggaggtggggtgagttaatcaatagaagaacttaaggagtctgagattgattggaggtgattggggggccagctgttcccctaattccgatgcccctctgcacctgagaatgtgcttggctcagaagtggtctgatcattgagagctgttgaaggctcaggtctgggaaaggcagggggatccttccttaaaaacgaccttgttcacattggtactctgatctccgtcaaatgtttccctgtgtctaagaactttttttctttcctttctcacatgcctctcactttggtcctacctttcctgcctcatttatcaatggtttatcgaatatttgctattttccttgcattgggctacatgttgttggggaagagaggatgtgtgacacaaggtcccttgtcctgtaactggggcagagcgaacacatatgaaatgagtggggacctgcaaggcagtgtatgatcaccttgcaagaggtgtgtcgccaccttaagtgcagagagaatttagaaatggagagagaattgaaagttgaggcaatcaagcaagatttccagagaaggttgatactttaatttagacagaacaggtttcaaaattttagctctggagattataagctgtgtggccggtggggaagtcacttcaatgctgggcctcagtttctttattggagcaagagagataacaaggcctacctaccttttaggatttttggacatatttaggtattagagatagtctgtgtacagtgctcaagaaatagaaagcactcaattaaggcaatatgtattatttcagtcgtcactattgactggagagtgaaagttaggtttaaatgggagaggaacattgaaggcaggagaagcaccatgagcaaagccacaggggtaggatttagcaaaacatgtgagaggcaattgtatggaactttaagagcttctgcttcctgaaaatatagagatcaatagcatcaggggctgccacaaagtcaagttggatgaagactgtaaataggccatttggttgaagagggtatttatgacccttgaaaaaacagctttaacaaaggatagttgtggacactagactgcaggcaatgcatttgccccctcctctgtctgcatctctctatccctggatgccagtggcttcttgtcttacctctttgtactctgaggctctctttcttttgctggcaggacatggaacgaaggcagcaacaaaaactgaagatgcaagctgagattaagcgcatcaatgatgaaaaccagaaacagaaagcagaactsctggctcaggagaagctggcagaccagatggtgatggagtttaccaagaagaagatggtagggacttggtttctgggacctttggttaggaatggaatgtctgtcacagggagaggagggcctgagaactaagggaactccagtggaaggcagccgcaccttcattctaagatgcacatccttagttcaagggcctggcttctttgtctcttcatcttagccagtccacttgttygttaacagagacagcctagaaaggacaaccaaattagctttaacctcattaacacctttgattagaagttgggatgagggccatatgcaggcagaaaagaaaactgaaactattggtgaaagtgagtttttttgtggatttgtcatgacttgcgtaattatacccccggtaatcatgagtcagcggttacataaatttcttgtgcaaatgcctatattggacatcctgtattgggtgctagactcagaaaatagtcttcccccatctcccaccaaagaacctatatgacagagcaaatgcacagtggaggagagagccatacctgcagacagttgcagatggatgtagctcatgaatgtgtcagctcattctggggcaaaattgagtaataaaatgattgggatctacggggattggagagtagaagaaggcttttaagagtggtatagataaagtgaacatggatttatgtaaaaagaggaggaagtactcaaggtggcaggaaagttattaaattcttcatgtgttgatcttgtctgccctgctagttttgaaattccatgatgacagaaacacattgtacttctctatgctcctctatagtagtgatttttaaagaaggccagggggagggtgtgagtataatttgaatggcatatttggtacacctatatgttctgaatacaaaccacagaaaatgaagctcagcgaagctcacttattggctttagtattcttattggatgctggggacactctatgcaagcaatagagtgagaatgcaggtttggggacatagatgattcctacataataacaatcacataactatcatttagtgagcacctagtctgtgcataggctccgtgctaagtgttttacacgtgttatctcttttaatctttacaataatcctgtgaaatggtcactgatgattcaaaatatactggatgcttcaatatgtgtccagtcagactaggctgaaaatacctaggataatgctgtaccattggaactcaaccactattttcccaagtgaatgaaggtggggatgatgagctaattctgtgtaggagttagtgcacatattttctggctgcagcagagggttggtagtggatataataagaaatgagggtggtgagatgacagagagctaagagcagttgttggggtgtcttggacattgagtggagctggaagagtggaatgataaggagtcgccatgaatttctaagcaagagaggagtatatcttgtctttatcatggaaaggacattgtcaaggtgtagctgggagaggctggagactggccacggaatcaggcacttgggcatgtccacagtccaccgtaagtatctacgtatatcacaagcccttaccgacctcacggtggtatctattcttgcagccagggctgcccctgcagagctaaaagcagaaattggttgtagaaacacccagagttccctgtcctgttatctagggcagggtggacaaaggaagcagcttgacaacagccccgtacaacttacagggacaactcactgggcttcacagaagtctgggcaggtagaatgagggcaaggaaggttttttttttttttttttttttttttttttagatgtagtcttgctctgtcactaggctggagtgcagtggtgcgatctcagctcactgcagcaacctctgccttccgggttcaagagattctcctgcctcagcctcccgagtagctgggactacaggcatgcgccaccatgctcagctaatttttgtatttttagtatagacactgtttcaccatgttggcctggattggtttgatctctttacgtcatgatctgcctgcctcagcctcccaaagtgctgggattacaggcatgagccaccatgcctggccgggaagattctttataaatgtcacatttgcctccaacctgcaccattcatcttacgattgctcaagaatggcgttgggaagcgggcttgggaagcttttaaggatatacctgttttttcagagaggtggaaagggagctaattttggtggttcattctttaagtatctggtaaccactgtgggactgcccaaagcatggttggctctttgcccagggactaatgagataacctccacctgctgtactttacaagacaggcacaggaccagttgtttcttggcccagtagccttgcaacttgaaaattgtctatgacatagtggaaggagtgtgaaagccagggtcagggtacctgtgttcaaatcctgttaggtagtttacttcctgtgcaatcttgggcaagacccttgatctttctgaccatccgtttcctcatctataatatctgtctcaggaaatgttgtgagggctctccaggataacacataggaaagtgttttgtaaacaataaagcattttataaatgctaattgttttatattcatgcattgctaaattcattttaccttattatttatttatttatttatttatttatttattttgagacaaggtcttactctgttgcccaggggaatgcagtaatgcaatcatgattcactgcatcctcgacttcccaggttcaagcagtcctcctatctcagcttcccgagtagctgggactataggcacatgccaccatgcctggctaatttttagatttctagtagagacagagtctttctctgtggcctaggctggtcatgaactcctgggctcaagtggtcctcctgcctcaacctcccaaagtgctaggattataggcatgagccacggcacctggccttattttgtcctattttaaaaggagtcaggaagtggtaggrgagatattggaaagtctgttgtaggggttttgtttctctctgcaaggctggggcaatggcaactattctacaaggcctttccttccggcaggctcgagaagcagagtttgaggctgagcaggagagaatccggagggagaaagagaaggagatcgcacgcttgagggccatgcaggagaaggcccaggattaccaggcagaacaggtacctgcttagtctcgacttccctctacttttcccactcccttgcctatccatccctttgacagcctgtagaatggccttgagggtggagatgcggaggaaaggatgcaagttacctagacttcagtagtctgagaaggaaggggtggcctgctcccagggcctgtgtcagcagggattgggcagtgcagcctgtgcttaaggttcaagagaaagtttttcgctgctccataaagaagaactttcaaccttaaccaaccaatgaaatgtgtcaccaggggaacctgtggtatctccatcattagcagtttttaaaattagaagcaatttcaagactgcctggagatgtctgaggtacagggaaagaactgggatgagtgggttggaaggacaagatgacccctcaggttatcttctaacccaaaggtttgatgacaggattccatttatcttttcctagaataactagctgccagagaaattcatgatgcttttcaaagcagactgtcagagtctgtaagtaggtatcttcttaaagccacttggtctgtacttccagctattttgtgccctcactggtcccctgccaacattcccaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcggtaggaggggcctgggaaccttggattcctttccttgtactgtagcagggatggtccatattggatagagagaagctttctggcatgttaacagatgctcgtcgatcttgtctgggttggtgggatcattataactagatggatgattgaaacttttaaaaatcacttgagccaagaattatgtgattagagaattgggagatagcacctggaattgcttaaggaattggtgatgactgggattatttaccctggaacagtaaaagtataaataaaggtaaaattctggtccattctgctgccctctgacccatgtgcccctgcaaattggggatgaaactgcaagaggagtggtttaggaaagatagagaaaagaacttcagacactaagggttgtgagtcactggagcaggactttaagggagctgtttgccgttcatttgacaaatatatattaagcacagaaatgcagggctctgtgctggatgccatggaggacattagcaattaacaaaacactgctcttgcccattccacaggaaaggtattagagatttgtgtttggatggactgcacctacatcaatccatctttcttccttggtagctmtttatccttttacttttgttttcccttttggctcaatgataatttcaacacataagtggaagctaaatgttcacatctctcactgttctgctccctccccaaaagcagtcaacagtcacagctcccattggtttccctctctgctctgttttccaccagtcagacctggtccctggggctgttctcctggtctaactgggaatgactctctttttgctctggttcagactctacaacattagaatttttcaaaaggaaacaagccaagcaaaattcgaattgaagggatacaaaattatagacattatgctcagataagtagagattaaacagtatagcatcactttcttggttcatatgctctaagtccttcctcttggcaatgggtagttagtggcatgccagaccaggctacccagacccctagttagaggcagagcaggtcttcgggagcctctatccttacgagagccagatttttggccttttattggactgcaggccccagcatgtcccccctgccatgataccctttggctctgtaattttctctgcccccagggttgtgccatggtcactggacacctagtgaagaaagtagcttcctaaatgccccccaagattctgcccttgggctacagactgccttccagatgtctcctctctcctccctggcctctatgcccttggacatctgtgttgctgttaacaggcactaataaatattaatgaaatgaaatttaagtcctacttttgctgccgacccatttatctttcctttgcatcatttgcctgaagcatatgcactagccagttattaaagctagaccagcctttttggagaagttcaacttcacctattgttgtaggttagtatctaggcctagtgtctccagggccatgtgaccaccatgtttkgtgtctttactcagaagcatctctgccacagcccaaatccaactttctctgcctcaaaagcacagcctcctctatggcctatatgtggacttttgtttctggacagagggatgtccatacttctcagcctgttgactaagcagagatagctgtcttcctctaccaagtggtttttagaaatgtcttggagcttttgaaaaatacgatgaccaggcttcacttcctagattgtgatttaaatggtctgggattaggcccatgcatgagtctgtttcaaaagctcccaggtgattctaaaatgtagctaggctctgtgatcactgccctaacccgatggaacgaccaggttcatcctcatttggattttcaactgcctggcaccaccggggctctctagtgacacatacaagtcccccttttccacacttaccccttcactcagaagagggtgaaacaatagaaaactgttctaaatataggaaaacaatggcaaggcaaagaggagagtccccctgctatcagagatgtgtctgggaagtcaggatttggtgtctaaatacagagggctgaggaagccaacagtattcttcgggtaaactgggaagtctctgtagaaggcacagaattttaggagatgtttgcatgatggaaagagtttctgggagtggggaggatgccgcatgtatggtggatcttggaagaaagctagagggaaatgaggaaatgaagcagtgttgtaggtaccttttgttggggtatcrgtgactctaggggaggagagcaggtgagaaattcctgcctaagatgattttacatttcattttttaaattatgttgagaacaaaattagatgttagcttaagaaggcctataaatgcatttttttctgagatgcgaatgcatttcatttgagtgttttctgagcctttcctgttgccattagtgattttctccctgatgtcagggtccatcaggtatttttgtggaagaggtttctaagggaaatttggagaggtggatcaggaagagaactgagcgatatcaggctgagctccttccttccagtaaccagggtggagctagcatgacactttatgcatcttttacatttccaagcatagagggagggagggagggaggcaggaaaggaaggaaggaagcaaggaagaaggaaggaaggaaggaaggaaggaaggaaggagaagaaatctcaggataagctggagaggagttatacattgttatcagggagaagtaggaacaatagttcccagtgggtgaaaccctgggtgtaagactggttgcataattttcagggcccagtgaatattgagaatgtgtagcttgggcaatgtaatgagacttcatctctacaaataataaacaaaaaattagctgggtgtggtggcactctcttgtggtcccagctactcgggaggctgaggtgggagaatcacttgagcccaggtggttgaggctgcggtgagctatgatagcaccactgcattccagcctgggtgacagagcaagagagtgtggactcccttgttcaaaaattattaagaatttcaaaacagtgaaagcagagcatcaaaccaagctgggggcccttctaagcatgcccatgacatacagtcatgcgaccctggagctagtcctggctgggtaggagaagggggcatgcatgygcagcagcttttgggggctgatccttgagttacaaaatggggctggagcccagagggctgtggtctctgaggcatgtctactgaaggagcccacccaggaggctcccccaccacctttcctggcctgggccagctcagctgagttcattccattcctgtttccctcccccagggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgaggtgcgctggaatctcctcctttcccaaatcctcttccctcccscaaagakatggcaccacaggctggaaagcatggggatttgggggtgaagggccatggcagagatgctcagggagaggctcttctccccacccagggctcatccctctgaagggggctccagcagwaagtcctgggatggggtcttgctggctctctgggagctccttggcaggatgctggagccttggcatgaatgtgtgtttcgggggtggattgtgagagcagggttggggggtgcaggcccccaggttctgtaaaccccacccagagcctgcttcctcccacctcctgtctggtccaatacctttcctyatacctgcctgcgtttccccggcagagccactggccttcccgagaagtactgcattgaagctgagcgcaaagctaacatcctgccagctacctctgtgaactgaggggagccttcgtggccctcaggatgccttcgggggacagattytgcccagtctctgggcatccataattgctgctaacctagacatttcatagttacagattaaatctacttgactttaaggaacagcttggctttcttgtgggaatgtggctgctacagggtactgaaggtggagtaaaataggatggggggaacccgagtgtgggtggtgtggggctgagggtaagggaatgggaagatgctcttttatgatggtttctcctaagccaggaggtccctttgtcctggtgtctcctggcctttttgtgattccctgggatcacaatcttgtctcagctccaccctgacgcccagttcagaagcatttcagggcattgaggcagagctacagttgcctctcagtgggggctggggcaaggcttggccaggcggagctggtgaaggaggcaccagggccaggtgaggcaaggctcttactgggatcacacccatgactcagatcacatctgtggagggagtgaagtttgaacctggggctcactctgcctgtctcagctctctcccaccagaaccctttcaattccaggcaatgctgcaacacagacacaggcccatgccccactagggcacaccaagagccctgcactccccaccctgccagtccagtcccctcacccgaactcagcccctcctgtggctgggctctcctcagtccacctcactcccataggtggggctcccaaaccattttcgtctgtttttaacttgtctcactttgccccaaactatactttaatcattcattcacttattcagatactgactgagtgcctaccacatgccaggtacatttcaggcactcactgagcacaacagaccttgctgcccactcagaagctgctcatttatgccggtctgctcctgttttctcccctgagctgctcccaccaaatttcttgtacctttggaatcatctctgcctttttggcctctcacctggttgtcaggtgcccctttggggctggactgctagcttctagggatggagccatgtaccctgtttttgtatgcctaggggaaagggctttcctccagctgctgtgacaatgaggtccctctctacccctggggatggattcatctctcaaatccagagcccagtcttgccttccctgatgggccctgcactagaggaggtgaggaatctgttgggtgcrtcctggatgtttacaactccaggttacaagggcctcaggcaagagtcctcttttcatagggcccagggagagtcagtaagctgtttcctgtgcttccttttcctcaggacagccacagcttccccaggtgccttctccaccttttccaccaggaaagattgttgccccgcccgaccaactgtttgggaaagaggctttctcaccgtccctgctcagcacctttaactgcaaccctccttcctagggaagctgatgccttcctccctaggggtcttgggaagatgtggtacccagcctcggatgggagagaagacatggcaatgccgctgaggattctgggactcatctgcagttggggcactggcaaaggttctctctgagcatcacctgttgcttagctgatgcctgcagggaccagggaacaaggctttgcctagttcaggagacactctttcccaggaaagctagaaagagcctgggtgcttaagagtttgcctaggctcacacctaagtcatccatctcagggctggaaaaaatgggccactatggagaaaggattgaggagaaagggggttccacacccactgctaacttctgagcccacttagacaaaaatgggccaacatcacaggttgacagtaaggccagcatttgaccagagctgctgctggtgaaaatgtaggtctttgggtccgggaagatcccaaagccttactaaaagtgagtgagactgtcgactgggcctggacacaggggcagttataggttacgtgaataaaggtctggctttggagaagagagaatatagccacttctgagcaagtgaagatggtttgggagagaatctcagggctctgcctcagggttgacccttttactctcatcaggagttctccatcttggaattggcccatgaagtagaacagagtttcaatttcttctcttgggattcctaagaagtcacacccaggctttcatgggctccagaactagtctgaaccagtaagaatctagttctaagatgcctgacactcttgagagccaggcaggtagttgggatctgaggccagtcaactacatctcggcaatcttttataaaccctctaccaatctcactcagaaatggcagtggggataattacagagaaatctcccagtgttaagtggggactggtggggttaggctgcatgatagtagtggcagactcagcaggacactgtgtgagctgagcctgcagagtaaggctagggcctggagacaaagagaaaatgggcattcttctgaggactccagtgggttcctaggctcagtcttgctgctagaggttggacctttagtggaggtgctttctgctgaggaggtttaagctttccccttctcatgctcaaaggtggagatggtgagctctgtgtactcctctaagccactgaatcaacacagggctgtgtgagaggctgtaagagataagtaggaagtgcagtttgctgcatcatctttgttaatataaagccttttttcttaattgccaacactattattgacattgttatatgggtatctgatcttttcatatctactttttacattattttatgtataaaggtacatattagcttcccgtggacttcccagccccctgtcttctgccttgggggtcttccagcccttataatgtcagactgaactagtccactctagggaatccaggggttgggctccctgccggggcactgagtcagatcagcaggcagttgcctcccaggcatgtgcctcctggctcctggctgggccctatgtcctacctgcccacatgtgcctgttgtgggttggaggcggtctcagtacttttgcatctgcggcagaagcagctccagctggatgtgactcagcagctgccctggtagctaagccatgctgtccctgactcagtggggtgctgggatgtcctttactacccctgaaagcctcagcacccccacctgtgactcgagtcacagctggacattacttggtctcagtaaaagcatttggattaggctcagatgaaaggggctgagagagttcaaagacagacagggctttcagggtgaggacaagtggccgtggtttcggtgatggtggaaggagacgctggaacctcagacaagaagtctggatttgtgggctgtggagactcagggacagtgagctcctcactctatctctcactctctctcctcctaactgctgcttctgcaaagagtggtagcctggcagagaactgtgaaagaagcagatggctcactgcagaccataggtctcttcccctcctgggctgctgcctatggcaacctgcctcccctaccagactctgagatatgtcaggggaaatcatgcccaggttacctggaaggtcctcatttctgacactgctgagttattcctgagttattcttgatttgtctggctttaaatagctcagaccttccctctgtcctggccccaaacctcacatccctcccagttgggacattctccttgaggcgcaagctctgtgtttctttttgcattctcacccatgtcctcttaagaaagggctagtcatcatctcaataccttttgacaactttgaggctggacaggagtagggttgagattttagagggctttctcagaagactcccagaaagaagagtcagaagtgggtgaatggaagtgaggagcagaagggctgggcctggaagaacctgtccagagccaatgaattttctgcatggtccctgggaaagacttccctgggtagtggggatggacaccaaatcttagaatctcaaagcagaaagggaccccaaagaccctctgatgcttgaatatcctttgtaaactctagtcaaatggttggacaatctgagcttgtacatcctgagagacagggcgctcactacctcaaaaggcaacccaaaccatctcagattcgccctgatgcccagaagtttcttaatattgagtcaatatgtcttcctgtgtatccaatgtgtggaccgagttctgctctttgtgaccacacaaggcagggccaggctccttttacatgatatttcttcagatatctcctaccctggctgctgtgcagcctgactctgaggggaagtgcctgtcattatagaaacacagggctctcctgagcatttcagggaggggaggaaactgggagaagtggggaatcttcaactttatcccttgggctgggcctgctgttctcctgccaggtaatacttctgctgtcgctgcagccctagcagcgctctgttgcctctgagccccgcccctgtggcaccaccttccccttgactccttctatcccagtgtgcaggcaacaggaaacaaatacagagggcagagcaaggattggtcaggacgggcttagtgagaaaggctctgaacgagacacacaccagctgcagcttcgtactgacgcctgccagctcctacacaccttcctgggcaactgccagcggggcaaggcaggcctggggccaccctgcaggtcaaggggcaccacagttccactctgtagatacgtgtttggggaatccagatggcaaaatcaaaggcaagttttatttctacaaattaaaatgtcaaagtcccattggacctgtggattaattcatctcaaagtttctctccccataaacagacagactcatggttcaggacaatcaattttagttgcttaatccacccgatggcctggctctgatcccagtgaggtgctctggtgttctgggtagaaggtcccaagaggttccgttctcaaggatcttccttcctcagttaaaaaataatcrtcagctgtcactcctggctttgctcttctcagtycatgtctggcagggacctggcttacttaccaagcccagaaatattcccctggcctcctctctccacccgctactcttttctctggcacgccgttgttagttatccttcagatctcggcttaaacatcattgccactaagtcaggggccttgcacgtattactgcatcttaccacattgcgggccaggagctatttccgtgtcagatggggtgttctgtgaggatagggactgagtctccttaattgccatttccccagggcctagcacaaagcctggctgtttgctgaatgaatgaaggttctgcaggatgtggttgatcttggcgaggtgaagatacctttatcttcaaagcctcttcattcttcctcagatctgtcatcagggaatcacatagcctttacaagcgatttcttctcgcctccactcattctcttgctaacaattcagttggtggcattcaatcgcctccctttgctcttgtgctttgttgatgtagtgacaactccagccactcctttaattgatggggactatgtgtgtgctgcttgctcttctgagtctgtcagcttcaggacattgcttgatgggagagatgtgggcatatccaggctcctcctagaatcccacttcttctgaagtgtaccagtcagaaccactgaggtttgggaaacctaagcaggagcttggggagtccctgtgtcacctgtgttcacggctcttccctgccagctttgatttgagccttagtttcgaacccaacccacaccctcaaacttagccccacatgtcgatctcatccctctctgtaaccagaatccgacgttgtcccatcaccacccatgcaacctctgagccccctacccttctcatgcaaccatggcctcacctggcagacctccacctccaaatcatcactgaaagctgggtggacagacagcagctgcaaggctccttggcttctctgtgactctttgcctatccattgtcactcacagcttctgctcccagagtcttacctcagaggtttcctctgcagga

SEQ ID NO: 12406 - DNA, 24440 bp, Homo sapiens
cgagactctgtgggctcccagccccctctgcctccgggcctaccccccggccactatgactcacccaagaacagccacatccctggacattatgacttgcctccagtacggcatcccccatcacctccacttcgacgccaggaccgttgaggagccaggatggtatggcagaggccagcacacctggctgttgctgctcaaggctggggacagagcctagtgtacccctgccaggagcagggagtggaccggcaggctgtgaacatgaacaacgcttaacagagcaagtgatgggagccttgttcctgggttctaccatgggagacgctgatcagcaggatgcctggctccctttcccaacccactgctcccaaggcctccagggccctgtgtacataaactggtgggttggaagttgctgggtaactctgatttcagacatgcgtgtggggtaccttttctgtgcatgctcagcctgggctctgtgcgtgtgtgtgtttctgtgattttagaagggtaccaggcacaggttctgtcctagggcacttaccatttagtagggagatggaaccaacccaattaactctagcaatagcctcctaactggcctcctccattgattcagtgaaccttccaatgcatggctcataatttcaaaatacaggctggttagttactccctacctgaaagccttcataggtgcctctttgctcttctgccagtatcaaaacttttgaaggccttaaaggccctgctttgcctggcccatctgtctctccagcctcaccttgaactgtgttcctgtcactgcacgccagtcacaccggcctctaggtcctcctgtaggccactcttctttctggcacagggacctgcacacctggagtgcccttcctcccccactcgcctgttcacccctgcttttcctttacacctcctcctcagggaagtgcccaccctccgtacatctttcacagccctgattgcagctgtgttcactcaccaggtacctgcagaaggcctacagggtgccaggcacttctttaatgtgttctttctttatgtgattatttgattaatctctgcctcccccactagactgtaagctccctgaaggcaagaatcctgtgcttatgctcaatattagctctcccttggcacagagtaggcactcaacaaatgctccccaaaaggctgagtggctgactgaattaagtaccagtgacatgcagtaactgctaagatagatgagccatctgtatgctctgacagttacagactgaataagttggagacttccctaaagggtggcatttccccagggtaacaacgcagagctcaggtgtgggaaggtgccaggggcaggggtgcagaggggctgaggctgaggggggtgcagaggctggagaaaggataacaggagagagtatacaggcatgccttgatttattgcacttcacaggtagcagaatttttaaagaaattgaaggttttgggacatatatgtgacagcaataggttaagaaaagcaaagcagagaaattgaagatttgtgtcaacactgctttaagcaaatctgttggcaccatttttccaatagcatgtgcccattttgggtctctacattgcattttggtaattgcttgcaatatttcaagcattttcattgttattatatgtgttatagtgatctgtgatcagtgatctttgatatattattgtaattgtttcggggcgccatgaaccgcacccatataacacggtaaacttaatcagcaaacgttgtgtgtgttctgactgctccaccgaccagccgttcccccaagtctttccctctcttagggcctccctattccctgagacacaacaatattgaaatgaggccaattaataaccctacaggggcctctaagtgttgaagtgaaaggaatagtcacacatctctcacttaaaatcagaagctagaaatgattaaacttagtggggaaggcatgttgaaagccaagacaggctgaaagctaggccttttgcactaaatagccaagttgtggatgcaaaggaaaagttcttgaaggaaattataagtgttactccagtgaaaacatgaataataagaaagtgaaacagctggccgggtgcggtgggtcacgcctgtaatcccagcactttggaaggccaaggcaggtggatcatgaggtcaggagtttgagaccagcctggccaacatggtgaaaccctgtctctactaaaaatacaaaaaattagccaggtgtggtggcgcgcacatgtaatctcacctactcaggaggctgaggcaggagaatcgtttgaacccgggaggcggagtttgccatgagcggagatcatgccattgcactccagcctgggtgatagagcaagactccattaaaaaaaaaaaaagtgaaacagccttgttgctgatatgaagaaacttttagtggtctggatagatcaaatcagccacaatatttccttaaaagccaaagcctaatctgcagcaagaccctaactctcttcagttttatgaaggctgagagaggtgatgaagctacagaaaatttagaagccagcagaggttggttcgtgaagtttaatgaaagaagtttaagaagccatctccataacataaaagtgcaagatgaaacagccagtgctgatgtagaagctgcagtaagttatccagaagatatagctaagacaacgatgaaggtggctcctctaaacaacagattttcaatgtagacaaaacagcctatattagaggaagatgccaatctaggactttcacagctagagagaagtcaatgtctggcttcagagcttcaaaggacaggtgttaggggctaatatagttggtaactttaagttgaagctaatgctcatttaccattccaaaaatcctcaggcccttaagaattatgttgattatttagtgtggcgtggtggcacatgcctgtagtcatagctacttgagaggctgaggtgggagtttcgcttaaggccagcagttagaaggctgtagtgaggccaggtgcggtggctcatgcctgtaatcccagcactttgggaggccaaggtgggcagatcacgaggtcaggagattgagaccatcctggccaacacggtgaaaccctgtctgtactaaaagtacaaaaaattagccgggtgtggtggcgggtgcctgtagtcccagctacctgggaggctgaggcagaagaatcaattgaacccaggaggaggagcttgcagtgagccaagattgcgccactgcactccagcctgggcgaaagtgtgaaactctgactcaaaaaaaaaaaaaaaaagaagaaggctgtagtgagctatgatcatcatcactggactccagccttggcgacagagcaagatcctgtctctaaaaagaaaaaaaaaaaaaaggccgggcatggtggcttacgcctataatcccagcactttgggaggctgagtggggaggatcacttgaggtcaggagttcgaaaccagcctggccaacatggtgaaaccccatctccactaaaaatacaaaaaaaattagccaagtgtggtggcgcgcacctgtagtcccagctactggagaggctgaggcaggagaactgcttgaacctggaaggcggaggttacagtgagccaagatcgtgccactgcactccagcctgggtgacaaagcacgaatctgtctcaaaatagataaataaatagaaaagaatgctaattttaccctgcctgtgtccctgtgctctggaaaaggaacaaagtctggatgatagcacatctgtttacagcatggtttactgaatattttaagcccactattgagatctactgctcagaaaaaagtattcctttaaaaatattattgctccttgacaatgcacctggagatgtacaaggagattaatgttgtttgcatggttgctaatacagtatccattctgcagcctgtggattgaggagtaatttcgactttcaagtctgattatttaagaaatacattttgtaaagcatgagttgccatacatagtgattcctctgatggatttgggcaaattcaattgaaaacctggataagattcaccattctaaatgccattaagaacatttgtgattcatgatgggaggaggtcaaaatattcatgctaacaggagtttggaagaagttgactccaaccctcatggatgacttggaggggctcaagacttcagtggrggaagtaactgcagatgtggtagaaatagcaagagaactagaattagaagtggagcctgaagatgaaactgaattgctgcaattcatgataaaagttgaatggatgaggagttgcttatggatgagcaaagaaagcagtttcatgagatggaatctactcttggtgaagacgctgtaagcattgttgaaatgacaagaaatgatttagaatattccataaacttggttgataaagcagtggcaggatttgaagaattgactccaattttgaaaaaaagttctacagtgggttaaatgctatcaaacagcattgcatgctattgagaaatcttttgtcaaaggatgtcaatcgatgtggcaaacttcactgttgtcttattttaagaaattgctacaggcaccgcaaccttcagcaaccaccaccctgatcagtcagccgccatcaacctcaaagcaaggcgctgcaccagtgaaaagattatgactcactaaaggctcagatgatagtaacatttttagcaataaagtatttttaaaattaaggtatgtgcattgggctgggcgctgtggctcatgcctgtaatcccagcactttgggaggccgaggtgagaggatcacttgaggtcaggagttcaagactagactggcaaacatggtgaaacttcgtctctactaaaaatacaaaaattagccagacatggtggtgtgcgtctgtaatcccagctactaaggaggctgaggcaggagaatcgctcgaacctgggaagcagaggttgcagtaagctgagatcataccaccgcactccagcctgggcgacagagtgagactccgtctcaaaaaaaaaaaaaaaaaagttatatgcatttctagacataatgctattgcacacttaacagactacagtatagtgtaaacgtaattttacaggcactgagaaaaacaaaagcggtgtgactcactttaatgccatattagctttattgcagtagtctggaacccaacccttagaattttgggggtatgcctttactcaaatggggcccaccagggcagaaccatcagggtctagagtaggagtcaggtgatgactttgaatcccaggtttgtaaggagtgtgattcaccttattaactcgttagaggattaactgagtccccagagacctccaggaggctaaacagatggaggtcgagaatataaacctagcaccacaccaactagatgggtttctctagacgcctttcaccaggtgctctctccttactggacagcggggtggactctggagagtggacctgcccccacctggattctccctagtatcctccgaccgcccactaccccactcccccaggctccgccccgatcccccaggcccagttccaggatgactttggattgcccgccctcgccctatccctgtccccgctcccgtcctaagatccactcgtttccttcgccatggctccgctcaggtcctaggtcaccctagcccttctctcttagcacaggctcggccagccctggccctctgggacccatcagctcctgcgatctctggccggcctcgccctgcctgctccgccgggcctggcccgcccctcgggttctggctccgccacccgccctcgtgggctctcccctcgccttgctctgccctgcggcgccccctgtcggccccgcgtgctctctgcggttgcccctttccctcgggcccgcccgcctcgcgcggttgtcttggagagggacgcgtaggctacgccaccgcggacgggtcggatccggtccctggacgcggaacagagatcccctgattcagccacccccagactgagccccgtagagtgcgttcttaccttcctgccccgacgaaggtcccagagacgctgcggacaacaccagcatgtcgagcgagcagagcgcgccgggggcctcacccagggccccgcgtccggggacccagaagtcttctggcgcggygaccaaaaagggagagcgcgcggccaaagagaagccagcgaccgttctgcctcccgtgggggaggaggagcccaaaagccctggtacgctggcgccggggtttggggatcgggcttccaggctgcgtcttcccgggttcccactagctactcactgctccaaggttatggctgaactcatasatacctacgttgagttcctgaatctcggcttgatagatgtttcaattgaacttgatcttaaagaacccacactctggtttgggatggtgacaaataccaataagatgtgataagatatagaagagaggaaggcccagggggtgagggcatcaggrgtgttgccaggaggtgcctttgaacagagkttacagatgttcattcattgartcaacaattactttccaaatgccagccatgaggccaratatgtcacggaggagaacgaggtggacacagtcctgcccccatggggtttacatcctctgggaaaagaaaatgagtagaatggtataagtagaggtatggccctttttgttgcaagtgatagaaccccaatcaaactaagcatgaaggggaaatgtatccgaagtcttcttgatacaaatctgccagcttcgtcatcacggggacaagaacttgctgtctctggaatcgaagtaaaacaacttgggaaaaagatctgatcatccagcattagccaggtactatctctttgtcagtgctggtggatggggagaaggaattataggagctggagaaacaacatcttctggaagggaagacaagacagtatacaatcccctacaggtacgaagccagttacattcaaaacacacacacacacacacacacacacacacacacacacacacacacacacagacatggctgctgtatagaatacagggtggaaggaggcaaacagatgagttaccggactatttcaacagcctagtctggggacagtgggagttgggatagggcagtgagaatggtgaggcttggttgagttaggctcctcagagaaacacttttgaggtagaagtaataagagttggcgaaggactggacagggtagggagtgagtgacagagcaagaaagattctgaggcttctggactgggcactgggtgggaggaagtgccattcatggagatgggaaaggccaaaggaggtgcatgtaagggaggagctctaaggggtgatgccagctggacagctggacacatgggtcagcagtgcctgagaggttaggggtggagttgtgactttgggtgaagttgtgactttgggagctgctgatgttctggcataattaagtcctggcaatgaaagagacccctcaaggaggcagggagtataattagagaagaggagagggctcaggatccagccttacaggttgtagaggatggcagggaaacctgagcagccagcagagaggtaggagagaatgggagtgatgcctgcacaggcacctggataggacaacatggaggtcatggtggccttagcagacaccaactgtgtgctgtggcaggggcagatgtgggctcgtgtccggtagagagtgatggctgatataggaaggtgtagggatttagaggaaatcctatctaatggcttttatttctgaagaagctacgaggtgagatcattagtgagcataagaaaggggtgtggaaggggaaaagagctgtgctgtgtgacaggtaactayctgctaaagtgcagagagcccatttccatccaggcatgaagtactacagggcagcgctcttttagagcagggcttctcaaggtgttgtccttggaccagcaacttcagcatcatctgggaagttgctaaaaatgcaaaatcagggctctcacctgggctacagaatcagaatttctgtaggatagggcccaggaaattgttttagcaggctctccaggtgatttttaagatgttaaaacttgagaatctctgttcttgagaagggaggtatgagtgaagcaaggaagcatgaggggctctcccagcagagggaagtttgggagggcagggaggtgtgcaggagccagccagaccagggggtcactgcaacctccctatgccttctcttacctgcttcgcccatttggctgtgcctgggttaccactgatggccagacacaggaggaaaatgcctctcatgcctttccccatgaaccctcgagcctctctgcatcctgccagctcctccactccctcaggcaggctccctactgctgagctgcaggtgtccctccyggcacagctcctgcagcacctgcccctgtggccagcgtgctgttctgtggagctccaggctgtccggcacttggcagggactcccatcctatctctaggagccacttcttcctgggatgcctatggtggggagccagaaagagcaagtgtcccttgaagactcagagtctcaagtttgcatagcacagccctcaggttgggatgtggtgggcgcgtgtgaattaatataactcagaaatgagttaatatttctaaagcatttcaaacagcactggacactaggaagtgccatataaacacactggacaggggaaatgttaaataaaagtatcgttctgctgctcttgggtgtatgtgtagggaaggagtgggagtggaaaggaactcacatcgggcctgcgctttctcccagggaccctgagcagttccagcagggaaggaggacttgtgaggaggaggctgggctggggacacctgggaaaggcggaagcccgggctgggagtggagagcaggggtggcagtcgctttgacctgggggtggggaagccagcacacagaagaggggaccccgttgtctaccgtgcacgcacgcccgttagtcccctttctccgagctcttgctttccccgtttcctatcaagtgttttcagcgtccgtacttccaagcgtttgcaagttgaatggctgcaaaaatatccgtctgaggagggcccctccgcccgcgcgggagagcttggggatgcgggggtgggcgtggccccttctctcacgcccctgcctgcccccgcagaggagtaccagtgctccggggtcctcgagaccgacttcgccgagctctgcacgcggtggggctacacggacttccccaaagttgtcaaccggccccgcccccacccgcccttcgtcccctccgcctctttgtcggaaaaggccaccttaggtgagtgacagtggagctccccggtgcctgccagggccgcctagtccatcctcagcctcccttcccacgccgggccaaatggagggacgcggggcggtgtgtgtgtgtgagtcggsggtattcgacgaggccggtggggaggtgggggagtctcccgtcttcctttccaacccagcagaggcgcgagtggccggagaggcagagtccgcaggccggcgcctcccctctggcggtgtcctccaatcccacccgggcacccgtgggccggcccggcgtggggccctggaggtggctgttcccctccctcctcacctctgccttccagacgatccgcggctgtcggggtcctgcagcctcaatagcctggagagcaaatacgtgttcttccggcccaccatccaggtggagctggagcaggaggacagcaagtcagtgaaggaaatctacatccgcggtgagccccgctccccccacccgccccagctccctcccgctcccctggagcctcccaggtctgaggcacctgcctcctcttggcccgcaggttggaaggttgaggaacggattctgggtgtcttctctaaatgtctgcccccgcttacccagctacaggccatcaagtgagaggcactgaggggatgggcgggggaccagagtgggagttggggctcctggtggcttgggagagagaaccaaggggcatgggagaccctggcgacggtggggaggtcgggggtgggggatgaggaagggcaccgctgggagaacggtgtggggagggttttccagtaggagggggcgctctagctctgtgtttctgcacttcccgcccacgacagcttgtggaaggtggggctgaccgataagaccctgaccaccttcatcgagctcctgcctctctgttcatccacgctcaggtcagcagactgggaggccccctgtgcctgggaagcctggctgggcgggtggtcagaggggagcagtgtggggatggaagtggcaggtcccagctcctgtgggcctgcctggcatccctgtggaagcagaagcaggcaatgtctgttggatcatgatacctccattagacaagaagccaggtccgcttttctgcccacaccagcacccaaagagcctgatcttcaggggctcaacctgtctcccctgcattagtctcattaccctccactccctccccagaggttctcgctctccttcctggctgcctggggctctggccctgtactgggggctggtaagaaacagttcttatcctccaggaactcgcagtccagggagggagagaaaaggacacaagaataaatactgcagggcaatgtggagactggtgatggaggactggttcatcagaggagggagtgggcagagagaagtgccacccactttatggatgtgaggcaggaagacctggaagactgcctggaggaggtggtactgagctgaaggaggcctaggagcaggccagagagggaattgggaaagggtgtacttgtatgggaaggagcaggagcaaggcatggggcagggtaamwacaggtgtggttgggagtgtaaggggcaaggctgatttggccctgccccttctctaggctcccacagcaccctgcctcttcttgcttcatggtggcgggggggtacccctccatgcagtggcttgcctgtcttcctcctgtagatggcatggatgctccttgagggcagggactgtgtcttcttcagctgggggtccccagcactctgtgtaaaacaccatgaaacatatttccttccatcatgggaattagctagcagaaaacaactatatgaattcatctgtaaataatgtgtaaaagtaartcatagcaacataaacaaatttaaactgaataatcaagtttatgtgacagacgaggcaggctgaaaggttgaacaaaataagaaatcatgggagcaaatttttacatagcgtcatttctagccattagttcagtttttgctgtgacttagaaaaggacctccattcttacagcactgttagagaagcaactgccatgtggaggctcatgttgtagttatctcttgctgtgtgacaaattaaccccaagattcagtggcttaaaaggacatacatttatgatctcatagctgctgtgagatgacctgggggtgggctagctgagtgctctggctcagggtttgaggttgcggtacagctgctgactgtggctgcacttacctcaaggatcaactgtggtggagaatctgcctccaggctcrcttatgtggctgcctgggcctctccacaggctgcctgagtgtccttaccacatggcagctggccagctgagagagtgccagagagcactcaagacggaagccaccgcctttgtagcctaaacctggaggtgctgtcccatctcttctgccatgttctgttcattagaagtgagtcacttatttccctccaccccaccccccaccycttcttttttttttggagacagagtcttgctatgtcgcccagactagagtgcagtggcacaatcttggctcactgcaacctccgcctcctggattcaagtgattcttctgcctcagcctcccaagtagctgggattacaggtgcacgccaccatgtcccgctaattttttgtatttttagtaaagacggggtttcaccctgttgcccaggctggtctcgaactcctgagctcaggcaatctgcccgccttggcctcaaaaagtgctgggattacaggcgtgagccactgtgcctggccagaagtgagtcacttctaatgtgaagtccacactcaaggggaaggaatgacacaggggcatgagttccaggaggtggggaccactgaaggccatcttaggggctaccctaccatgggtcaccaactttggggagcagtcccttcacaatgggcacatctgtgaatttttagtctggggaattgtcacatatatttcctatattgggggggcaatcctttgactctacttcctagctgcttcccagagacgcacacttcctctctgttcccttcccttacctggcctcagtggtaccttctggttctcagatctcccctgccctcaggaaggtgtctctggaggggaacccactgccggagcagtcctatcacaagctcatggccttggacagcacgtgagactccctgccctcaccccctttctctgggcctgtctcgaaattccaagccatttttagtccccgcccttccttgtccccctaccatctcggcaagggccctcgatttctgcccctacatcctcagaccagaccgccccctcaagcgctcaagtctcccatattccggcggacgccctgtaccttttccagcgacccacattctccctccggctgccccaggattgcgcacttgtctctgcggaacaataacatcgacgaccgcggggcgcaactcctgggccaggcgctgtccacgctgcacagctgcaaccggaccctcgtctcgctcaacctgggtttcaaccacatcggtgacgagggcgcaggctacatcgcggacgtgagtgcacggcggggagggacctgctgggagcaggggcggcttgggcggctcacgcgtccctgcccgcctcttagggcctccggctgaaccgttccctgctctggctgtccctggcccacaaccgcatccaggayaagggcgccctgaarctggctgaggtgggtgtgccgatcaggtggggcaggggcgtgggcgggccgagggagccgaccctgactayccaggcgtccgaccgctgagcgcccgcctccttcaggtcctgcgcgccttcgagctgacacacaccgaagtggtggagcgccgacgcctcctgctggaaaaagggacacaggagcgctcgcgatcggtgaggagctaccaggccccaggaccagccgagagcccctctgaccctcgagcccactccccaagtccgctgcttttcagcaaactggccatccagtttaatctccaccctctgtcctgactgtctttccctccgatttctgcacagacttttgccaagcccctgctgggsgggctctaattgcagaaccacactatgggcagtagagtgtactggttcagagataggacactagattgagaccacctggacctgaaatccggctcatccatatcccagcttgtaaccttgggcatgttactaaacaacttcttcttcttctttcttttttctttcttctttctttctcttcttcttcctcttcttcttcttcttcttcttcttcttcttcttcttcttcttcctcttattcctcctcctcctcttcttcttcctcttcctcctcctcttcttctccttcttctcttcttcctcttcctcctcctcctcttcttcctcctcctcctcctcttcctcttcctcttcttcttcttcttcctttcttctttcttcttcttactttttttttttttttttttttttgggagatggagtctggctctgttacctgggctggagagcagtggtgtgatctcggttcactgcagtctctgcctcctgggttcaagcgatttttctgcctcagcctcctgagtagctgagatttcaggtatgtgccaccatgcccagctaatttttgtattttttagtaagatggggtttcgctatgttgaccaggctggtctcgaactcctggtctcaaatgatccgcccacctcggcctcctaaagtattgggattacaggcgtgagccactgcacctggcctgtgttacttaacttctccttgccttagtttcctcatctgtaagtggggatagttgtacctatttcatgactgtcgagaggatttaaagactcaattcctgcaatgcagttaaaatagcacctggcacttagctcaataaaagctgttattttttccccctcaatatragtctgagaccctgcctcacccttcatctcaccccacccaggtccctctgctatttcttcccgaaagcatctcaccccagaggagtcctatacaaattattttagcatttaggcagggaggtgggtgggagggtgctgtcagctcgactgctccccaagtatgggtatagctacctttcatgcccccattgaggaaggggctctggcttcttccccccttccctcccatttgtgagcacagccctcctcctctcgacacggggactccaaaacggaccgtgagaagagtcagatggtagggatcagcaatagtgcattggtggacaagacagacaagacgcagacaatgaaaacccctaagggcctgggcaagaaaaaggagaaatcatgggtaggtgtgcaatgggacagatcctgggtgctggacggacaggggagggggcttccatcatrtacaraggtggtggagggaagaaggccacatgggcctttgaagttccccctaaggccccgggtcctaacctgggctccttccctcaccactgcccatcccctccggaggtgggacttgcccctctcttctcacattctccacaggaattggccaagaaagaggagaagttggggtctgggcagtcacccacacaaggaacccctaagaaggaagatgccacaaaggcaggcaaggggagtaagtgcgggtgcccctgggtggcatcttcctgtgtggaggagggaagagtgcygggccgggtgcaggargctgttctgggcctgggtgcgcctgcctggagctcatctcgccatgcccctctgggcttgatttccttctcacagtgggatgatgtggagagccgcatccagcccagacatcctgacccactgctgtcctcattccctttgttggagctggagctctgtggccctgtcttcaaagaacccatacacctagctggggccccctccagccatttcttttttcttttcttttctttttctttctttctctttctttctttctttttctttctttctttcttttctttctttctttctctctctyttttttttttttgatggattctcactctgttgcccaggctggagtgcagaggtgcartcttggctcactgcaacctctgtctcctgggttcaagcagttctcctgccccagcttacccagtagctgggattacaggtgcgtgccaccacgcccagctaatttttgtatttttagtagagatggggcttcaccatgttggccaggctggttgcgaactcctgacctcaggagatcctcctgcttcggcctcccaaagtgctgggattacaggtgtgagctacagcgcccagccccctccagccatttctattgcacccaaacccaaagttggggggtctctttgcctcacagcctgttttctctggggagggagcctgggtggtatcagaagtgtgcactgtgcattctggctcctcttctggccccagaggtaaccatccctgaacagaagccaagcagggcaaaagggatcaagatcgggagcagagagaagcgcagcatcctcctggagtccgaggtaagttgccaggaggagtggaggcagggggcacacccctgggattccaggcttgcctgagacgtctcaccccagcccctcctggaatgtggtctccagccccatgctgtggcagcagccatttgccttcaaatttgtcctccactcctgtcccaacctcacctgaaaccccctcccatctcaccttgggcttctgtgggaataacaagagcagaccccttctatttttccttgtctattagtagcccacactttggatctgctgtctcaactcagccaggctacttccccagaggcccagaggcacagaggccctcagttcctcatcaccacctccatcacttgcttggactgttgcataggaacaatgcgtcttcttttttgcccctctcagcagctccctgaggaaggcagggcatttttatggtcatggcactgccccacgctaccctgtgcatgggtccttcttcagaccctctctcttttgcccctggatcttctctgcccccttacaacctggaccaacttgctgcttgcattggaaatcttcctgggctgccttcagtgctcttatggtccctcatccctccgttctgtcagctgcctgassatccgcctctctttatttttctcttccattggaagactccctgcacaccctaggcagggaagggcccctctcctttcaggagtcttctctggcactcaagacaaaatcttacaaaagaggacgttcagagggaggaagagattggggttgcctttcagtttccatttttcatctctgcctctgtcttgatcaggctgctgattgtactaggactactgcaatttcttttcatcatgccgtcattgttacttccctccaatccattctcctcattgctctaggtgttgggaaacacttagtaaaatctgaatgcgacatactgtttcacgcttccagagcctttgcacctgctttctttgcctagaacacctttcccgtcttcatctgacaatatcatgtgcgttcacaggaggcccttcctggcctggccttttccgtgctcccacagtgctctgagcttgcctctgtcagcgctcactccagaccacgttactttcactttctggctcctccacacaaaggagcttcttgagsgtatgggcttatttatttttgtatccccagcacttgggacaaagcctggactatagccggcagtcaaaacatgtatgttgaatgaatgaatgaatgaatggcctgttgaccagctcccctgctgtctgctgcaattagtattctgctttagcagctggttgttgaggctactgaggtggtcaaccctctcctggagcctgtggagcaccgagatgggaaagttttcatgcctgggaacaaggtccttttgcacctcaacctcatccgtatgtctgccaacctcccctgtcctcctgtcatgaggctacccgggccctgtcctgcctgagggtgtytaccccgactctatggagcagagctggtcctcccatctttgggctacatgtcccccaaggctctctggcacagggctggaggggccagaggaagtgctgagtctgggaggaggctgaggacaggcgattggagtaatgagaggagttagagagatggggagtgtgtgagtaasagctgagtgaagggctaggtcagggaaaggtgtgcctgggccagtgagtctggagtggggagctggaggaactgggatgctggggatgtctggtgtgtcaggtgccaatgaggcctgtggtgctaagaggccacctgtctgtaacttccaccagggaaccgcatcacagaggtggggctggagggcttcctcgccacggtgcagtatcagatgcagttctccaaggccaagagtgcatccaagggtccagtggggctgctgtggctgtccctggctgtgagtccctttcactctctcctgctgaagcagacgttgcccctatcagctgtcatactagacagctgctgcaggcagcttctgtctccccatttccaaggaaggtctgtagtttctctgcttctttttaataatcacaacataacctccattcctcttgctggaaaatcagcagtattaatcactctgctttttctgcatgtcccccagcccctaacccaccctgccccaggaccatttttttttttctgccagaggactaatcttcattcctyttgtcagatgtcagccttccttttcttttcagaaaaattgcttcgccccacaatgtcctgcgtacgccataatccaggagctgatgttgccaagggatcccatcaaggccaaactcagggaggatgaggccatggcattcttcccctagccccctcccacctgcttgcctctaagactcggggctacagaagcacctcctgtccctgtgtggggtgacctccctgggggagatctcagaccaataacaaagtctgttgctatacttttccttgaggtcgtctgaaaactttcttccagaactacttggaacatttagattttgcgtctgtccatgttacatgccaggaatggcagaaaagtggtctgaattacagttccgctggggatgatctcagctcctctggcctcagttagccaggggcattgccgttctgcctcctgggggctagttcttccttgctcaggcaatagccattcccccaccgtgttccctaggggacatgcattatgccagggtttgcattcagaaggatttgggatagggattagtaactgacacacataagcttgggagggagtgggagcaggagtaggtgaagcagaggaattaagcacaggctccatgcccgctcccttctgcttccccgtctggctggcccaggtgtttgactgctttggaggagaggtaagggttcagcttaagaaaatgaacaaaggcttggcaggccactttggagagggtgctaaacgctcaacatctacatagcaaaggctaagcattgaacatgaaccctaataacctgcctgcagaagtcagcaatctgaaaccagaggttcctgagctgagtcagggtccccaaacctttacccttcagtgctgcctccattgaggtcacctgccagtgcccagagagcacaggactggcttcggggagcctacctgtaaacctatacagcagtgtccaagatggcgcagatcagcaaagaccagcctttcttcctcacttctaagcagattcaacctgttccacattctctagtcctacttccctcatcccactgcctctgcctacctagaattcccttgtcctgctgtcttactttgtgtggctcagtggcacctaggcctgtctcctgcctctgagtgcctggagccctcctagtctgactgtcccagctctgtctctgcagctggctgtggagccagcttcaccagggaaaacctatcatttctttgaattcccaacactgaacacattgaggtgctggatgatggtcaccccagcttctgcagggaaacttgccatgtcctccagagcttcagtgaccctttcagcccatatctttatcccacccttcatcactaatgactcctgtatcaattctgatgcccaaatagactgtaccctaatgaggacacagctgaggattgtgagaggtagaggagtcagggttgggctggaagagacagaatttgtcactttaatccaacactgaatgccaggagacagaggtgaatggttacagtcttggtgatgtggctgcgtctgtgggaggatgtggatggatgatgacagtgatgaactggccaggcctgaggcaaccctcccacttagatttggcttttaaagtcttcaagctcattgagggcagctcatgagacctcttgactctgggtccactgctcctttatatacacatatatgtgtatatatatgtgtgtgtgtgtgtatatctatatatgtgtgtatatatatgtatctatatatatatctgtgtgtgtgtaactgagttcagtgtcttgtcatgttttctccatgggggttgtacaacttaagtttgcccagtccctagttcagtgagtgcacagctgaagctctgggagggaacaggcaagatctgggtctgggggtgagagggctccctctggttcccactatccaatcctaaccagtcttacagggaacaaacaccgtaccttttatcacagcgattccaagaaacacacacaccaccactgaaggatatttracttttcttaaaaaaaaaatcttaaccatgaaaggaagaaaataaaagagtatacattatcttaacagcagaacagtcatttccatatctatattttatatattatatatatatttatatatatatatatgtatatatacacctagcacagtgtgtatattctattcatcagggagagttgggtgaggacgtggtgatggggccaatgctgcggtggccccttggatggtcctgggtgaattcagggactcggcattcagacccctgtccccacctcctggggcccagtcctcagctccgtacctgcttcactggttttctacagggacagggtggggaagagggggacataggtggggtaagaaacccccatgatccccatcttgtgaagatgagaagtccagggagggagggagtagcttggcagcaagctgtggagggcaggctctggagccaggtgggatggggagccagaagaccttcccactcacagggacaggaacactcaggcctggctcccgctttaggctcgatcctggaactgggttgttaactaaggagatacaagtgaaacccctcttccctaagcagctccttccataactgcctccagcacttcaggaacaggaacaaaaaaggtcaaagttatttacaatagcaaagatgcacatacgatacatacatatttataggaaaccaaagtgacaaagaggggaggggaggcacccacctctgcctggggtcttatggagaaagaggggaggaagaaagtgcatttacacagaagcctcctcctttcacttgcatgtctgagggcagcgcacatacaggcgtgcgcgtgtacacacatatgtggggtgagggcagaccatggtgagtgggggcctttcggatgcagtcagcatgcttaggagacatgaggccttggagggttgggctaagggagggaaaagacactgaaacctgactccgacttgagcagaccaagcaacatgcgggtctccccccgggccttggctggatcctagtttccctaactgcctcctccacagggaggagtgttgggatcccccctaccctgtgccccggtctcaggccagtccctgaaggaggagtggggacgcagaggatttggtggtttgtacggttatggtcctggtgacgcggctgcgtctgctgtgctgtcttccaggggggcgtcagagcctgtgggaggaggatgaaggtgaggaactggccagcctgaggtgaccgcttccacatgttttgtctagaaagttcaggctcacgagaacagatccttcatcaccttccttctcctccagaaaccccagtttctcgtagggcttgaaaagggctgtctactgaactccactttcatcagcgcctaaagcccttaggtcaggtaggtatgtgccttgtcttcctgagttatgacatagctgtgtccctggcccacccagtgtggttctgaatcatttaatcagcacgagtcttaggccgacaccatggtgtgcacctgcaatcccagctgctttggaggctgaggtgggtggatcacttcggcccaggagtttgagaccagcctgggcaacatagccaggccagcccttgtctcaaataaatagaaaaaaaaaaaaaaaaaaaatatatatatatatatatatatatataaaattaaaaaaagaacaagtcttagaggtgagaacaggctcctcctggtttgttacctccatagcacaaggaaaaagagggctcagtgctaagctccccattttgccagggagcttctgtgggacttccctraaaagatccctctctgaagctgagagaatgaactcgtttcactcaaggggaaaccactctcagaaccaccatctctcactgcttagtgatgtgtcctcacgagttggcagacttctcccccaatggtaggaaccgagagggacctggcttcactcaccatcctcagggcagggccccagttcatggctgttcctggagtcagaagctaggggctccttagcgggaggtgagagggagccatctgtccatctagctgcttctgtgtggaaactgcccacaggcgtggtgccaccagatgactctcccccaagggacttgagcagctctctgtgggccagctccatatcctggaagagtcggcgggggaatgtctgctcgagtccttctattcctaaggcccctggggaaggggtctgtgctgggccttggggaggagggtgtgatttaagggtggctgggcgggctgggggaagatccctgggccaggacaggatctaggsstcccgcgaagacacacatctcactcatggggaatggttttggggtgatggactgaaggcctgcagggacccaagccctgcttccctcaccttgagcctgttgagcttgagagtgagctgctcaatggtayggaagatcatgcccacgtccctgagggccaggcytggaggagagcggctggggcgtcttggatcatcgttgcctccctgcagctgaggctgaggctctgtctgccctgcagggaggctgtcaggctgaggggggctcatgggtgcctctgagtggtcggtgcttgagtccgggggtcctgatggcatgctgacataaaagcagttccctgtccccacagtaagagaatgagatcaggaggcaaacagagaagtcgaagctatcctcccgttcctgtgggattccccagccacctgacagagcaggccaggcagtcctctccagacaaactcagagaacgtgggccttgctcactgtctgccagccccctaaaagccctgctcccgagaccttctagatgacacttgctcagtctggccccaagctgggggagatgctgagcgatgaactcaagggagaagtggcagagctgcagtgtttcatttggggaaattggagtggctccccctccttgagtaaacagattgtgagctggtttcaggctcttctgaaaggagcaggcagcagccctcttgccctgcctgactccagctctggatgaactacagccctgccctgcccctcttccatccatgccacgatcctctggaggtcccttgacccaaccaaggggtgtcagagagagctggaggaaggacgtggagggttcctgacaggcaggaagcacagagaaccaccgcggaatctgggaggctctttcagccgatttccacagtgacactggagcggcggctgaggtggggaagtggctgcttgcatatcaggtgaaggacactaggtccccacccccaggccaggcttccctgcccctcccacaattgcacacaggcatttatccctgccattctgaacaggagcctggacaggtggcttcttaaggctggatggacagccagcctttagaaccagatctccccgtctttagagccagatcttcctcctccccattccaggcagctgagggagcttgtgggtgtgtgtgtgaccatgggcaggggtccgactctgccctcacaggttccacactccagtcttggcctgtctttagctccaaggagaaagttattacccgtagcctttgttccgccttccacttcaggtggcccaggctctgactggccactctctggtagtgcagggacaaccttgctgcctgccacctcagctgcaccgacaccaccaccaccaggaagaggagagaccaaaacacaaggaaagggaagggagagagaacaggaaggagagagggcaggaggtggggacagggggaggagaaaatgggaagaacaaggtgaacacaagatcatacacgatgacatcccaggcagtgcagagaactttccaccaattcaccgagagacagagaaggaaggtcagttcccagaaacccaggagacaggtggcccttgggcagatggaatgaaaaatgctgctggaagggaggcagagtggaatcccaggggagggcaggcccactagcgtggaaccccatcccatgtgtgccccaggctttgttctacttttcttgccaccctctcagaccagcccactcttcccggggtggggaccttcctccctgggctcatctattggcctccctgtgagcttgtcttggcttttcttgtctcaaggccgtccatggtgtttcccaacccggggtgccctccctgccaccttgttcactccccacatccctcactcgccaaatgtcttcccagctttgtcctccaccccttcca

SEQ ID NO: 12407 - DNA, 12945 bp, Homo sapiens
tcataggcacctttcactgtggatgttactctaacacaataaaccatataattaacatataattcattcattgtcacatggatattttgtgtctctttatactggttcttcccatgtacatgtatatcctgcttacacatgccaaattaagatagcatggactacctgtctagacttatacaggtgggtaaaatatagaaaggaaatatgatgtttaagccattaaacataattaatatgttttatgaacattaatttattatttgtatataaacattttaagtaaatgcttattacattacataagcattaataacaactatgaattacgaaccacagtagttaaaagaatcagatctgcagaagaggttaaggtttgtatttcagtgatgccacatattgctttgtgactttgaacaagttgataattaacttgtctgcatcttagttttatcatctattggtataaaagtaatatattttaaaagtaggacttcaaatgctaatatgaatattaaatgacttactccatgcaagtgcagagaatgtgcaaaacacagagcttgtgcaaaataagtgttatctgttaatatcatttgcaactaattactatcttttgttattgatgttttagagaatgctttaataaagagtgatatattaaaaacaaaaactcatacttaggaatacttagctatgattattatttatagtatatttgttgttattatttatctggagccaagttgaattcaaacttcatttacttagactgctttggttgaattcatccaatttggttgaataaaattatttggttaaaagtagtctccagcacattccaaagtgatagatagatagatagatagatagatagatagatagacagataggtaatagaaatatatatcatttgaactacattactcttgttttcacttttgctgcctttaaaatgtctatgcattgccactagaaattaattttctaaaattcaagtttagatttgtgtattaagataacagtttaaacacacatatttaaattttcttccacaaaaaactcaatagaaataaaagagtcaggactagatgaactgttagatgacctaagaactgaaaagtgtaaagatatagtaatgaacattaaaatatctataagtttacctaaaaaccttcatgatagctatgtcagtactctgaaatattatataccactttcttttttctagaaaagaaaataatttctgtttatatcaaaagcaccagttgattctgtttattggatagtccaggaatgaacaaaaatatatattgaaaatttaacagcaaaaaacaaaaatcaaaattaagttaaaccaaagcattatatatcctggggaaaagagttcccacaattgacctccaaagttaaaacacttcctcaggtatgagtacatgagatccgactgagggaaatacttatctgcccggtgttggacaagaaaacagaagaggagagcctagaaattaactggatgaaattccacatacaaccgatggaaaaaataattaaagcttggaaaaacagaaattgagaacgatgctctacttgggaaatctggatagagagaatggagccaaagaatgtatgaaatttcccagtcacaatggagttatccactgagctgtgttcagagaaggacatgaaaagtaaatcttaaatttacaagccagagaagtgaggaactatccaggtaaactgaggctactaaaacaaaacaaaaaagcacaactttttagcacaaagcaataatctataactaatactgaacttcgtggcagatatttccatatttgctgtgcatatttagatatttaatattcttattttttgtatccaaatatattctctccttctctctcacacacacagacaaacacagattgccttctttaaaacaatgattttagttttgccatacaccgtttgtattaaaatcattaactttgtcaaatgcatagcccaataagtagttggattactacagttaaagagagagagagagactgagagagacagagaggttagggaattgaaagtaaatgctctttcattacatagactaactctaagacacaaatcattaaaatgtttcctatttaaaattttgatgagatttgtgaagatatcagaaaaaaagttgagaaataaaaaatacaaaatttaatatacaatggagatattgaagaatatattaaatactacaggaaattaaattaatgttttgtaagattgcctggaagatatgtcccagaatttagagaagccacatgaagagccaaatattacatgcaaagagaaaaagttatatatggagaatgtattaatagatattacagagcaaaatatgattatgaaaattctagaaaaaaaacaaaacagaggaaaataataagtaaaattaaaggaaaatatttctgagcttgagaatacttgagtcatgggatcaaaacagactgttttatattatacaaaatcattggaaatacaatgtggcctgttgacatttttgaattaaaaaaaacctacaagttagacaaccaaaataggctcccaaatcgtaagaagaaaagttagacaaaactcagaaagcacgtcttcctatttgagaacttgatacatatttccagaagaagatgacatgataaaagtaattaactttgaaaaaaatgagaactttgcaatttcaacagatcagtggatgaagcacagatataaataatactcttgtagaaaagatgagatattgatcttcaataaagaagtcagcagaaccagtgtgagttgttcaaggtaggaaagacccatacacactcacgacatgagaaaaacaaaaaaagacatggtttcctcactttcttcagtattggcactaaatccccagtgccatgtttattatgaaatggccttattttctgtaaaatagcttttcaagatgatcttctggtgtcagtatattccttccaggctttccaaatctgtgtgttcatataagaaggccaggatcatgtcaaaactaccctttgcatagtacactggtacactcaagaacagctgagacaatcatgaaagtgctagagaaggaagcttacaaatttgggaagatgagtacaatcaggaaaaatatatatatttattgacaacttcgatctgaaaatctaacaaaaggagagtaagaggggaaactttctgttaattaaccccatgagagaaggtgattcacttcagtgcagtggaggggaagaatcctccacagagcccagttccctttcctgttattccctggatgccctatggagagactataaatccctttttgaaaaggctgaagtaatattaaggatgcagtgacccaggcagactgaggagtccctgtgtttttggcaaaggtgagtgtagatgactaagtcataaagagaccgaattcattcaccatgcataaatcatcatcatcatcatcatctcataacctgaagacctgattattaaagaatttagaactttgaataagggtggaaggcaaaggtatttacaggaggaagctctgttcagtgtggttctgggcatgggtatatatgaaacagcatgccacatttataatgccattttctgagagatcatctagtcaagacttgattgaggctctcattagaactgaattgtcatagttcccttttcaaacagtccccaattttctttgttcacttactcatggctgtcttgtgcacttagttataattgtaccaagtggctgagttccaagttaatttatttgatacctaccgtctctacatattaaccctgttgtagtcactatgagggataaaagacattcactgtcctgaaggagaaacctatagtctagagaaggtaaaacaagtaagttgatgatggatcctgacaaacgcttcaataaagcataatggcattcaacacttccaagtgtttcctatattcctaacactaaggttttaaaatacatttacatgtattggtagaggcagtcaactgtatgtaggttagaatgtgtctctagagatacagtgcatagatttaaattctgactttgccctgcattagccgagaatttctggacaaagaacttaacctgtctgtgcctaagttttctcctctgtaaaatggggataatcatttcacctcattagagcattaagagcatgaggtgaaaaatatatacaatgtgcttggaatagtgccagcattagtgacgtaataataccgtatactatactgtacaattctattgttattataaaatgtttagttattctcaggacttcattaaccagtattaatattttctcagttttacaaatgagatattaaaggcatagagaagctaagtaacttcatgttaagtcacagagctggtaagccataaagagaatttaaatgctagcaattttttttctggcatctagacttttaaccagcagtatatattgcttttgtgtgaggagagggggcagaggagggagagatatgttactttaaagtcagaggaagtagcacaaacaggagagaactgtgattttagaaagcaacatgaacaatgggattgcaggggagagaggagtcggagaatgttagcaggtgaagctacagagagttaagagtcagatagttggtgtgaagcttatgaaagagagattggttagagaaaaacatttagaagtattaatagtttaaatcctgtaagcggatgagatcactaagggagtgtataaaactataagaggttgaagtggatgataggaacctggggaaaatagactcttgggaaagaatttaagaaagacaacacaagctaatataagagagaagaggcagaataagaaagaaaatataaataaaataaataaaacagaagcaaaagtcaaagctagaactgcctttaaagctatctgggcgtcacgtcccttgagaatggaatcgtggaaacagaggaacaaagtctcaagcaggagtaatgaaaagtgtcgagtgccagagatgactggatagtttccattagtaattagcagggcattgatgaacgtgatcagtatagtatcagcataatgctcgggaggaagcacacagcagtgttaaaggagaacaagaaatgcagagaggtagattgtatcactctttccagaagttgcctattaaacactgtccaaatctttctgcaagtatttactaaatcctacagcatccttgttagataggtactatttttaatcccattttgcaaatgattacctgatactctgaggtattaagtaattttccaaaagacatataggtaacaatagacaggatttcaatgtcaacttcaggtttacattgtaacacgttagaacagagattttcaaagagcatgtgcacaatggcccagtcgggtagggaaagagcataatataacttctgttatgtttattcgtattcatactttttaattttaaaatttattatatgagatacagatatataattttgtgttattatgccttaatatagtaaatgtgtataacttataaatgcaaatacctatattagagattaagctaaaataaaaataattttaactagtttttttattattaaaacatttggagacccctatttctgcagttgtgccaataaataagatgtacagctaagcaactttgaggaataagaagaactaccttgaaggtttcatttttttttctgactttaaactagtgtacatattgtccaatgtttgatacaaaaaaaaatgtttgatatgaaaaaaatcaaacattggacaatatgtacatgagtttaaagtcaggaaaaaaaatgaaaccttcaaggtagttcttcttacttctcaaagatgtttagctgtacatcttatttatttttttctctaccctctcatgtgctggactatgccctctccatttacaggtagctctactagaaatatggagagcrgaaaccaatcaacagtgactgaatttatcttcactggattccctcagcttcaggatggtagtctcctgtacttctttcctttacttttcatctatacttttattatcattgataacttattaatcttctctgctgtaaggctggacacccatctccacaaccccatgtataattttatcagtatattttcctttctggagatctggtacaccacagccaccattcccaagatgctctccaacctcatcagtgaaaagaaggccatctcaatgactggctgcatcttgcagatgtatttcttccactcacttgaaaactcagaggggatcttgctgaccaccatggccattgacagatacgttgccatctgcaaccctcttcgctatcaaatgatcatgaccccccggctctgtgctcamctctctgcaggttcctgcctcttcggtttccttatcctgcttcccgagattgtgatgatttccacactgcctttctgtgggcccaaccaaatccatcagatcttctgtgacttggtccctgtgctaagcctggcctgtacagacacgtccatgattctgattgaggatgtgattcatgctgtgaccatcatcattaccttcctaatcattgccctgtcctatgtaagaattgtcactgtgatattgaggattycctcttctgaagggaggcaaaaggctttttctacctgtgcaggccacctcatggtcttccygatattctttggcagtgtatcactcatgtacttgcgtttcagcracacttatccaccagttttggacacagccattgcactgatgtttactgtacttgctccattcttcaatcccatcatttatagcctgagaaacaaggacatgaacaatgcrattaaaaaactgttctgtcttcaaaaagtgttgaacaagcctggaggttaatacagagccacaggttcccttccgttgcttttgttttgttttgttttttgagatggagtttcactcttgttgcctgggctggagtgcaatggcatgatcttggctcactgcaacctccacctcctggttttgaacaattctcctgcctcagcctccctagtagccgcgattacaggcatgcaccaccacacccagctaatttttgtatttttagtggagatggggtttcactgtgttggtcaggctggtcttgaactcctgaccttaggtgatccaaactcctctgcctcccaaaatgctgggattacagctgtgagccaccgcatctggccctttccattgctttaatgtttgtctaacatattagaacatgagattactctatacctagtgctttgtcacactgaaatttctgtcatcctaattattttccctatacctagaaaaatatttatactctctgtgtcatcgttataaaagttgctgtgcatatcatgaggaaccttattatgtggctgaataactgtagtttctttcttctgaaatgctgtggttaaagaaaatttgtttgccactttagagggttagaactacagagcttgagcttcagaagctgacaatgtgctctgtggtagtatgtgtctatttaggtaacacatcttagaaaagtttttttgtttaattatgartcatggattacctcattggggttttccagaaatagagatctaagaaaaagcccaaacaacatttaattaagttatatctttatttttagttatgtagttacctattcattagaataattacatgtttagtaagattagattattagtactgccacacatgtttaaaagaaaactacaagataagatactatttacagtaatatactttggtttccacaaatatcaattttagttattgtttgccttttccaaggttaaacatcttcactttctttatttacagtaaaaaatatttggtgtattcactaaatggtagtgtcaaaaacacagatgattcatttagctttttgactaataaatttaaaaactttcctcttctttccatatttactaacattgccttaatttcattttctataattatttatgcacaattattataattatctttaaaaaatacagtaaaattttgaaatgaagatagtgattttatctcatgttttaattttcttctttaacgaatccaataaaatgaccaaaccctagatcatataaacttcttaaaggctttaaacctagaaaagataataatgattctcattttttattgagtggtccagcagtggtcatatcaacatgtgaacacagagaaaacataaaactaccctttccaacatgtatcacattacttcccctaaaaaaaacccctaaaaacctatataaatcctgacaaacagaaaagagtgacttcaatagacaaaatccaaatggtttcctgaagacatagtgcagataaaataaaattcaaaggaatacaatagaggcaagggaagggcctatttagtagaaaatttgaagtaatcttttcagtaggtgttggaaattccaaactgagaacaattgaatggtagggatggggaggtgaaatttatgaatatctgaaatatttctagcatgttaggtgagaaagttgcttacctaaatatttgttccctggtcttcacctggtggatcacatgctatgtaaagctgggctaccctaacttcaatagttctggtttaggttcccatagccaacagagaaaaaaatgcacattggtgattcttcatcatatactttgactatatacatttttctaaatgaattagagctctaatctaacaaggaaaccattaaaattaaaatactgctgttaaaagcagctaagaaaggggagatggtctttcaatcccatatgacattttaacctgtttccttcccaatcattttaaacatggttcatactaattataaataaagaaaacaaaaacttacaccaaaagacttgtacttgactaaaggttgcatttcatggcttaatggtggcctcctcaggaaacatattattttctcatgggaatttgaacttgctgtattatcattcccaggtttccagcaacgtgagttgaagaagaggatggaccaggggtgctggagaatccatagagagaccatagagggcaacttttaccccagtggacacctttaggaactgtcctcacaagtacctgcatgcatagtagccaaacaatttagcccagagagagagagagagagagagagaaagggggagggagagaggaagaagaaacttgtttcttccccttctgtgactaaaagatttacaggaggtattcacaatgtcttatataattcaaccagaatagttcttctataagaattagcaaacagaaaattagcctaattaaaaatatagttttggaggtgatattggtatatatctgaataaaagccatcaacatttatagtgaccttagggatgtactcattagtttagttctttaaacagaaccccaaaagaggtagggtgtagcaatttgtgctttctcctctcaaaagcatatttatgagccagagaggtgtttgcttacttcatgctctaacctctcaacatatgattagaagataaactcaagggtaacttgctcctgaaaatcccaataatctataaaaaggtaaatccgttatatctgcattctttaaaagattgtaaatcaaaccaaaaggagaaaaccaaggagaattcatgtgcacaacatactatatttctaaccagcaaacattagtttgaaaaatgttaaaacatgatacattctatattgcataaaactcttgagacattttcatcaggagattaagatctacaactctttttcgtgatcagttgaaaacatgattttggaaagaagtgaccaatcaggttttaatgtctatatattctttttgcttgttttgagggtatttatatcccctaaacaccttcccaaatgctttgtacatatatgtgtgtgtttgtgtgtgtatttagcatttgtcatttggagatttgtgtgtgtgtgtgtgtgtgtgtgtgtgtgtgtatgaaaactacatggaaatggaaaagtgcattttcaggtacatgatgcacctttggacacaggctaatgtaatttttaaaatgaaaatgttctgttaataataccaaatctttagccattaatcactctaagcaagagtcacaaaaataattttaaatatatgatgaaatcatagagaacttttactattaatacatgaaataaattagtttgtgatggcaaagttagtgataataaaagacattacagaatataaaaatgcaatggaagaagaagaaaatggaatgctccagaaaactaaactagagagttagaattttgacttcagaaagtatcataaagctcaaaaaataataaataaagtgccctatcaagattgatgacaaaaaaactaaatcctagaaatgcaatattaatgaaatacgtattccagaaagagaaggtatagcagactgagaataaaatgaaagtgctacaacagttagcaataaaaaaattaccttaaaacaaaatcagacaactatttatgcttctaatcaaaataaaatagcttgtggtagacccaacttttcactgaaaataatgaggaagctgaataaaataagattaaaaactgcttggaggtattacagatggaaacactatgggcacttaatccccatagacactggggattataattcaagataagattttgggtggggacacaaccaaacgatgtcatgcttgccttaggtagctccttccctttcaacactaaacccatatgaagccatgccccgagagccacgggtttacagaatgagaacatgtaaaggtcacctgaacccaacctgcctaaagcctggtgcctggggtccagaatctgaagtgtagcctatcttatcctgttgcctctcacttacagatttactagcacaaagctaattaattgttgttttagtacccatgtgtaaaacatttgataagtcactatacttggttgtgtgtgtacttcatttgacaatgtaccattctgagattgcataaatttaatatatagtacttactatctgaatcataagataatctgttgagttgtatacacttttgaattgtattgttaatttttaaaacaattctatcattttcagaaagtttatctgtgtcaaatgtgttgttatttaaccacactctgctcatttatatgctaaagactttttacccgttaaacagattttagcttatttataaatagagcaggtgctgaagacttgagactgagtgctgggttgtgaagagatacaaaggagtcaatctttgcaagttgcattttcctttttgtaacattttcttcatcatttttgtggctcataatcacctttacttgatctgtgcttgaaaataaagttacggcatttaaaaagtcttttaaaataaaagctaaatccaaaagctcttcatactgtatagaaataagaaatatgtacaagagatgaaagaattatagaacattttactttatccttattgcttaccatccgtatgtaagcaaatgttttgggttactccaaatagcacaaaattcagatgtattctacatgatattctataactagaaactgctgtgttaggtaagttggccagtgtatctttgtctgaaatcataatcctacctcttagttcacatttatttagtttgttttggatggaaaatttattgtacttttatgaaaaaaatatgacctctttaaagaagtgagaaaatagagaaaacagaagaaatttggcaaatgatatagacaaacaatttacaggcacataaacttgaaagtctagtaattacatgaagagatgcttaaaaatctttattaaggccaagtgttagagcagatgaagagacaaagaaatacatgcacaactgataagaatgtaaactggtgtggccattttggagaaaaatctggtagaaatgaagttcaagtgtatcctctgttttaataatcctgcttctaggaatatttgtcaaagacatttttacacatgtttataagttgacatacctgaagatgttctccagaatgtagagtatttggaggcaatctggagcttatcacggagaaaacaggtacttaacatacgccaaatgaatagttcagagaagcatgcaggtgttaaatattatgagctattgaactcaaagaaacaaaaataattcctgtaaataatactaaaaggtaaaaataagcaatacaatgaaaccaacaccatttacataaataaaaagtacatgggtatgaaacaaaagcacatgttttataagaatacatagagaaaatatttgtcaagttaatttaaatagtgtataaaaatgaggataagtagaattaaagggaaatacataaaaatatacagaatggagtgctatttagccataaaaaagaatgagattctgtcatttgaaacaacatggatgtaattgggggtcattatattcagtgaaataagccaggcacagaaagaaaaactttgcatgttctcactcttttgtgggarctaaaaataaaaacaattgaattcatggagatggtagaataatggttactagagacggggaagggaagtggagaggttggagggggagtggggatggttaattggcataaaaaatggaaagaataaacaagatctagcacgtgayagcacacaaaaaataaatttcagtataaacttagatgtaaaagtgtatttttcaaaaaaacacatgaaattagtgttttgatatttgctttctgagttgacaatatgtttatgtctttccaatatttgtttatgactctatttttataatcacagcatacagatctattatttccctataaaaccgctgcagcataatattctgtgtt

SEQ ID NO: 12408 - DNA, 169930 bp, Homo sapiens
  misc_feature (1)...(169930): n = A,T,C or G, or insertion/deletion polymorphism (see Tables 1-2)
taattgagggaccatggccgagccatgccaggatgaagggagaccagcagaggctagccacagcgacaaccatggaatcccacaggcctgaggaggagggtgagggagtggttactgggtccacgaaaggctgtggctacagtgtagctgtgagagaggacagcccacaggagctgtggccttgtagagggacacagccatggccaatgcatagatcagcagagagggagctgggagaataaatattcaaacttcaccctagctgtccacccctagatctctggctggggcttcccattggctgaatccaaccagaagccaaaaggcaagggtgatgtccataaatgtcaaacttctgggtctcaagcaaaagggggagcagtggggaaatggtctgcagggagaagaagagactattcaacacagacggggaagaagaactaaataggaaggactagggaaggggtgaaagagattgcggtgatggtttcaagggtgtagacttatctccaagcacaacatgttgtatataataaataggtatggatttttgtatgacagtcatacttcaatgaaggctttgtaaaaaaaaaaaaaaataggggcaggagagcgaggcaaacactcggtcttccatgaactttgcatttgggattctgtgcgtggggatgagtgcctgagagatgctgtttggactgccatattcccagggcttccccaggatgggtgatgagtggggctgcccccaccctggggccatacgccaaactgcccgaccgcaagagcccatgctcagagctgatattggttgcttcctcccgaccttggtggggctattttctagggagtggcaaggacataagaatgagaagccacaccagcttggtggagagcactagagggctcactgcgaagtccagcaactttattgtcagctcagagcatctccccaccagaatctcaaggaagcggaagtacaagtggctgtgaagttatctgcgtgtttatcttatcttctgctattcatttcaagagttggagttattattaataagaaggcctggtttctggcagctcttctcttagaatgggtttatgccaagctgccagttatcagaggattcagagcctaggattatgctgacagcgagtctcagagctgtgatgggagggcaaagacacgggaaacaacgttgtattaaagaggaatcagcgttttgtgtctagtccttgatgcccttttggcttcctatttccgaagaacagcaaggaaaatacaaggagagacagactggaatcctgtgaatatcagagaaaagcttgattttcaagagactgctcaagttacagagattccccaaatctgaagaagtaattaactgatgagttcgcatacttcatgcagggtgaactccagccggtctagaaaaacactgtgatggttgatgatttaccatactttgctttcaaccagtaattgtctcagattcttaaccactgatggttttggtgaatgttttggagaaaaggctcgagagaaacttcatgacactaaacatactctctgagaagtgtggtgctagaatgctaaggtgatgtcctagacttcgcagtctcttaaacatatctgacattatattatgctatggcatgctatgctatgctatgctatgctatgctatgctatgctatgctatgctatgctatgctatgctatgttatgtctttttaggcaatagctcatccctccctaaagcagagtgaatgctcttatttagcttaaagacagtcattggactttgagtaaagagtcattttcttgtacgttccactccaccctccagtgtacatttgcactctgctggcgaatgaccatgagctattaaatcatgacatagaaaaagatgacaactgtaatgttgggagtgacccccaagtcccacctactgaaggaacaccacaagccttcctcactttaaaccatggcatgggggcactatcaccaagcataagaatgcccagcaatcgtctggggccatgttgggtgggcagagaggatgaggcactgagttccttcagccacgtcttaactgtgccatgtcagagagacttttcatgttgattgaactgtgtccaactcatctctcagcaccaatgcgaacttattaaacagctcttcctctaatcttttttcaaccatctactcatcagcagactagaaagaagactggctcatttctttttcctgtcagccaccaaaagggcctgggagctttgataagggcctcgatgtggaagaccacatagatatcagcaaaactgtggaggaagaagtggtctgcttaaaacctaagaggacaatacaggtactattccacccactgggtggtatttccaaattctgcacagggggttgtagctatgtagatgaggcttagagagaattcactgaccaccagaacaaatattctcagttgctttcaatctctgccagccaagtcatgctacagaccactgtcagatgaaaaaaaaaaaaaaaaagaaagaaaatcagaaagaaaactgaagcaccaatgatagccatcttgtgactgtgaccaattgcctactgaacagttcttaatgtcctgggccccagcaggaaaccactgaatctataaagtcctgtccaccagaaatgagtctgattgtggatggcctggttaacccagattgccttcggtgcctgagggacttgatattttctcattatgaagactttcccatctagtgaacgctgcaaataaaactgctcagaatcggtytgaactgcctgtttccgtggtagcaggcctctgtctggaggataaatctgcaccatcttcttttttttttttttttttttgggtttcagccagttgtgttacaaggagttccgaaatgtgctataagtgacacccaacaagatgggctcggccagttggagagggaagctttgtcaccaaagggacttgcacccctgggccagacggtggtgtccaagagaaagtgatcaaagagayacagaacccrcatgcctaaatatttatttcagttgttcgtatttcccacacttttcaaatgtgaacttgtgtcctgaaggtggagctttagtacacaagaaaattgggaaggggcaaacatgtttgtacaaaatgggggtagaatcagcaaagaatgcatttatatgcttcctcgtcgcctacgtttttcatgccaaaaagttagcacagattctgatttctttcaccgtaggagtctgcatacaattaaatgggaggcaaaagaagcccactcttaagagtrgggcttatggtcccagtagaatggcagggaactgtagccatcaaagccatttatacttcttgtgggtagtatttttaagatgttgtttctttttcaaaatgaagcagcratgaactgagtagtgatcaaaatgccgcaccacagagtatgtttaatccaaatagctcccaagatggtctgtgactgattgtaccaactctacgggacttagagaaatgacttggttaccagtgaagtaaaactatctctggaatggaattgaactgttgcttctcagcacatagcgacactgccaccgctggttcacggagccagtgaaggtcactgagttctgcatcagtcacagggaaaactgtcaaaacaccagcgcataaatcccctactatgctgtggagggggtctctgagcttcggatgaggtttttaaaatattgatcttcccacttccagaggtgcaaaaattctgaaagcattccaggagggcagggagtgggggagcaaggccagatattttggagcaggtgaaacatctgacttgtcttgcctgagatgtcccgattaacaccaactgggtactttaggcctttccccttcttcctcccctctccttatggacactccaacaccatcatcacagcacaaagggcaacctcatatctcgtgggaaggcattttctgcctcctgccaggcaaagataatgttatccaattgcaaatgaaaggcttatgaatgaaaagatgaccactctgactttagtgtatgagagccactgctgaaatgataggatccttgaacttcacatctagagcagaaactcacacttctcttcttctccctccacctcacccttctttccttaagccttccagaactcctgccatatccctcagcactggggagaacttgaagcactgttggagaagtttgaaacctgcaaccttcggcaggactcagcatgggacaaaagccacctcattcctttcccttcccaaaacagcatctcgagctggggaacttggagggaaggaagaaaggggatagcagccaattgccctccctggggcctggggtctggaaatagcctgggaaggaacagagatcatttcccaacgatccatagaggtcctcagcaccctccactcctatgcaccccctggctcatctgccagactgtaagggtgctgatggtgcccgcagctgccccgggaagctgggaggcatttgtgcatcctctgggaagccccattccgagaaatcatgaacctattccccagtgggcaatgattccctgtgcttcagaaattcttggcggctgtgggggcaacccagctgttattcaccctctgggtgaggtggtgagacctcagggggtccaaaggataaaagtgggtaatgatgagacagatggagagcctcgagggaaatacggggacttgggtctaatagtagaaagcagggcgggggctggttggtgcatttaacttgaggaacttttcagtctcactacagagaatgatctctgggggattatggcaatggccacaggtggcacttaactagagccaggtatgtaagaggccctggggctagatatggattcgaatctcggctctgatatctaccagcagtagaatgccagcacgttccacaacctttctataaccattctcctggactactaagtagggatgacaataacagtcactaattaatagggctgttatgagaattatgagtcttaacccatgtggtgagttcacaagcgcacccggcacgtagtaagtgctcagtaaatgttagccccgctcattaggttagatggtgagcagaactttccaagtgctaggcttgagagcctgggactctgttgccaagggagattagagaacctttgcaaatatgggcgctccggccctggggattgtccagaacgagagtgtggcgcctgcctttctgccacctcactcatccgacccggggaaacccacaccctgtcacaggggcgccttggtccccggagtctccggctcggccaygtctcccgcgcgcctccccggggcctccctctcgccgctccacacctgtcagccgctctcgcagcagccctgtggcccgagcccggggcctcagctgcaaccccttcgcaccctggatcctcgctccgcgcgcctggcgtatccccgacccggctgctgtcgtaaacaaaaccgggcgttggagcagcaccgcgggcggacgggcgcgggagcccgctccgtgcgccgttagcgcgccccgggagccccaggcgagccaagggggcgatggtggcggccgcggcggccgcggcgggcggctgagctttgttatgaatagatgaaagaggccacctacacagtaacccaaattacgagacctccctcctccctatctcaccgaatcaagaggggaggggagatgggcgtggagggagggcgggcgggcgggcaggaggcggagggcggaggaggaagagaggatgaggaagggggccagttgcatcccactttcacaatgggaaagtgaaacgcacaagcgcacccaacctctccagccctccccgcccgcctcgctcctctccgcccgtcccctcccttcccctccgcgcctccccgcgagcgccagcgctgcacacaggaactctccggcgaaggagggcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtytccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactayacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgcmgccgccgaggcagaacgagctgggggcgagcggcggggcgggggtacagccgggtgacatttaccaggtctcaggttcacaccgcgggcggccgtccgaaggctcctctcggacggtccccgagacctggagcacggcctgaggtccccaaagggagagtgtaaaaaggggggcggggagggttggagttagactcaaaactctagtggctgcatcccattgccatccttccctgtccaaacggggacgcttgtttggggctgagtctcctcgcgcagcccctctttcccattcgcttctccagacttctctgtgccccttccgtgtagtcccagcaggcgtgkgggtctgaccctcttggtcaacagttagcaacacagtgccctcggcagagaagccattgaacctaaagggctccctgccacaccccagcctttgtggccccctgtctccgccccccaccggcaacgcaagtgctgtggtctgaagagttgctagcccgctcagcgtggagaaatgccagcctgcaacagaggcttgcgctggaaccgaacccctggcgtgagccggtgcgagggggcggtgccgtggctctgctcagggtgcgctgtggtcgccagccgccgggagaggctgggcgggaggtggccttgtggtaaaagcctcatcctagaggggagygcaagggaaagtgttgggggtgctacaggcagtttctgggctccagattgcgagactagatggcgggactcagagtcaccaccctsgggctgaaccaggcaagcgayacaggtttcccctgggctcccagggcagccacagcttttatcttgagattggcatttctttgactggaaaataaagaggcagttcaagagggtccagttgatggggattatggagccattgtgcacttctccggaggccgtttcccttccaaggcggctggcacatcaactccacatatggctcctgagaggggagcctgctgggagcctcctttataactggacaaaaatcaaagcgcagaaattaacggctacaggtgttgccattgttttggtacaaaatgaatcagagaggaaggggagaagtcactgcttggaaaatgtgttgatacaggggcacgttggctcccaggtatattaatatgtgtatagaaagacagcttcccccacccccttctttctctgcaaagcacatcttaccaaatattagccctatgagccagggagaaaaaaaccaggaggtcttttgcaaggcttcttagaacggtcacttgctgctgctkctttgcctgtcaagctgtgtgctgggacacacacattaaggccttcattttgttactggtataatttttaaaaatatgtaaaaacacatatttgcctcctaaatgacttgctgttgccgtacacatataatgtaatatttgattcctgtctttattagatctttataatctaacggtttaagtttggtaaaatyatcgtttcctacttctctgttgaaagacttgaaagtacccccgaaatattactttgtgtcaagctttagacacacttagtctctggggttaatgacaagccagctcagaggcccacagcaggtaatgagggtgaaagtccaagctttgccatctgacagctgtgtcgatgtgtggagccaaaacatttctcttgactgcgtctctctacctattgggtcctggaagactcagttcccttccaaacccagccagcatcttgaatgcactcaaaatccacgttttggctcaatcaggtgttcctgcttgtgccgggatggggaggggcagtggcagaggaagtcgcggagcttctgcgagagagctgccccttggaaatcaagcaaaggataaacacatgctgccaaaaatctggaactggaaaaataaataattaaaatgggtccctccacagcatttcttgctgctatttatcaagaactcccagtgtgctcagagctgtgtgttctgaaagacagggtctgtaccccctgagcttgtcagccaagttmaataatatactctggttcaaacaatagcatgtcatggctgcacaggtgggagcttggagctttgcatttttttttcatttaagtaaattccttgctgctagtatgcattgaaaagccttaatggaattgaatttcaagaggagtttgaatgaaaaagggtggtagttttgatgaaaaagctgacaattttctaacctattaaataggtagagaagatactcaattcaacaaatatttgtttgatgcctgctagtgtaagcaatgctctgtgctgggtgccactgattttgccactgaaaggacgatagcagattgcaaccttgtgtaatggggtcatgggatcagtgtgcccctggctgtcactcagaagaatgatgtcatttgattgcatttgttctgcattttattttcaggtcttgaaygtgtttttgaaaaggcatgctgaattataggtgcctaaaacaggagcaggacttgaaacactctagagggaacctcaatagattccaacagcrattcctttagagcagacacagtaattttaacagtaatccacaggctgcaaggcacaagcggctggatttgcttgccttctttctccctctcctcctagctggctcttattttccgtcttcaatcagccataggtagaaaagtgacaggactgactgggttgtattttcccactttctggttctcttatctcttgtcactgatcctcctctccttcagcttctgctaagcagtgatttacgagatgcttgtgtaatgagtgtgtactcagctgtttacacactggaccattactttttctgccttgccaccaactttgaatccactttcataactgtagcaggttaactgcagctctcaaatgtgctaaggcaaccgatttctgtagaccctctctctaataatcttctgtgatatttgtacagcacttccacatgtattatttcttttgagccccgcatcaagtctgaggttgattctatggggatgatttcattttccagatgaggaggctaaagatccgttaagcagcttgctcaagatagttaagtgccaaagccctccaccttaaatccaggtcttccaatgtctacatctctactcttcccaccaccccagggtttctcgaactttcccttgaaggtcccctaattaaattggcagcaaacaacctcccctaggatgtggggttgaggctagagggtaacctcagaaggcagtacatgcctctaatcttggcttgtgttttagaacttcatgtggtctctttcctttttttcattcttttttataacacacctgtgcttggattagtataaaaatgaatgtttttaattatgcacaagttaatcaatttgacttcctacctttctgaactctcactacccctggcacaccaacgtgatacacagaaagtgtttgtgttcgagtttgtggagtctgattgctccagacttgtttggccaccattgttgggttctggggtcactcgtggtttaaacatggcagccacccctcggtagacattgagggtagtacgttttcctgcagtattggtccacaggactctagatcattctagtttgttctctagttcattctaccctttgtagggggacataccrccttcttccacgcctacataattctaaagcctgacataatttaactgtcatgcagacaaccacagaatgctcacatgctgcccaacagagagcaacccaaggaacatgtgtggagaagtgacatcccagttccacttggcgatgcagcctattgacctcaaaatccgcagtcttcttgtgatgtttatttctcttccagcttctgttatgattttgtcaagccattttgcagtctatagactagatggtgattttaccctcatatacacatattatatgcaaaaatggattcaaaaaggacaattgccatgacagcacccacttagaaagaggggaaagcaatcatagctactatctactgaatagttattatggccaggttttgtgtgaagcaatttacatgccttattttctgttgattctcwttcaccatatggggcaaggactgtagttatcatgatgattagagatgagaaaattaaggcccagagagcttctgttaggttccatagcyggaaaatagcagaggatttagaacctgggtggtccagctctacgacctgagcttttagccaccttacaagtctatattaaggagccctaccctattactattaataatcatgatggtgatgatagtaaagacatccaaagcacacggcattttctatgggtcaagtagtgcttattctatacacattaactcatgaatccagagaatattgctgtcaaggaaatgggattccccacttataaataaagaaaccaaagcacgaagggttaaataattactacatgcaataatgtgtacatgtccactgccatggacagtctgtcagcatggacattaggtcctgatgtcaaccctaacctgtatggagcaagctaagcccttgcaactgctatgctaagaccagctttttgtggacacaggcataggatagcagagaatccttagttatgagctgagtttctaggtttgcattggtgaccacctgaagttctgactctggcaggattgtagtttcttaactgtgaacttctagacagtgttggtgttctgatctatacatcatctcaaagggtgttctctgttgaaccccccatacctagcatagtacccagtatgtagttgggacttcagaaatatttgttgaatgaataaatgaaggatcgtagagaatcatgttggaaatgttttctctactcagcagcaacactttctgggagtctggtcacctcatactcccttaatcattgtctttttcttaatgcctgatgtgtcagggccccttccttccttagttttaggttacatggtgtcctttactccttcacctcttcccaggtacttccattcattggaataccaggcttctggtgttgccaatctgagagttacttttgaccatggaaacctagcatggttggaacttctrtggtgtaatttttgattgcctttcaactatgagaggaaagggctttatgctgtaggcagtggtccttaaagtgtggactgtggcccagcagcatgaatatcacctgggaacttgctagaaatgcacattcttggaccctacaccagacttactaaatcagaagctctggaggttggggtgggactggcaatctgtattttagcaagctctcaacgtgatttgaagtcatgcttaggtttaagaaccactattgtaagataaaacaattttccttgtgttccaactgaggcacctaggataggaacttgtcgcattttttttccccttgcattttacttagggccataaaaagtaaccaacacattttaccacctgatattccttattccctcctcactgatcaaaggcagtacctagaaagccctttaaagacttgccatttttgggcttagagtctgagtctcaaaaacctgtaagccatagtttaattagctccttcactcttgcatataacagtttatttgtatttcactcccagatgtggggggatgtctagagtcgtctattgtgctgtacgccagaaccaattccgcacaccagacattctctccaagggtccattctttacaacatcagtcctgttaccaatttctatcctagtcatgtacagttggttgcatggaataaagatctacttgagtaaggtcagataaagggatgagggatattgtggacagaaacacatggaattacatggtaatctaggaataaaagcaatgctgtgttatggttatgtgcacagtcactggaaccaggtcaattgggaccaaagctaccagttaccagttgtgggactgtagacaaattattcaacctttctgtgcctcagtttcttatctataaatagtgatcctcttggtttcataggattattgtctggattcacgagttaataagtatagaatgaatactactaactacttaactcatagtaaatgttatgtctgtgtttactatcatcaccatcattactrctaatagtgttaggacgggctccttgatatgcagttggaaggtggttccacattcaaggcagcttaaaggagctcagtcagcatcagcaaatgatggatgctccttccttagtctccctgttaacatgacttagcctggctgctttgcaccatcctcctaccaaataacctcctctgcttcctcaaacatctactcyctcccacctgagtatgcctcaggcctgccttgatccccactgtctatcttttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttyttttttttttttttttttaaacagagtctcaccctgtcacctagactggagtgcagkggcatgatcatagcttattgcggcctcaaactcttgggttcaagtgatcctcccacctcagcttcccaagtagctgggactacaggcacacaccaccatgccaggctgattttttttatttttatttttggtaaagatgaggtcttgctatgttgcccatgctggtctcaatctcctgagctaaagcagtccttccgaagtgctaagattataggcataagccagcacacttgcctcccactgtacatcttaacagcctgtcaccttcggctttggctactaactggcaatgactttctgtattatttagtccaagttgccaggagagagatagagttgagtccagttcatctttcccaccagatgatgagcccgagttcagtgtagggatttgtaacccttggggcaggtgctggcccctggtccgactagaagaggatcaaacatgcaattgtccccagcaggtgctgcaggtggattcccttagaacaggatggcggaagagccacaccaagaccaacatcttgattacagtagcatacagtagtgtcaaatctgcctcccttaaagttttttgatgaccactcccttccccaaacatgcattggcacacagatgatgaagactgggaaaccccaaagtcgacttgggaacagtgtgtggccagcatgggtctaacctgttcatcaaagtggggccatggaatggtaggttttcttattatgttttttatgaaatgtgcttatcatttttcttagttttaattttctatcttgatgaaatgctaatttttacatgatcacaaaaacaaatagaactgtgacattcatttttcagtttcagtagctgattttcatgttggttggattgtctgttcaatagctacacatagtgctttccttagagaagttactagggggatgtggccctatttccatcccaccaccctggtcaatgctgttatgcaggggtcagcaaactctttctgtaaagggccagatcatcaatattttcggctttgcaggctgcatacagtctctatcacaactgctcaattctgctgctgtagtgtgaacacagccatggacaatacataaatgagcaggtagggctgtgttccattaaaatgttatggacaccgaaatgtgaattccctgtaattttcacttgtcatgagttattctttttttgattcttttcaaccattttaaaatgcaaaagctattcttagctcatgggccgtttgaaaaacaggcagcaagccagatttggcccacaggtggtggtttgttgactcctgctrttatagaaagaatgagagtaaaacaaacctttcccatacagtctgatgctcatggcaagagagacgtgaccaaaagctgccgtggaagtcccaaaaagaggcactactctcagcctgggaggatctgggaggcttcagagaggtaatgcttgagctgcatcttgaagctgagtggagaaggcagagaagggagttctagagagaaggcacagcttgtgcacaagcaggaagttgagtaagcctgggagccacaagcagctcaccaggctgcggaatgtccagaaacgagtgtgcaggtccagatggtgaagggcttaatgagacgggcaaaggtggttggattttatcctgatggttggtcctctagactttccaaaccttgcctttaaaataaattatcaatcggaagctccctatgagaaaaaggttagaaaattatcattaggcagggagcagatggcgcatgcccataatcccagcaccttgggtggccaagacgggtggatcacttgagcccaggagttttaagactagcctgggcaacgtagcaagaccccatctctacaaaaataaaaataaaaatcttagccaggtgtagtggcacatatttgtagtccaactgcttgggagtctgagacagggagatcgcttgagccygggagttaaaatccagcctgaacaacgtaacacgaccctgtctcttgagaaaaattatcattgacttggttctttttgtaagaccaattaccaagcgctgggaacatgggaggaagcaggggttgggagtttccggagccctacaacttgccacaccccatccgggcctgtccctgaggcatctccaaggaacttctagagcagggtgtgaaaaccatggctaaggttgatggagtaaaacagcgggattataaacagacacaatctgaatgtgttctagaaagattactcagaagataaagtggctgcaataaggttggaggcaaagcaccttattagaaggactatcatttgttcgaatactttcttgagctcctattatgtgccaagcaatgtgtggagacatttatatcatggtaaatagggtagacaataaacatttggcaaattaatagttacttttacattaagatgatagctaaaatttacagctcacctactgtatatcattattctaagcactttaccaatattaactcatctaatcctcactgcaactttacaaaatgggctgtattattactaccattttaaagatgaagaaacggaggcacttcactaaacaggtaatgtagcagaggcatttgggggttgcaggtgttggggtaagttctctttaaggaggccgaattgacaccaggaagataagaaaggccggttgcaggtttcccttgcagatctgggaagagcagtgctggcagactggagggcatgtgcaagaactcaaagatggaacatcctggtcttggtggttgtggagagcaaaatgctagtgtggttgaggctagggaggtagaggagagagtatgaggggaggaggctggagaaggaagcagcaggcccagcctgcaggcctccttggcaatgggaaggagattagattttcttctccgagcacaggagagcctttgaagggaagtgaaatgattggatttgaattcctaaataacggctgccctgtggggaatggatgagagattggccacagcggaagaaggaaaacctgcaggaggctcttgcagtagtccagacaagaaataatgtcaccttggccacgagcagtggtgacaaatatggagagaaacagatggattttgtttattgcaatcattcaactgagggacgttgaagagctgaactgaggttgcagcaatgaggatggagaggaggggtgaagtgaaataggtttttaagacgtggaggaccaattagaggatgagtttaatttttgttgatttttagatgccttgggacatacaggaagacaggaagagttgctaagtagsgagttggcaatgaagttaggagttggggatccactctataaaccttagagtgtgccaggccctgtgtcaggccccacacatccctgtttgggctatatgtgcactgaggggagtagccaggtctggctcatctttctttcccaggcatctatcargttggctaacacatggtgagtgagccctcagtaagtgtttctagaactggaaaaaaggtactcttcatctggtggagaagatagtgattatagcatggtgagatgagtgcgtccaagaggagttgacactggggctctgttttgaggaaaagtaaaagctgggcagcaacagggaagtgtatttccttttgactcccttcccaattagccaggattccttgtcatcccctgtctccccgcaacctgactgaggaagcgtgttacctaacacaccagctgttcctgatcatcgccccttggtcttctcctgaggctcctttctctatcattgaccccttttaaaaattggattccgagtgcaaagccttgcttctctgaggcaatagaggggggaatagcctagagcagctggtggctgtaggtgtaacctagtgtcagcccccgcacttagcaatatgtttcttcataaccctgcagagctcttgtgctgtagacctctaatgcagcctgtagaccccctgacagaataatgttttttaatgcatgaaatgaaaacattggattgcaaaatagatgtaatatattaatatatcgatctatcaaaatgttttttcaattaaaggtatagtaatgtatcttaacacattcaatagcaagatatagaggcagtaactaccataatttcaaagtagagatgagcataaatgatactttgagatatctgcaacaactatcaaataatatgaaaatatctgatttcttttggtgacaaagtcacaggttcagtaaatactgctgtggcctgaatccrtgattaaaggaaatgctaagttccagttagagctccctggaataaagatttttttttttcatccagtttcatggattccctgaattctgttcatgaactgtggatatcagtggagccccactctaaccattcatttcagttaccaagtgtttcagaaaccaatgacatgaaatgcaaagtttagcattttatttcaaaactcatttgactggtttattttgacaatagggagtttgttcccatctgtattttacagatcaagtacttggtcaacagcaagtgctccataaataataggtggatgagtggatgggtgggtggatgagtggatgggtgggtagagaaagctcagaaaggataaatgactgtctaaacacttacagctcataagtaatagagtttgaacttgaaaccacatattttttactctaaatcacttgttctttctattcttccatgctaccatcagctacttttatttgaaaggacacaatgatagggcatgttcttaaaaatatgcatttgaatcatgggaaaggacaatcctattattatttgctttggtcagagcacacctaaagtactgtgtttacttcttagaagcacattttaagtacactgaatctgttgactgttcatggactgagatggcgagagacttagaaattgtctcttacaagctatcaatgagctatggatgtgaaattcagagaaggccagtttacatggtaatgggaggtctggggtggttttctattgctccccaaggcagaaccaaggcccagtatttacaagggacgaatcttggctcaattaaagaactcagtaatgattaggcctacttatcaatgtatcataattgcctgatgagatattgactgaaagtattcaaacattgacccatgtatttatttatccctttgataagcatttattgacaacctactccatgccagatgctgaggtggatgctgcattcgaagtgtagaatacaatactattggagatagtcagtcttataaagatggagtctactgggagacagtaagtttttaaaaacaatagttataataagtattttgaaggaaataaatggagtgctgtgattcagaataaaaactgaggtaggaacgggaagagctatggtcatgtgtccacgagtaggtgacattcaacttgaaacctgacagattgaaaagagccagcctacaagggagtgaaggggggtggggctagaagaagtagcaagtgcaaaggccctgaggcagaaagatggtaatgtgtccagagtctgaaagaaagtgactggacttggggagcagaagcagagtgcaggaggagaagaatggcaaggaatgggtgtgaagacgtcatcagggatcagctcagggagagtctggggaggcatatggattcaattctcagcattgtgatgggaagccattggagaattttagtcaagggagtaacaggacctgtttcatgttttaaaagatcactttggctactggacagagaataaattgaaagttaaaagggagacaccaagagactcttgcactagatcgggaggggaatgaatgggcacttgggctgaatagagcctgtagagatagagaaggtgaatttgagattattgggaaattcgactgagatttttaatgtattggatgtggggagtgacagaaagagaagagttgagggtgattagtggtgctgttgaccatgatgggtagcaggaccagagggaagaaaagtctagataaccatttgtcagcacctctgaaaccatgtcacagatttcagtggttcttaacaggggataatgacatttacttaggggatgttgagaaatgttggggagagactttcacagtagtcaacataatagagggcactgctttgtggacaggagtcaggaatgctagaagtcccgcatcacacaggacagctcccataatgaggagccatcccatgtagaatgccagttgtttcctcctggacaagcactggtggactgagtctctttcaattctgagaacctagggccaggtgcggtggctcacacctgtaatgccagcactttgggaagctaaggtgggcggatcatgaggtcaggagttcaagaccagcctagccaacatagtgaaaccccatctctactaaaaatacaataattagccaggcatggtggcaggcacctgtagctactccggaggctgaggcaggagaatcgcttgaacccgggagtcagaggttgccgtgagccgagatcgtgccactacactccagcctgggcgacacagtgagactctgtctcaaaataataataataaaaaaaagaatctaggaaaatgcagtttcacgctatctgccattcatatacttttgtaaattatttgagtcaggtcgtctttttataagtaattgactgaaattagccatagggaggagaaggaggttgtgggggtggggaagggacataaagcgggaagaaggaaggatgaatcttggagagtgggactttgctggtgggttggcctgggtggctgggaacactggggcccgtcgagggaggggagagggtagaaggaggtgaaatacaagcttcaccaccttgcatgcttcccacggctgtgctgcacaccagtgatgttttctggtctagaggctgcccagctgtgtccctaagcacactttgaacctctccttttggtcatttgagtccccagtgtaaattcttccttcagacgatcagagagctgccataacttagtcagatcccggtcaacactgtatacactagaatggagaaaagcaacccgagccttcctagctaataaaatcactgtccgacttgggcaaatagttgtcctttccatctccttagctgaataaaagtaatctaattattttcaaacacatgatttcatctggacctcacaacaacactgagaggcagggcatgtggtattattaggtccattttacagatacagtcactgaggttcaggagacttaacttgctggaatcaagcagtctataaggcacagagcaggggccagaacttgggtgcagggctccttcaggggtttcctaatggcaagtgggccccttgggaagtaacagaaaatgatgaaactgcttcaaaacaaagggatcccaaagggaacagaatataaaattaactgcccaagaaaggcattttgtcatgtacaagaaattgataggtacccagttggtatttcctcccacctggtaaggtaaaatcaacatacaggaatccttttagcaccttgggggtaaaacacttgactcttgcttggtgctcaacattggaggccccagttttgtgcccattccctcccgatgatgccgcaaaagctggagcatggctgtgagcaccctgcctcgatgagccgggccatctttcacatggtaggggcagggccaagctgtggctcagctctagagggtgcctttcacaccctggaatgcatgactggcaccccctgcagttgtgcagggcacaatgggagagtatttattgtccatgaaaaatcatatgaagcagctgcaaagaagtctaattgttttcctcatgatatgcccatgactycctgcacacacacacacacacacacacacacacacacacacacacacacgtacacacacaaacacacacacacctcaggagctttggtcccagtttgctatatcaggcccaaagctctttctctctttcagcccaaacatcgyttgagccaaggtagctttctcctccaactgagaaaagtttccctcttagagccggcaaacgtgtaggcgtgacgttatgcttagacacggcaggaaggagaagcagagtgacaactctgagggaaccaagaaagcccaaaggggagacaaggtttagagcgaaatcaagatcggattttgtcatgaaaggcagaactggcaaaagcatcattacaaggcattaaccttgttacacacagacgaacaagcagaggctgggattcagaaataaattacacataataaactagacagaataggctgagagcaacattagcgattatgccctaaggggagagaarggcaagatakaaaatakgcccgaaaaaaagagagaaagaataatctctggacacagggggctgactgcactgtttcccccttcttctgcctggctccctgggtattaacctcacttttgtgaggacgtttctccggagcctgtctttcttttgttttcatttgctgcaataagcataagaaagccattcaaagggttccttttcccattcacagggacctgtccatttctgtgtgtttccagcacaaaagaatccatttccattcagccagagcagcccctagagttttcatgaggtccaagcctcctctcctgttttcttccaggctcrctgttgtaataggctgcaaaatcctgactgtggccagggtcctccaggctggtgagaggaacaagcatttgtccacgtcctggtccctgcagctggggaagaactgcagtttagtgtccgctccaacaagttgtgattgtcatttcttaaacagtgacttscttttggttccaagtagcagaaaacgcaaccaacagtggcttaaaccatgacaactattgttaacttagtaamatgtttaaaagttgaaggtctgcggctcagtggtgtctccaggaacatagaatctcttttctttcccctgcaccaatcttagcatgttgctttgtatccttcatcttgaatctcatggaaacagaacggttgccacgagtctatgcatgatgagatcacacaactgtattccagaggaggaagtgagggaagagggcaaacgggttctcctcaagaggcttctgttatcaakgaggaaacttattcccagaaatccttccagtggacttctcacatctccctgcccaggactgggccacatgaccaccctcagctctaagggttaggaaagccagtgtctggcaatagggaatggagctgccatttggcttggcccaacgatagcttccaccaggcttgggttcattgctgtctgaacaaaattagggttcttcttggcaaagagaaaataactgccatgggtgtggcagtaacttgtgtttttaaatgaagtaatgatagcaagcatgggttatgtgttgctatgtgccaaacctgttctaagctttactgaggcttacgcacaaactcacccagtcctcataaaaagtctgtggcataaaaagtctgtgctcttatcatcatttccatcatatggaggagaaaactgagtcacagagagattaaatcacatttacaaaattacttagctagaaagtgacagagccaggagtcaaacttaggtggtctggctggctctctatgctatactgccttcattaggtaagatgataaaatacttcaggtagcacacagtaagtattagtacatgttagctggtattattattattattattattattattattattattattattactatcatcatctcttttttgtaaccaccctgccaatcagacacatcagccttattagatactagaaagctaacccctaacagcattaaattaattgcccaggtcacacagtgagtgagaaccaagctcaaatgtaaacgagtgctgggtgttctctcaagtttgagaatgttgatttaatggctgcaccacttacccatgctacttttttttttttaaggtaaggtctcactttgttgtccaggctggagtgcagtggctcaatcatagctcactgtaacctggaactcctggactcaagtgatccacctgtctcagcctcctaaataggtgggacaacaggtgtgtgccacacatctggstgattttttatctctgtagagatgggggtcttgctatgttgcccaggctggtctccaactcttggcctcaagcgatcctctcgcctcagttacctatactactgatcccggacttactttgaaaaaaaaactacaattgttgaggacagccagaaatcagagaaggacaccgggaaaggtgagatggtaatttgggacggatttttccttgttccgttttagcttttgagctgcctctgttttcttggatccagtcttttgcaaacaggatctctcatcccacctcaggaaaggctacccatggttcttggtgaattagaacaggtacagtattaagcacctactgtataccagacctggctgtacactgtcccacctggtccttgtggataatctacagtccacatccattactttttctgtgttgtgagatgaagggaatggagtcctctagccagagatagtggtattagaacattctggatacccaggcagagacgatgccctattctccgcgttagcctctctgcagtgttcaaatatttaataaaaataacaggcatggtcagctgatcttacgtttgaacaattctggatttattttaaagcaagatgtgtggcatggttttacttatttttttaatcctaaaggtcatccgacttttctttttctgctcatagtcatgaggcttccttatctaaacagtgatctattgttccaaccttagacccacagagaatttttttccttaacttcaattttcacaggacagctcctcatcttcccatattgcatgaaaagtatctttcaacaagggaaaaagaaactctaatgagctttycctaaatcttcttaaaccgagttcactatagaatattttatgcaaaaacattgccttctcttaggttatgacatcttttccttgaaaagtgatcagggcattggacaaatcctggctagcttatcttgtccttgcagcgcaacctcaacaaagaaatatagatggcactttaaaggcttcagaaatcaatttagtcccataatccatttagtttagatgttaatgaaacttggtgggtttaaaaataatgaatatttaataagacataaattgaaagacataaacactgttggcgataatataatgaagttaataagtcttagcctccccctccccaaatagggcgattttaggagttgctgtgttgcttactgaagtttgctggctgcaacttcaatgtgcctttaaaaaccttagtacagttgggaactgagctctggcagataaagtgtgctatcacactgtgttcagtagctgcagacggcaacggctcttcctagctccatatcttccagagatttgtgtaacaaactcagtttcctgtcgttgaaggcaggatgcagcacgaagcacttcattccttttaaacaaaaaagaaaaagacattttggtcgacactctctctgctctgggtttaaagaggggctttatttaatgatcaggaccaagcgtgtgattacatgtgctcagagcctcagacaatttaaatgccttcaggttgggagttagactttttgttttcccctttaaaagcatcagcaccagggccagcccttcaacttggttcctccttagctctgtggctcgatcctacccatcgtccacaactgtatctttaccttttcaccccctcaactagctaccctgtctttrggcttcctgtggtcccttttggtaaatctagaatccctcctttctgccatcacacccaacaggatcgtccgtgtcacatcttgggaaatgtttgtgtttaacctcacagaagccaacgcctagctaaaatgaattggcggcaggattttgaaaacagccaagtataagatagtctgcctcccaattcagcggtgggctgtctcttggcactaaagtggaattcagcttcttatatcagctgaggggtgttagatagatggccagctcrctytggcactcaatacctgttcatacatagtaaacaggggttttctttggttgggcaggtatggtgattttgcaaggtaatgaaaggttgctcccggggaatctagtctaagaraatatatgtggggcccagaagtgagatcctgcctaggagggcatgagtgacatttcatcagtataatgagaastattgttgttaaaaattattattatttttttgtgcgtttgtgtgcatgttcagaaagaaggggatcarcctgaaagagtccaaccaatcgcatcatctaccttgatccattccgacctgacatccgtttatggcaccgtggtaatgaacaggactgttttattcttggggactggagatggccagttacttaaggttggttttctgtgccttcttcaaatgtctattttaatggtgataytttgtactttaaaraaacatttttttaatgcttctgggttatacatgagaccaaaccaagaacttcatgaactccttaaagacccccagaaatggcctggaagaaaatctggaattctgtatgtaagaatgccccgtagccatgtaatgaagtatcagctaccttgctgcccaggagtgcaccaagatgtttttccttccttactcataagccagctgggtgaggtaaatggaggtctggtccctaccccaaccctgactcaccttcccaagacatgtaaccttttagttctagctcctttatcatggaaatgtacaaagcacctgatttctcacaacttgaaagagatgagagattatagggcttgaaaagaagaaaaaacaggtgttctttccctccagcccacttaccacccacagagggggtttgttttttgccctttgtacccacacacaccacagagaggttagagatctaaaatcctttgagactcctcttgacttttatctcagaggactatttyttctccactgtgtggacacaccccggtcaagtgcaggtttttattcacttaggagaggggaagaggggaggaggagaaaataaaatcagagataccaaatgacttgtctgaagttatctagcgttcatcttatcaatgtcatcagcaagcatttattgaagaccttctgtggtctccaacaacattcctggtcaggaactgcaccatttctatgactaaagactgagattccttggcttctctgcagccatccatttactctcagctcagatttttaatygagtaatggtagatctgtttccctcaactgatctcccacagataactcgctgtgtgactttaggtgaattgcttaacctctctgagccttcatttccttaccagtaaaatacagttctactagacaacccagaaaaacgctttcctcttctgaaagtctctaattctgtcttctgcacacgtattccccaccatccccatccccaagccaaacctatttacttgctcctgtttgatcctgtttccaaatatgatcctgtttccacacttgctcacactgtacctccagcctgaaatgcttttttcttttttctcttatttacggcaccttatgtgtctatgctgtggctcagctcaaaccccacctcctctttgatgacatctaggcctggagtgaccttgctctcctctcatttcctgaaatactcatgatctatgtcattcttgtggctcattccaaatgtcttgcctggagacctcaccttttcactggtgtctgtcttgccttcccaacttgattttaagcctcatgagaagggggccatgaattcccacagcctaatacagtgctgagtgcctggtaggcatttgatttaatctgttttctttggaggaaacccagtaacatatgggagggagtttgtttgtatacacattcttttaaaatatacattgatcatctttcctgttgtgttagctttatttcctggggaagggtaaatacccatccatcattctacacaagtcactgggtgacrtctgtagctccaccaacctggtcaggcttattggacccatttgcctggcrggagtttccatcaagcctttctgggcctcctcaccaattatctcttcagatttgggatgtttttgatgagtgttttgacaagaacactgtttccccaaagccgagccaaccaaaccgctacatggtgaattggaggtgaaggaacactcgtctataaatagttccccatgggatggcctggttttgcctgtcctgtgtgttcacccagcagcctgcatgccgctggccagcttttagcgatgttgtggcaaccagggagtggaccaagctgcagcttcatgctgctgaggaggccgcagccgaccgaagtctcgctctcctcaggatctgtatggggtacccattcagaagccacctgtgtggcctcgttgtttttttcaaggtttgaataacaaaggcagctttttgttgtttgttttgtgactgctaacatttacacagtgcttcctagatgccaagggactctatatcttctaccgaattcagtcctctccatgacacaatggggcaggcctactattcccattttacagatgagggaatcgaggcccagagaaatgggatgattgttgttcaaggtcacacaggggcagagcagggatttgaacctggaatgacttcagagactgcacraagatcccctatgctrcactgactttgcaacctctgccgcacacattggtactactctctgaggattccgggggcacatgggagacatgcagatagggttccatgccgtggctggggacacatgctcctggggtgagtcagccttcctagaggctcaggaaagagtcccagcttgagaataaggcggaccatctgactgaggaaatacctcactggcgtggtaacttcttgggaattaacacccaccccccaagcccccaataagagagaagttctctcactcaggagaagggtgtgagggatgaacttgagctgacttgccccaccaggctccctagggcagctcagtaatgcccaagcctctcccctgtatcctgtgtacagattcttggatgtagcccctgaatttacccagaatcctgaagacccaggatcgtgtggatgatttggaaactaccgataatcctcaaatccctttattcagaagctttcagcttctcccttgccaaggcttgtcaccagaactgttagaaaggatgaacactgatagacacaagcttggctccttaagccacagcgtgggggaactaatgagcggcaaaaaacaaaactcaacccaacgcagacagtaggaggaggagaagaaagagggcttggatcagccacagcctgactcatcagtttctgagtgatcatgagttgacggcattttgacatgtgccaggcactgttgtgtataccttgttgaatgagagtcaggaaacagcaattggggcccaactgctgttttttaccaccaccagtaaaaacctgacttcttaaatctctgcaaatcctgtgagttttaatataatttggtgcaattttaagcctcatgttatttaaataatttttccttattgtaaaggtaatatatgctcatgtaaaaagttgcagagtygtcgggggtgagaggacaacaaagaaaaaattacccctaatcatgtcatgcagaagcaactgctgtcagcattttggattctytatttatgtagttgaggtcaggttttgcatccttttcttcagttagtgagggaaaatgcttacattaaaatgttattgcaaaccctttgtaaaaagtatttttaaataactatatcatattctattatttgggtacattattttgaacttaagctaagatactggatcacttttaaagtatctttaaagacatgcattttccaaggaagayggcattacctccaaaggtaagatttcactgataatctgtgaagaaactaaaggctacagtatgccagtacctttactgtcctccttctcttgcctatagacctaagtccctttataagattttggggaaatagaaggaatttagagctcaaagggtcctttgagagcatctaatctgctcttttattttatcggtgtaccgtcccatggtcgtgaggtgagttatgtctagtcacccccgcagttatttccccatcctgcttcttttcggaacatgattgcatgccgggtttttttcagtcgtcagcatctccactgagatcagctgaaaagtatggtcacactgaactcagctttggggaattcacactgcacgtgttgcacaatgtatgcatttctgtaaacacacaccgagtctttctccagattatagtacagcctatcatgtggtttggattcctttgagctgactctgttgcccatagaaaattgtccttatttcaaaggcagaattgcatattttgagcttttccaggtggtaaagtaagtaataacagaatatgcatgaaatttgaaatttgtaactttatgcatgcccattaaccttcgtgtaagcataaaagataagaaggcaatgggcaaggaagaataatcgctaacatttctgagctcttmctgtgtgctgggcattagaaccagcatctgcacgggttaactggtttaatccttaccagtcaatactctcaccatccccactttataaatgaaaaaacctgaggcctcgagaggttaggtatctttttcaaggtgctctgaaccaaaatmatctgtcccagagcccgagcttctatcccccaactaaactgcattaactcttacagagcttagtagagtttgagagctggtttttgttatatttctttctaatactggggtataagggttgataccaagatgcagatgtttgaggtttcataagaaggggccgagaaccctgtggtttagtttgttcctatttggggatggcttcctggcaacccagctgagtgcagagcccgctcctctctgagctgcgcgtagtccacgggggtctctgaatctcctttggggccccagctttaccccagtgggctcctttgtaggaaaggtaggaattctgtattcaagttgctgttttgaatggtgtcagcagtaaagactagtgtctccccgacctcccagggactgcagtagggttcaggatacaggaagctatatcacatagctctatcctgtccccatatccagtcttgaggtatttcctatgtgcttgggctcagactggttacctatgtggccctctactcccacttaatggctttcttttgtttatttttttttcttttttgagccaaggtctggctctgttgcccaggctggagtgcagtggtgcagtctcggctcactacaacctctgtctcccaggcttaagcgatcctcccacctcagcctcttgagtagctgggactacagacctgtgcccccacacctggctaatttttttgtatggacagggttttgccatgttgcccaggctggtctcaaactcctaggctcaagagatcctcccacctcggccttccaaagagctgggattacaggcatgagccactgcacacggcgccactcagggatttcgtttattcaaatcacagcaaaattaaaccggttccaaaaagttctgtctgaattcaaacagaagcaaaaactctgtactgcctaaagagtctgccttgactctggttattgaagtttttgaatgaatgtcagagaaaaaaatcttttgtaaaggcaagctgtactatatacccagaagatgttcaaataaggaataggagaacttggggaacctagaacaggacctgggaccggaagtggtggtggtggtggggatgactgagctaacagaccaaaaagttaaaacaggaggaagtgtcaaaacttggaagtgggttcattggttggctgtttaggatgtcatgtgaagcctgcttcaagttctccccacctcattaattgcaatttatgagtttgcagggactccccagtttgaaacttttagtcccatataatccacaaatctagaacctgtggttcagactgtatgcttctcttactacctacactgcaataagtagattggaaacaaaagagaaatttgccttgatctttatatttcatctttgttactcctaactactgaggcacattaaatacttaccttgctttctcctgtgtgtgcatgtgtgtgtgtgtgcacgcatgcacaggcatgcacgtgtgtgtatatgtatgcaggcatgcacgtgcatatgtgtgtgtgagcttgtgtgtgtgtatgtgtggtttaagtctccttcccagcatttctcagaaactgcttatggaaaaaaataataataaatgaaagggttggcttgtttgcccttcaactggttagccccacagagtgaggcataggaaattaaatttggcataaaatattatagctttttgaacacccgtggcttttccatctcatggtaatcgtaaagaaaaaaaaatagttttttgtttaatttttctcccccctcattttcctcaccatgatatccttcctgtgggtgatcttgaacctgtcttacaattgtatggtgttgaaatctccactcagttaatttcagcagtgtagttgggagttttatatgcaacaaaaatcccaaggctcgttaatagtctaccatgaggctkcaggaagacatcaacagaaacaatatgttgacacgaactgaaattctccatcagagaaaatttgttttctacacaggcttcagctggaaaaagctgaagagccctataaaatcttgaatgctaatagcgtcgtttttcatttaataaatatctactgggcaccttgtatgtgccaggcactgttctgggtgctgaatatacaaaggtgaacaaaacagacaatgcccttgctctgctggtgggaagaaaaagacagaaaacaagtaartggattaatcagcgataaagacacttcagatagtgctatgaagaaaatacagtgatgggtagagagtgacagaggtgttcagcggagaagtgatcagggaaggcttctcagaggaggtgatgttggagacttgaaagataaaggagtatacaagcatacacatggagaaggttcagattgacttcagattagatctatattaaggtcgtatcctggaagataaaaatccacatcgtgcccaaggattgtgtgtgtgaattggatgagatttctcttatgcaaaattcaacccgttttgggtttttgtgactcattgttacttcctgcattgcttcactgatcatgttctttttccgaggctgcccacctaaactgagctgaggaaggaacgtttcccttgctccagtcttgctggcttttgtctgtgtgttgatattctcctgaagtttgcaattagaaagtccaagtgttccattagtgcctgtgggctggggctcgggctaggtgagagatgatatgaacactgacctgtcctttagtcatctgagagagatgagactccaggggccacggaagcagaaatccctcacccctctgtgtagcacatttgggacctttgtggtgaaaactaaaacttcctcttgtcctgtcctcaggattatggagagcattgtttgcataatctagcaaaaagaaaaacaatttgactcactcaccctcaaggatttttaaatttaaatgttatatatttatttttaaggtaatacaatgatattgtttaaaactcaaaagaaccaagaaaatattccgtgaaaggcacctggtcttgacttccaaggcaaccaatgatagtagtttcatgggtatctttccagagatagtttatatctgtctacaggcaaaagagtgaagatattcttcctcccttttgttgaaacataaaacacagtaaacatatatgttatatatgtaaaaatacctgtatatgtaaatatgtctatatttatagatatatgtacatatttcatataactttaaatataacacaaagagctttctaattatttttatagctaaatagtatttccttgtttgtactatagtttacttaaccagttccctattgctggagatttaagttgttttaatcttttctttataacatacaatgctacaatgaatatatgtcatttcatatatatgtgtgtgtgtgtgtgtgtgtgtgtatatatatatgtgtatatatatatgtgtgtgtgtatatatgtgtgtgtgtgtatatatatgtgtgtgtgtgtatatatatatgtatatatatatatacgtatatatatgtatatatatatacgtatatatatatgtgtgtgtatatatatacatatatatatatatatatatatgtatatatatatgaggggctgcagggtccaagggtatgtcctttgtaattttgatagatgatgccaaattaccttctagagaggtctggcttccaccactgaggaaacatactaatttaaacccagcatctatggctatcaggacaagcttcagtgcaagccacgctaagtagctttttcaggaaactgattggtaaatcctgggccacagaactttttgataacttgtaaaaaaagaaagaaagaaaaacaaagaaagaaagagagagagagggagaaagaaagaaagagagagaaagaaaaagaaagagagagaggtaaggaaggaaaggaaaggagaaaggaagggagaggagaggagaggagaaaggaaaggaaaagcttccttgccacaattcagagttctagagagaatattgatgcttcatttccaaggtaccaagtaaataaatcaatgttgcacccaactagatcttgctgaccatctgtatcaatgatgctccaagagtaaataaaataagcccccaataaaaactgcagtgcagctcctaatttacgtaaaatggatgagtggtggtgtaaagtatgtttttactttgttattttaaagcaaaccccacagacatgatgtcgtttcacctcaacatatttcgttatgcatctctcaaaacctacagttgttttcttaaataatagtaaccataatgccatgatcacagctaataaaattatcagtcattctttaggatcacttactatccagtctgtgtaactaagtattcccaattgattcaaaaaggtattttaaatggttttgttcaaattggtatctgcacaaagtcctcaaaccaaatttggttgttctattatctagagcagtctcctcccttacttttattccctgccactgacttaactgaaaaaaccaggtattttgccctatagaatgtctcttatcatgtgtttggctttttgcttccttgtggtgtcatttagcttgttcctctactcctgcttcctagtgctaaatggaagttagtgctaaagacttgactagattcagtttcaactttattggcaagaatacattatgggtggtgctgcccaatgatgcttttgccatgatgaattcctgaagagataccagggcagcagcttctcttctcttgacccttccttgataatatttctatcagtgtttgtttaaaaaaaacaaaaactggcttcctgtttctctttccctatacaactgctttccagaaccagatcaactgaatctgagctgattaatacagctaatgaattagagacggcaaatcctggcaagcccataccttggtcagtgcctgtcccttggctccacttacaggattctgtagagcagtgttggccaagagaactttctgtagtgatagaaatgttctacatctgtactctccagtatggtagccagtcaccttaggtagctagtgaacacttgaaatgttgctagtgtttttaattaaatgtaaatttttaattaaatttaaatagccattatgtggctagyggmtgtcatatttgatagtgcagctataaagtcgttttaaaatgacttgagacacacacctttcccacctcccttaggacctaactgcttctgttttaaaaagagcttttaagaagtcatatttcatatgtttggttagtgagattgacttttacaaagctgctgctgaatttgatgagcagtccaagggcttcaagtgagccactatttgcaccaaatccacctgggcttggcccaagcagatgatggaaggaagtcactgatcgcagggcaaagctagactcgggcccaggtcctggaaaggagaagtgaatgcgggaagttgctctgtgcaaaattgataagaagcctttggctaaacagcaaatccctaactgccatcaggatatgtgggaacaggcatattattgattagtagatgtgtgaagtagactttgtccaaaaagaatctcaggtgccaaatttttcttttgaaaccatgcgcccaatgtggctgatgtctacagtggtagagatatgaatacagataatctatctggatgtgttcaaactgacaaaatgttgaacaccttcacttttcaaagtagtgggtacaaattgtgttaggtacaaagaagattaaaggttaggtacaaaggtgattaagacatggtcccaggccaggcacggtggctcacgcctgtaatcccaccactttgggaggcagaggcgagcggatcacctcaggtcaggagttcaagaccagcctggccaacatggtgaaaccccgtctctactaaaaatacaaaaattagctgggtgtggtggcgcatgtctgtagtcccagctattcaggagkctgaggcaagagaatggcttgaacctgggaagcagaggttgcagtgagccaagatygcaccactgcactccagtctgggcgactgagtaagactccatctcaaaaaaaaaaaaaaaaaaaaatgacatggtccctgcgcaaaaggagcttgcaatctagtaacagattattatctattgactattgattatgtgctaagcatctttcatagttcttatttgatccttacaaaactgtaataaggaaggcactattagccccattttagagatgaggaaattgaggcctagggagattaagttaccagttcaaagtagtgcagctacttaaaggatggaggcaggatgcaaactcaagcttaagccaccattatacttctctagcactataggattygagtctcccgatggctcttcatacccacacttcaaaccctgccttcttaccatctcctcttgctccttgacccaaagccctgccatggcctcctctctctcatctacagtaaaaggcaggctgtttacacaggcccacaagacccttgattatcattcccctgttatcttactatcttactgttcactcctctacctctctccactgaagccaccctggcctcctcccattttagtttctttgcactgacagggctgcttttaagaacatgtttcattcaagtatgaaaataactcatctcctgcaagtctaaataaatatcaccttttcagtgacacctaccctgaacatatattctcttaacccctgaccccactatattttataatttacttttttcttattaatagtctgctgttactcaccccaccatacacacacaggaatgtaagttctatgaggtcaggagctctcccttccccattttgttcactgccatttttcaaacacccagaacagtgctgggtacataatgggtgttgggtagatgtttgttgactgaagatggatgaagctcaggtgtgtccaatttcaaaaccactgagtactgagtcacacttgcgtatattttatatgtgaacacaaacctacttgtctgtatctgccaagttaatctgggtcacttctaactgtatgatgatcagagtatcctgtgcaaatacatgtgggagctacttcctttaatttccagtctctcttgagacagcactaatgaagctgtcacttgtggcttcctatagggccagacatggtcagaaattgtggtcagccagcttccayatatgaggatactaccccagccctgaagagcggctttttttgtttgttcatttttggtaactttgcctttacaaaagaagaaatattatgcttgttattaccagccttgttgaggactgagatgtgggaggatgattaaggagcatggtaccttaggcagtatttgtagtgagtgaaaaaggatgtagctttatgattaagctacaatttttgccaccctgctattcaaagtgttgaatagaggccggaagtggtggctcacacctgttaccccagcactttgggaggctgaggcgggtggatcacgaggtcaggagatcaaaaccatcctggccaacgtagtgaaaccccatctctactaaaaaaaattagctgggtgtggtgcatctatagtcccagctacttgggaggctgaggcagtggaattgcttgaacctgggaggyggaggttgcagtgagccaagatcatgccaatgcattccagcctggcracagagcgagattcygtctcaaaaaaaaaaaaaagtattaaatagaaatcatgtttctctttttgaaaaaaaaaaataggttattcttggtgagaatttgacttcaaattgtccagaggttatctatgaaattaaagaagagacacctgttttctacaaactcgttcctgatcctgtgaagaatatctacatttatctaacagctgggaaagaggtaggtagaaatactagttattgcttctgatttatgaataaaaatggtttaattgatgtcattatctagtagcaaagcttttactttgaactacagagtttaagcagtgccccaggctttgaggagacccgcagtggttcacaggcacggaattaaaaaccttactgactgtcagtaagtaagcaagaaatattatctatttagacaattttattattggctatatttccagtgccaagtttttcagaggagggtgtgcttggaaatgggcgcataatcagcaaggtaactgaatttacacatttattgtgtgggcactgaacggttagatgcatttatgaatatacccaatgggactggctttggaatttggggttaatatcaggccacagtctcatacacattcatgaaccaggaaatatatggtactccccctccccctcttcatttatcttgctgttttggcttttcttttgcttctgcttactgaaataaaagtaatatatttttatattttcttcatctttaccaagtgctgtcaccaagggaaggggaaaagaaactaattgttaatgagtctctactatgcattagtcactattctttgcatgatctctgtctaggtgcatagaattgtgtacatatacatacacacaagtgtagaaaacagtgttaatgaaatgtgttactgaccgggcatagtggctcatgcctgtcaccccagcactttgggaggctgaggcaggaggatcacttgaggccaggagtttaaggctgcagtgagccatgatcaaaccactgtaccctagcctgggtgatggagcaagaccctgtctcaaaaaaaaaaaaaaaaaaaaaaaaaaggctgggcatggtggctcacacctataatcctagcactctgggaagccaaggcagggatcacctgagttcagacgttcaagaccagcctgggcaacatgatgaaaccccatctccactaaaaatacaaacaattagctgggcgtggtggtgcatgcctgtaatcccagctacttgggaggctgaagaacaagaatcgcttgaaaccaggaggtggagtttgcagtgagctgacatcacaccactgcaccccagcctgggcaacagagtgagactctgtctcaaaaaagaaaaaaaaaagaaagaagaagaaaaagaaatgtgttattaatttaataaaaataaatgtgttattaatttattttatgtgaagaatctaagacttggagaggttaaataacttgttcaagaannnnnnnnnnnnnnnnnnnnagaggttaaataacttgttcaagaatatctgtatctatctatctatctatctatctatctatctatctatctatctatcatctatctatctatctataggttagcctttgcagggctgtgacaaaaactcaaccctgattctaaagcctctgataaatgatattaaatccaaaatttgtgaaaactggacattccctggctcagtggttttgacctatgaccgtttgaacatggaaagtgcaaagaagataattgagacttacataattatataatggatgtaacagatactctcagcccaaccctggttttccattcttttcctttcagtcattctaaggaaaatagcaatgacagcaatctacatgtgctttttgagtcacagataagatgtgcaagcaatttgtagtttctggtattcttataaagacgatactgttctttgcacattgaaaagtcagttatatcaaaatgaccacactgagatggccacatcttcccacagagcttgtaaaccagtccttcaccatatagaatctcctatgccaatttgcttcaccatgcagacactttgtattatgtttcttccctggggatcccatctttgaaagacttttgtctacccaacaaactgcacatattaagtaacagttcccattcccagggtttatttatcaagggcgtctcaaaactgccggtcagagtactgactgtgttcccacatggagctgataaaattccaacccaaagcaaagaaactygatatcttccttaatccatgcgygtktttccattcagctgtctgaaatattgcaaatagctcataagcccccattacttccttcatggatagtaatggaaccccagaactcaggaccccaggctgggaaccattatgaaaagccaccagtagttgatgggttcccactttctagaaagcaaaaagttctagcctctgatcattcaaagcctgaagtcctgggaagagtttttgactgggcatcaaagctggttagccctgcattcttcactgaggattactgctagagatcctactgtttgaactctggctgagcaaatataacgcctaaagagacaaagtccaaggaaggctcttggggagataagaacagccaaactaataagctatgggatatccataaaatggtatgatacggggccgctaaaaataatcatatggagatgtaggcattgatatggaatagtcactacggtctgttattaaattagagggcaggtctaatgtagtatttttagtgtcctctctctctctctcttttttttttttatggagtcttgctctgtcacccagcctggagtgcagtggcgcaatctcagctcactgcaacctccgcctccacaggttcaagcagttctcctgtctcagcctccctagtagctgggactacagtcacacgctaccatgcccggctaatttttgtatttttttttttttaatagagacggggtttcaccatactggtcaggctggtctcaaactcctgacctcaggtgatccacccacctcagcctcccaaagtgctgggattataggcgtgagccacctcgcctggccctctctcatttttttttgaaacagagtctcactgtcgcccaggctggagtgcagtggtgtgatcttggctcactgcaacctccacctcctgagttcaagagattctcctgcctcagcctcctgactagctgggattacagrcgcccaccactatgcccagctaaattttgtatttttagtagagacagagttggccagactggtctccaactccaggcctgaagtgatctgtccacctcagcctcccaaagtgctgggattacaggtgtgagccaccacggccagccagtgtcctccctcttatacagagttatatttgtgtgtttaaatagactgagtaatagttctcagagaatgttctggagacccatattccacagaatgctctgagcaaaagtggtcccagaaccagctgttacttactatacccctcctggaatactgtgaggctcagcatagtcaaaggctccgagaagccctgtgctaaggaaacccgttttgctttttcagtctgaggttttatgtttgctggatcatggagcccttttcttgcataatagcagtaaccaatacttattgaacatttagtacctgtcagacaatagttcataataaccccatgaagtcgtgatccattttacagatgaggaaacaaggttagagagattgcatgacacttattaaaatccatcagtgttacagaggcatttgtgaactacaaggaaatacctcyattctggttaattccggctcaggatcacgggctgccagctgcatctgtcagcagtgttggggactatgaaatggaagggcgtggttatccyccatgaagtcaacttggaactgaaggatccagctcaggatagtccttgttttcctcacaaaatagagaaaaatagagaggtcccttctagaactccttatttctctaacctgctaaagaagttatttatactatctagcatgtacaacttcctggcataatgagttccacaagttcccttactacctgctgtgtggttttgcctgcagaaagtgctctgtgtgatgctcagttactccctgcctctcaccgccctacttgcaggctctgactggctgcctagatgtctgggtctgcccagctggggtgccctctttgtgggctgctgtttcctgacaatggcaagaggcagctctagggatggggaaatgatttgactactccccctgtttcttttattttcaactccactggaggggtgtgagcaaaacaagccaggagctgagrtgacggcgctgcccctggcaggggtgtgggagggcctcgtccctggtcctcctcgtttccacattgagtgccaaactcctgctgacactcctggggcagagcctttgttattccctaatactcatttccaaaatgccattggccacatatggactgtctctgtatgaaaaccaggcaacctgattccatgatccgtatggaaatmatcattagcagatcggaaacccaactgggtgtcagactcacctgagagagagctcttaaaatacagattcctggccagacacagtggtgcaygcctgcaacctcagcacttttgggaggagtgctttgagcccagaagttcaaaaccagcctgggcaacgtagtgagaccctgtgtctttaagaaaaaaatcttttaaatgaaaaaatacaacttcctaggctctgcccccagacttagcgagagtctctgcggcagaggcctgggaatacgcactgtcaaaagctccccaggtgattgtgatacaatgacttcatgtcctagatcttgagacccactgcccagtgccagtatggaggtgttgagttcaagttgataaataggctctttttggcccttcattagataaggtgttgtagttttcctgctgttgcttataattccatctgaaccattgtcctctttccttttaggtgaggagaattcgtgttgcaaactgcaataaacataaatcctgttcggagtgtttaacagccacagaccctcactgcggttggtgccattcgctacaaaggtatctcctgaattctttctcaccaactcgcattttygaaaaagtgtcatgcggcagaacacttgttgccctactttaacgatccattccagtgacctgagggaactgatctcttcctcgactaaaatcttgttgtgcaatcctaatgaattctcgaaggtgtttccagcggcgtccgtgctatgcaytcactggacccgggagctccccagtctsggggcgggaggggcaggtgtgcagccttcaggagaacgggagagagcaggcaggtttggcttttactttctccagagttcgccaagactcaagagagaggcaaaagggccccccctccgagaagataaaagaatagagatgtctgaaaatttttcagctgaatccccatcatgtatgtcatgtattctgttcgctccgcagaagcctcgttattgatggcgccgtctcctaatgcgccgcgcagctgtgggcctgatgtacaatctcagtctccgggcagaatctgcccagcctggtctggaatgacgatgctcacgacccatctaggctcaggggcgactcggagcggcttccccgccatggcagtttcctagcgtcgctgggcccggcctggttggattcgccgtcgccatggcaacccagtactggggctcttgctggagaagcaaaggaggagagagccttcgctgcagctcaggcaggaaagagagagagagagagagaaaaaaaaacccataacagtgtctgtcagtttggtgctttcagtttttaaaggtgaaaaggataagaaagagcagagcaggtggagagatgctgaaggctgaaccaggggacagtttgggtttagaaaagagcaggaggaagagaattggtgactgaagggggagrcagccaagagaaatgaagggagagggggaaatgcaatacaagcaagaggtttaggaaacaaatcaaaaatacggggatggaattaattaagagttcacgggggaaggcgcaatccgagctgcagcaagaggaataattgcccctgccatttgctacgcttccttaccgggctgtttccgtcagagtcactggcagacaaacgaagcaagggccagaaaaatgctcatgaataattcactgatcacgaacgggrtttgtttgttgcacactcagtgagcagtcttgccataatcttttagatccattcatttatgtagcatccctgtctgtatttgtagagctgtgtacaggagtcaattcgataatggtggcgatgatggtggtgattaaatagccacatggagctagcggctaacgtattaacaagctcagctctggagcttttgggagatctccaagctggtgatatgaatttgggagttggtagtattttagatggtacttagagaagccttaagaccagacgaaggagtgagtgttgattgaggagagaagtttgagaactgggccttgaggggctgtggtgtttaggggttggggagaaggaggggaaacagaacaagaaataaggagggagcagtcagaaggggaagaggaaaaactggagagggtggtctcctggaagccaaggaaagaaaggaggaggaagtgatccactgggtcagattcagctgagaggtcaagcaggagaagaaaagaatggatcctttgcacttagcaggtgacartgggtgactgctgggaatgccatggttaggagtggcgctaaatccacaagagacaatgggaaaataagaccttaagaagggacagcttagagaagctttactgagaaaggcagctgaaaaaaatgaagcagacactgaaagcgaaagtagagtccaaagaattttgtctttttgtcctttttttttttttttttgagatggactctggctttgtctcccaggctggggtgcagtggcatgatcttggctcactgcaacctccacctcccaggttcaagccgattctcctgccgcagcctcccgagtagctgggattaccggtacgtgccaccatgcccgactaatttttgtatttttagtagagatggggtttcaccatgttggccaggttggtctcgaactcctgacctcagrtgatccgcctgcctcagcctcccaaattgccaggattacagccgtgagccaccaygcccagccagttttgtctttttaagatgcatgaaataacagtgcatgtctgcactgttgggaaaattccagaagagaaggagaaayggatgatacaggagagagaagggttgtggagtgttcagtctttcagcaggtggaagaaaatatgacttggtgtgccagtagggaggccagcctcagacaggagcactggcccctcaccctcagtggtaggagggaaggtagggactctgggcccaagcatggggaggtggcagaggcctgtgtggtgtcttctcctattgctcacattattttcagtggcctacggccattgagaatgaggtgagggaggaagcactggaggtttgaggagaaaagagagagaaggagtggactggaagactaggagggagaatagaatagggaaatatcgagcggttgccaggaagcattagggcccacttgaggttgatggtcctgtgtttgaagtgagagctgtaagcatggttttgtctttctcaagctgcgttcagctttggtggtatagctgtagactcagaaaaagttagctttagccagtttgggggctttgccggaaaatacatcaagaaaggagagagtggccagggagctgagggagcatgtaaggaatggatgatgatatcgatatggatgttgattcatataatgatggcacttgggctctaaggagggaaataaggacctgataggggtagggatgtgaaaaggtggcagggtctgtgttggaagttsaagttgagtttaaagattgttaggggcaggcgcggtgactcacrcctatattcccagctttttgggaggccaaagtgggtggatcacttgagcccaagagtttgagaccagcctgggcaacatggcaaagaccccatctctacaaaaaatatgaacattagctgagtgtggtggtatgtgcttctggtcccagctactcgggaggttaaggtgggaggcttgcttgagtcccagaggtagaagttgcagtgagctgagatcacacctctactttccagcttggatgacaaagtgagaccctgtctcaaaaaaaaaaaaattgttggaactagagaattggaaaggggaattattggactgtgggggcttgatattgaggtcatggagggatggagttattggcaatgacagggtctgccatatgattgtcaagatcattggcagagaggtgtcaaggaactgaggtggttaccagagtactaaatggctccatcatctgtgtggaaatcgcagtcaccaagagagtgaggagctacatattcaaggaacgaagggaagtggccagggctggggtggtctgtaatgatcacaatgaggagggacctggggtggtttgagctgacagcatgggctttgaagctggggaggaagtgttggaaagagagaagaaggatcttccagaagaggctgcaagacacaaataggacagctagatgagggagaggaagcagccaggccttgagaggggcctggggaagctgtggcctcgaaggagagctggtttcagtaatattgagaaggggaaaggaacaatcagagaagaggttgaagacatgggggcttctgttgataactggctgtgagttatagtcttttgtttgttttgagacagggtctcatcctgtcacccaggctggagtgcagtggtgcaattacagctcactaaagcctagacctccccaggctcaggtgatccttccactgcagtctcccaagtagtggggaccacaggtgtgcaccaccatgcccaggttttttttgtattttgtagagacggggtttcaccatgttgcccaggctggtcttgaactcctgggctcaagcaatcctccttcctgggcctcccaaagtgttagaattagagacgtgggccaccacacctggccaaaagcctgcttctgctcttgctccctcacccctatcccagtgcgctccaagaagagtgattcatttaaaatccaaatcagattatgtcactccccagcttaataccctcccctggctttccatcttagaactcagtctgactcccttgctgccagggcctgcataccaggctttccgtgatctggcctttcaccacttctctgacctctcatgccattctctcctttgtttacttaaccccagacatcctgatttaagactatgctaagcatgttcctgccccagggcctttgcatgtgctgtttcctcagtctagtacattcttccccacatctttctatggcagactctttcttgackgtctggtcctagagcacacatctctctgcacctgcctacccagtcttcagtagcctccccttactcacagtgacattactgttttattttcttcatggcccatcactattaggaatgaccttacttctctacctctctttattgaaatgtgctcagaaaaacataagttaaatgaatgagataggctgagtgattggtcgactctgccaatagcaggttaagacttgtgccttaaatcttataagacattctgaagtcatggagcgatggcccttcacagccatgtcagaaaccacttggtttcagacagcctgggttctggcctacaatgaaatgaaactaagtctcatatctgtgactcatatgaagctcccagtaccattcaaaattaggaattctaaagggggatgttttcttataatggtagagcatcccactgtgtttattttaaatgtcatggatttatttagaaaaataatttattttctctgttgagaaggttgagttttcttgcatacatgtctagaaagtggaatggtggggagaggcaagaaaactatcttcacttccttttgatcagatgttaagaataggcatccagactgggcatggtggctcacgcctgtaatcccagcactttgggaggctgaggtaggtggatcacctgagatcaagagttcaacaccagcctggccaacatggtgaaaccctgtctctactaaaaatacaaaaattagccaggtgtggtggtgcatgcctgtaatcccagcaacacgggaggctgaggcagtagaatcacttgaacccaggagacggaggttgcagtgagccaagatccagcctgggtgacagagtgaaactccatctcaaaaaaaaaaagggaataggcatctagtataagtagataaaaagcaattagataaacaatgagctctaaaaagtctagtattttattgttggaacctcagatccaacctgtgctgaatttgtctgtgtgggtggaaagtgaatttttgcaggctgaatatcttgggtttggaagcagtttctcagtttctcccatattgcaaagcatagcacatgtgttcagttatggatttccacaaaactggcaatcccgaaccaatgaatgggtgaggttccaaaagttcatttgcaagtttgtttggcatgcagaatgcattttcccatagaaacaatgtcataaattaaggattgattcccaagccagcccataaaatccaaaattatttaatttcaacaaatatttattgaacacctagtgagagcctaatctggggcatgagatagctaggtagtattgagagaaatcggatgccattcttggctttaaggaactcgcatgctagctgggaaggcagacttatcaatggccaacattcattcattcaatcctacatccaatcacaaatattttttaagcacaacaatgtgctaagtcctatgctcagtgctcaggatacagttctttcttgtctctatagagcttgcaatctaatgggggatataatgtgtatcagttaggtttctgatctagtaatgctgtataacaaacaacccccaaatccttagtggtctaaaagagcaaacatttatttacatttgtttttcatgctcatgggtcagcctgtcagctatgggaagaagggtggggtcaatgtcaagctgaaggttgagttcaggtctgtttcccatgtttctcattctgtacatgctcttcttaaggcacatagaagtagcatgagagaccaagctaaactagacaacatgttctaagccctggctgacatcatgctgactaatattccattgataaagcaagctgcatggccaagcccaatatccatggagtagggaaatatattccacctactctagtggaagattctgcaaagtgacctggcaaaaatgtagtgtgggtgtgtcattctagtacaggatggattgaagaattgggagcaataatccactcttatcaataagtaaaggagataaatgaatagagtgtcataagagctagcatgggggaagtttagggtttcatgggggcacataaaattatctaacccaaacttaacaggtcaaggaaggcttcctggaggaagggatatctaatctgaacctgaagggtagggggatatcagctaggtaaagatgaggcaggggaagctggtgtagggaccaggctgtacaaaggccaggagagcttggcctgaagctcagtgtggacgagcttcacattaaagaatttgaattttgttggaaggaccttggggagccattgcagggctttaattaaaagtgcgaccagatcaggtgagtgttttagaacgagaactctggggtgcaaggtggaccggaggggactgagaagagctggcagatcagttagcaggtggctgtaaaccagtaagagaccagggactgaattagaatgatagtagtggtgagggaaggaagtgggtggattagagagctatttagaagatagaattgacagggcttagtgattaattagattcccctttgagtctgacacactaaaaatagggccataaaatgaaaaataaaatctcaaggtggccactgtttttctggaagatgtatcctttctcctttgatctcagtcttcatgaagaaaacaaacaagtgatacccacatgtacacttgattcttcctgtgtcccaggcactgggctaggcaccaggttagaccccaaaagatgggcacctgagtcaaatgtgggagggcttctgagagacaccagcgctgagtctcagagtgtgcagtggggtgagttattgcattgaagctggtgttgagattacagcggaaggagtgcaggcatctggctggggtgaccagatggacagaggtgtcggttactgagtagggagtgtagaaggagtggcctgtttgggctgcatgggaaacgcggggggtggacttccacactggcaacatgggcaggacagcctatgaggacagaggaaaggtcctgtgtttgtctgtttttgcactgctataatgaaatacctgagactgggtaatttataaagaaaagaggttagttggctcatggttctgctggctgtacaggaagcacgatactggcatctgctcagcttctggggaggcctcaggaaacttacaatcatggcagaaggtgaagggaaagcagggcacgtcttacatggctggaacaggaggaaaggggggttggggaggtgccacacacttttaaacaaccagatctcaagagaactcaccatcacgaaaacagcactgaggaaatggtgctaaaccattcatgaaggacccacccccatgatccaatcacctttcaccaggccccacctccaacactgaggattacaattgaacatgagatttgggtggagacacagatccaaacgatatcaggtcccaaatgcattttgctttggatagaatctgggctttgtgtgacctgccagtttcttatctctgccacttctcctcttctataaagtggcatttataattggccaggtattgcaaaaaagtgctgggattacaggcacataatcctgggattacaggcactttgggaggccgagttgggtgaatcacttgagcccaggagttcaagaccagcctgggcaacatggtgaaaccctgtctctacaaaaaatacaaaaattagctgggtgtggtggcgcatgcctgtggtcccagctactctggaggctgaggtggaaggatcatttgaacataggaggttgaggcttcagtgagccgtgattgtaccactgcactccagccttggtgacagaacgagaccttgtctcaataataatagtaatagtacctgcctcagaggtttgctgagagaattaaattccataacgtacatcattgtaggcccagtgcctggctcctggtaggcaacgaagttgtgtcaactgtcatttggtggaagcccaaggaggcagtcattacttgtccctgaggttgggaaaggcttcaacgaggaggtggccttaaaattggccttgaagcctgggtagaccttcaccaggggaagagtggtcgggaggcatttcaggcagaagaatcagcgcagtgagaggtctgtggagagactggcagatggagttctatgcactggctgtagaaggaaggaagtgggtggagatgctgggtgggctctcagggtggaccttactagcgggtgctgggaactcatgacagggttttaagcagaggccttccagcgccatatttgtgttttaaaaagattatcccrctggcagtgtggaagatgaaccacgttaatccaagtctctcccggcctcccaccccacccttcctgggtcactttcctctggtgtgttttgtaaagagagagtttatgtcacatctcgtcctgagtcagttacttggtggctattctccgaattcatgtacctccccactgggagaggtagtacgtctcccagtgcatccatggggccccacttgctctggttttagtgccatgatggaatcagggctgggtcctcttcagaaaatgggccctacaggaaagagcacacttgcattcaccctcccaacacttcgtgctccaccctgcactgggtacacacaggtggaggcaaggcccccaggcatgctgcttataaggtatctgtatgcgtccttcaattatctgtacaaatttcacattcactccatatttttctacatgtttcttccatgttgacagttggaagaccttcaagcagcccctggtggctgtttttaggtcttcagctgcagttaggctgttccacgcatgagatcgtgaaagagatcatttctcgctcggtctaacagcagggccctgtggtcagtcttcctatcagactttctgaagggttgggaataacagaagggtatttttaacacatgagagaaaactgccatctgaatgctaaacatatttgtccccmacaccccagagtaacaaatgaaaagaatyacatgagttgcttgtggacacgtcccagctcctttttttatcktgctctcctgtcttgagggttcttctccaagtgacactccttcctcaagccccccaggcctatcattaacctgctgggatccttcccaccaggastgtgattgccctgaaacttgaccagtataatccatggtgcacagtaatttatggccatattcttcagtagcctgagttagtctgttctgtcatcatgagaggtgagctacatacagcagagagggcccgatagggcttagatgttttgtctcctccaaatctcgtgttgaaatgtgacctccagtactggaggtgggcctgctgggaggggtcgggtcatgggaacggatccctcatgaatggcttggtgctgtccttggcaatagtgagmgagttctcactctgagttcacaggagatstggttgtttaagagagtgtggcacctgccccctcacagtcttgctcccaccctagccgtgtgacacacstgttctcccttcgcttccagcatgattggaagcttcctgagcccctcaccaggagcagacactacccatgcttcstgtacagcstgtaaaatcatgagccaattaaaccccttttctttataaattatccagtctcaggtatttcttcatagctatgcaaaaaatggactaacacagggtcacagaaggctttgcagtagaaaagtccagatggatgtgactgttcctcattcagaaggcggctgcagtgccccttccacagggagcctgcctcgagtccaggcctggccaggagacagtgtgcatgggtagagaagaatatgcttatcatacattagacactaccttgcacgttctgtgccatgttccatttagtcctcctggtaccccatgaagaaagcactattacaatccccacttcttagagaacagccttagcttatgtatagtttcccacagctgcagaaacaaattcccacaaacttggcagcttaaaacaacatgcacttgtgatcttacagttctggaggtcacaagcctgcagtgggtttcactgggctgaaaccaaagcattgacagggctgtgctccttctggaggcccttctttgccttttccagcttttggaagcagccagcattccttggctcatggtcccttcctgcatcttcaaaaccaacagtgtggcatcatcagattacattgggcccacccagataatccaaaataatctgcccattttaagatcctccacttactcacatctgcagagtcccctttgccatgtcctatggtttgaatgtatcccccaaagttcatgtattggacacttaatccccagtgcaacagttttgagaggtggaacctttcggacgtgattaggtcatgaggactctgtcctcatgaatggattaatgacattatcacaggagtgggttagttattgcaggagtgggttacttatcacaggagtaggttcctgataaaatgatacattaggcccctttctctctctctctctctctctctgtctctctctccctcgtgctttcttgcccttccaccatggaatgatgcagcaagaaggccctcaccagatgcaggccccttgaccctggactgcccagtctctagaactgtaaaaaataaatttattttctttataaatttcccagttagtagtattctgtaatagcaacacaaaatggactgagacaccatgtaaggtgacacagtcacacattccagggattaggacctggacatctttgggggccattattctgcctactactggttgtacaagtaatggattcaactctgggcttagctctagctcctaagccattagagcaaaacaaagagacacaggcaagggacattatccctcatggcagtgggtggagaggggagagcctggagcaaatggccctaatggagcatttgtgataactgctatgtataagaaagacacggcactcagggcccacctgagtcagagaaaaccctccatcttgaaagcttaggcaaccatgcattcatttaacaggtatttactgagtacctgatatgtgtcagtcactgtcctaagcactgggattctaagcactagcagtgagtaacacaggtcaaaatccctccacacgtatgttcattgcagcactattcacattagcaaagacatggaatcaacccaaatgcccatccatgatagactggataaagaaaatgtggtacatatgtgccatggaatgaaaaggaatgagcagccatgaaaaggaatgagatcatgtccttttggggatgtggatggagctggaagccattatcctcagcaaactaacgcaggaacagaaaaccaaataccgcatgttctcacttataggtgggaggtgaacaatgagaacacatggacacagggaggggacaacacacataggctcagctaatgcaagctgagcttaatacctagttgatgagttgataggtgcagcaaaccaccctggcacacatttgcctatgtaacaaacctacacatcctgcacatgtaccctggaacttaaaatgaaaataaaaattgaaaaaaaaatccctgccctcatggagttccctctagtgaggtgttttagtttcccaaggctgccataacaaattactaccaacacaaatttatcgtctcccagttctggaggccagaagtctgaaatcaaggtgtcagcagagccgggctccctctggaggctataggggcaaatccttcctcacctctcccagctccgggtgactcctggtgtttcttggcttggggtaggataaccatctctgccttggtcttcacatgaccttcttctgtgtgtccaaatctccctctcctttctcctagaaaattcccattcactgggacaccctaaatccaggatgatttcatctcgacgtccttaactctttacatctacaaagaccctatttctacataaggtcacgttctgaggttctgatgggcacgaatttgggggaacactctttaacgcacaacatgagggaagatggacagtgtgaaaataaatgaggaaagagagaacatgtcacagagtaaacagggctgtgaaggaaaataaagcagaaaaaggaaatggggagcgctagttggaggcagggggcgctaaatttaaacgggagccctggaaggcctcagtgagaaggggcatctgagccaagacccaaagggacccactcagttttggggctatccgcyttcatgggctattgcactattgagtggaayggccgacaatttgagacagaagagccttcctcctttccttccaatccgggatgtgtccttgtgcagatctcaagcttgacgtctgtgcggtgacacttctttatggtccagtgaggctctaatgacagcaataatgataatggaattggggatggcccctccttctcgtgtgaggaccccattgtgccgactaattgtgtagaagcaagtaggacaactgtctgtggggtggaagcggtggggagcaaagaggaatatgtcctttgggcctcagggaattactgaattaccgttgtgtgggctgagtccatgcatctgggttactgtgaatgctggaagggatttggggggctttccaacaccagaaggggtctgggggtcaacctgtgtcctgtgggttctctacctcctttttcagctgtgagaggagctatgagttctatgtatttcaaagcagaaggcaaaggggatagcagtgctaaggggcacctctccacccttggtgtcccagacagttggcactgggaaagtgctcgccatgctcagaagccaggcttttttgtttgtttgtttgtttggttggttggtttttttagatggagtctcattctgttgtcaggctggagtgcaatggcacaatctcggctcactgcaacctccacctcccaggtccaaatgattcttctgcctcagcctcctgagaagctgggactgactacaggcgcgtgccaccatgctcgcctaatttttgtatttttagtagagatggggtttcaccatgttggccagtatggtctctatctcttgacctcgtgatccccctaccttggcctcccaaaytgctgggattacaggcgtgagccaccatgcccagccaggtttgttttttgtttagtggagctagtaactgacgttctcggacctcagcctccgtgctacttacctgcaccatctctaatggatgctctctgacttccaacaagcaccattaagaacatcccttttagtaaatatatgttgtaatggaatagatttttttgaartgaccttatctcaggcagcatgcactttcataagaatgtattgattggcctttaaatattcctcaaatgttttcacttgtctctgtgacctaatatttgtcctgttcccagcatctcctccatatccaaacacaatgttcaggtcttcattcgaagccttcctgccagtcttttgttttttgctttttaaacattttgatgcttttattctgctatatggagggtgcactgtttctgataggccaaatgtgggatttgatattgctttcaggaggatcgggttttaatatcattgccacctgtttagtggtggagaaactgaggcccacagaggctaaggaatgtggcccccagttacacagggagtatatgggagagcagctttgaacccagacccttctgactcaagaggtgtcattttcccatttttatttccatgctgctgtttttttaaatggctcccctaaattatttagttcatggtttgcatttggaaataaacaccaacttttagtacactcatygcccacaaaagaaccacatggagcaaaggccacaaacccattttgtgtgagtgtttcagtctgcaaatgtgttttttrtgtgctaaatagctcaaagtttcaagacaaaggctgtttttccaccacgccagtgaacaggccaacctagtgaacaaaaatcaatgaaatgacttctgctggtatcactgaaacacagacaagaatttagccattttaaaatttccttgttaatccaattcagctaccttttgttgaatcccagccatgggccaagtcctgtactaggccctgggggaaacaaagatgaatgagggtctactctgatgaagttcacaggtgagtgtgggaataatttcaatacactgtgtaaaatgctctaatagctggtactcaaggtatgaaaggactccaaagaaccctttaatatttaggaggaaacagagytgtgattaagaatcccccaagaagcctcgaattgtgtctgcctccttacatagaaaaggcatgttgggcattgagctggtgtgtgagcaatgccaaagggcatctggtcaacctcattgcccaaatccctttctcatcactaccattttgtctttggcttatgtcatccatttttttgcctaaattttctgttccattttcccatataatataataataataatgaatatttattgaggcataattgtaaactcttagaacagatgtacatttttctcccaacttcatcaggtgaaaactattatttgcatttctgcagatggagagcctgaaacacagagagggcacatgtcttgcttgaggtcaccagcttgcaaatgacacaaccactatcctccttccttcactaagttctagccaagctggtctatttcatcagttccttgcagagaccatgctttaagtgcactcagatactttgcacatgctgttccttctgcctggactgctcttcccactacttttttttttttttttttttttttttttttgagacagagtcttgctctgtcacccaggctggagtgcagtggcatgatctcgactcactgcaggctctgcctccagttcaagcaattctcgtgcctcagcttcccgagtagctgggattacaggaatgcaccacctcgcccagctaattttttgtatttttattagagacagggtttcaccaggttggccaggatggtcttgagctcctggcctcaagtgatctggcctcccaaagtgctgggattacaggcataagccactagcacyggcctcttcctactactcttgacccgactacatggttctcacccttgaatgcttagctgaaatgccatctttcttcactagcctgtctaaagtgggttcctttctactatatctttggtttctgcagaagacgtacctcaatttgaaattattttaaatgattgtctgtttatttggtttttgtctatgtgcttctctggactgtaagctcaataagagaaggaacttaactggcttatccatggaagtgtctgcagttcctagtggagtgtttggcatctgatgggctctcagttaatatttgtagaatgaatgccaggtatggtcttaggccctgagggtgcaaaggtgaataaggtgggcctttccctttgggggatttacagtgtagctggagagacaggcaggcaatcagcaactaatgcagtatgctgtgtagagtaggagcatgtgtaaatgtcatggagacacagaggagggagtgactgctttgcctggagtctgagcaaacatcatagaggaagacactgaaatagcccttgaacaaggaatgtgatttcaccaagtgttgcaggcccaggcacgttcagggcagtgaggatggcacacgctcgggagggcctggcctgtttgccctgtatgtgtttatcaaatgcctgctctccacgaggcactatggaatagataccagggatgggtgtttttaggagcttgcagtctagagagayagactcatcaaccaaacttacctggggatgagtttgaagaggaaggcaggggccagatcacagtgttggggtcagagatgggcatggaaacatgtattgcagactgaggtgctgaaagkcatgtagacaggagagtctggtatgggagaaagggtgtcatgagagatttttaagcagggagtaacatcatcagctctgtgcgtaagagtaacccagatgttgatgtggaggttgatgagaggaacaggaagtgggaagcgggagacctcatttggctgctgcaggaacccaggtgagaggtggggggtaagcatgggttgtagaggatgcttagaattcgtttgggtacaagagttacccaaactagccaaagtaggcacaaagttttgtaatttgatccgccrtgaggattattgctcattaaaccagaccaggtagtggttcccaacatgtgtgactagaatttctcatccctcagaacatccttcaacaaaaaagctggaagatggtacatcattcattcttgtctcagaaagttacaaagcacagtggcatctacaaggctctgagaagtcctgcagcagagagacttgtttaattttatttaactagtgtttcccaagcttcttggcaatagaaccctactttaatattaacaccaaaacaaatccaggaacacagtttgaaaaatgctgagaaattgagtaaaacttgtattttcctatatgttcatgtcttggaagaatctacttgctattatgctggcatttgtgatgtcgctgccctggaagccttcaaaatttttgagcaattaggtgtagtagtaagagatagatgccagtgccagacaccatgctaactaacctctctgcacctccgtttctcaacctctgacatggaggtggtaacaataacacctacttcatgggctggttgtgaggattactgtgttaattcccagaagtccccagaaacagtgcctggcctatgggcactaggaaggtgcgatggtttgaaaatgtcacctaaaaagcgtgtgttgggaatttaatccccaatgcaactctgttgaaaggtgggacctagtgagaggtgtttaggtcatgagggctctgcctttgtgaatggattaatgccaatcatagaagggcttcaggctgcaaattcagtctctttctcttgttcacatgcgcatgccctcgctctctcttgctcttccacctcctgccrtgggatgattcagcaataaggccctcgccagatgcaggcccctcgaccttggactctccagcctccagaactgtaaaaaataaatttcttgtctttataaattacccagtctgtggtattctattatagcaacacaaaacagactaagacagatgggctcagtcactattagctattctgagaggcaatataggtagctgatgagaccacaggctttgaggctacactgcctgacttagtaggtcagctcctctgcttactatccctgtgaccttaggaaagcaatatggaaccagctatgcctcagtttcccacatctgtgaagcagggacaattattgcagctacttagaggtttgttgtgaataataaatgaatcaaatcatgtgaaaagacatcgcctggcatgttagatgtttttgcttaaaaaaaatcttttaattgtctctgttattagcataattttatcatgtagaytgrctttcagcttcagtgatgaagatccaatttttgagctttcccagcaagttattttggtcttatgttttggcattcccctcttaaagagtctggaggcctttcatttgaagtttagtttgtcacagacttcctattctcgtccattcagtagactttggtttcctcatctcatggactggcaattgtaaagaaagtcccccgattctggagaccacctcgcccctccactgggctctgtgccttccctaaaaatgcagacatctgtttcaaatcacttagcaaaagaccttgggttgctcttatagcaaagccctcccccagcatggatgcagtctcttgtttcctgggagagagagaagctggattgtttccttgttaaaagttttctgatattatatcagtgtagaatctttggaacagttcacactaacccccacattcaagccacttacctgatatgtagttatcagattccttcagggactgtctgctcttggtgaacaattagattagaggatgctgatgaaatttgagtggcaggaagtagaagttacatttctgagttcagagtttctatttcaaggttgagtaagtggtaaatttttactgcaagattctagcctaacagagttggcttctcaaggtcccccagcccggcccatgggtatttcacctgcttggaaacttcagctccttttcagaggtgggcctccctgttctttatgttggcatgaaaacaattaataatttaagccatgcccattaaaaaaatayaaatgctgtataaatacaatactgtaataataaatttaaaagtcgatccagctgggcgctgttcccacactaccagctgagcagaaacacaaataagtaaagaagaaaactgctatataatgcaaatggctgcaatctcattgttttctgctattgtttattgcaaatatatagtagtaaagttacattatggataagtaggttttgtgggctaacctggaaacctaatcactgtttataacattatttctatgggggaaaaatgcattttatattagaaacagatggtttgcaagaaaacctttttgggagtagaatggatttctaagtccagggccgcctgaaattttaacctcttgctagttgtgtggttgtgttgtattcacagctagtgatagaggaaaattagaggcctytcagaatgcccacttctgtgttctcccccaaatccttgctaaccgcttcatcctacagtctctgccttaccttctgtcttctctgtttctggggtccccatccctgtgtcctcatcctggcccagctccaccctgcaaccactggttgaggtcccaggaagccaggaggaactatgaatgtcctctattaagtggtggttaggatctataggaaggcatgaagccagggggccaagtttgtgggctctgaaatcagacttctgccacttggcagctatgtggccttgatatgttactgtacttctctgagcttctgtttcatccgtaaagagtgaggttgttgtgagaactaactgcaaacactcccatcagtgcctggcacacagtaatgtttcctccatgccagtctgtggtggggtaattattcagggatattatgggttacacatatttctatgaacccaggaagcaaacccactgtatakaaagactttctaagttttcaaacagtgaacttagaaacaagtgtctgggaccttcctgtttatgacttggggccggagtaggtttggaactttttttttttttaaatctgttgggggtgagggagggggcggttacatacttatatagttgaatgccaatatcaaactctagtattatctcgaatacattaagctctacagcagattttatagcaaactaacaagaacagctttcttaaatagtttcattgactgaattgtttctacatacagtgtttttcacataagggaagtctttttaaattaactttttggtttgggggattttttttttttccttcaggcaatcttttctttgcatttgggcaggttctgtattctaatttgcaaayaggcttgtgtctgcctgcaggctttatcatgaaagtattagctctaagtggaaataaggactagaaaaataaaatactgactgggagtctgaggactttgggatagatcctcagtagaggatggagcaaaagtaatagtaagtcaagaaagcaaatatatctctaccagtttccctagaatatgtccattcttatccaaatccaattttcctcctattcttggcctgaagaaattgaaatgaagccattaagatatcagcctatctgagagtgcatcactgaagaatcagcctcactaagagtcctgtgtgacaatgagattttaatttaattagggcagtggctcaagtgtttatgcacttgaccgttgctcttgttgatacgcaggaattagagtgatagctttcaaaaggaattatttcagagtaactagctttgtttactaaaatatgggagctataagatctgctctgtaagaaatgtaaatgtatgagtaatatgctgtcatgaagattttataatctgcagtatttgagaagtaataagatactgttgttggctggccatctggttatacatacttggtgtcatggtttgctttttattttttcattttttatttgtactggtgagaggcaaagaataggagttcagaggtggtgggttgtttttttatatatatataaaaacaaggaatttatgtttagttgcttaacatggttagattttgtttttgccttatgcagaataaaaaatgraaggttcattttatactttcttttccctttttttttcaaaaagtaaaatggaaacctcacccccaatttgtccccagatttaaactttttgcttgttttaaaaatagtctctttggcatgaggaggagtcagacatgaattaaaactctagaaagaaaaatcagcaacagaaaagacctatagagatttcatatttcatcctttcattcaaaaatatttattgaaaccctagtatttgcatatcatgctgccagacactgagggatttgctaaagaaatattaaagaccttctcccttctttgaggagcttagagcttacttggggagaactgagatagacttatgaaatagttaagttgtaattcgaggcagcatatgattaaataccgaaatatgtacttctgacaagaaatgctataggagttcagaaaagggagtgataactcagtggcactactgttttctgcctacaaattggcaaattgtagcactatttgtatgaaatattttacacttgtttttttggcagccttaggctttgactcccaggcagcattaagagccaacaaaaatatttgtactccagtctcttcggaattggcttatttttttttttcttataggcagaggaagtgccttacacaaaccggaktgcccatgagaggcagggagtttttgacagtcatgatctatttcagatacaaccgaaagaaccagcttcgtcattctgtttttcaatccagcagtgcttgtctctccgttgcaaactctctctgacattgacaggcggtttaatttgaacttaatgtcyttgacggatgagctagccatcaagggtcagataaatttatggctttggagaattgccgatgaaaatccccatggttataatgttggagaagaaactgacacagatgtagtgggaggtggaacacagatgtgcttattgggagcagggttccccaaatgtcagaagccggtgacatgctaaaggtattgtgcttggggatgacgtttagtgaaactcactgacttcctgttctatttttgccatattcaaattaacacagagctcaaagatgaagccatgaggcctaaattcttaagaattgaaagagagagagagtagagaaaggagaaaaaataaaacctttaggaagccaaatacactgtttgggcccatccattcctcattccgctcggatcccctccgggactccccgtagctgaatgtggtcatcatttggttgcttttcaatctcatgattcatgtgttttcagtttcttttaaaaattcaccatcactggtttaccacccctgcattttaatcttcagccttgaggaggtgtagtactagaaatatttcgttctttccttgatgctattcaatggaatatctgtggagtccaacaccctttggcgataacgtgctgttggtatttgttcttcttgcyaggttggtgccccgtctggtgaggcaagggttcccaagttagtgtgacctagagtgactgacacatcaagcaagccagtgatctcaccactcagcttctgagcatctctttatcaaagtagttggccctggccacagcttaagacttatctgggtcagcctctgagctggctgacttgggaaaatggccctggaaaaatgtttcacctatatcttttgatataatttggtatctgtctaaataaatggtatgtagcagatggttatggaatgtcttatcaaattcttaggcagactctgcccttgaaatttttctatttaattatcatactgcaaagcacaaaatagtaactttgttattatttttaaacaaaatcaagttacacaataggttgatattctgagaatgaatagcaaacctaaaatttatacaatatgtgaactcttccttgagctgttctttgctaggcatttctaaaagggagctccctatttcagaatccatgggaggatgtgtttcagatatatttggcgatgtcatcttgagagatggctcaggagtcgaagttcaccatgttgtctacatttgttctttgctcctagacatgatggaaaaaaatgctctgctgttttcttgttgcttttcatggttttagcatcatgttcctattctcgctcaaatcaataatccactgtacaargtctggcattttgtactgaagccaagtayaagaaagttttaactaatgcaygtatggggtcgctgttttaactaacacacgtatggggtcgctgttttgttgcctcgtttttttaggtgcacttttcaaggagattgtgtacattcagagaacttasaaaactggctggatatttcgtctggagcaaaaaagtgccctaaaattcagataattcgaagcagtaaagaaaaggtaagaggaaagattttaatttgtcctcgttgtattgtctcattttgcacagcggatgctaaatttcttctgtgtgtaaaatatccattagcaatcaaacatgcttagtgatagcactccattcatttagcactcattaacgaatattgagtgcccaccagatgccatccactctgcaaggtgctggggatacagcggtaaccaagtcacatcatgggcctgctctcatggagtttgtcgtcttgtggagctgaagatgaccctcaatggttgaactggaagaaaagttggacttctaatgttgtagaaatacatattgcttttgaaaataaagaaaaaagaggttcagattcatggtcaacgagataccttaaaggtggcttaattgcagaatttgtttagtgtaatggtcccttatcctaatgtgttgaggcttccccagtaaccatcttatgaacatagcttccaacagtcttggtagcgatggagagaagaccaacatgggcagtgaccattgcaagtgaggtcctttggaaagccagtggrcccttgctatggcagcaccactcttgacaacacatcagtcctgtcattggatgagagaagggagcaaggagcatatttaagcattttcaaatgcacacgccaaccgtgccctacggaaaaagggaattcctgccttgcagtctcagtggtgctataaggaggcattttctccctaatgacggctcttgtgttatgaataattgtacagagtcctctgttatgaataactgtacagcagccagctgacctgtctgttgagctcactgtgttctgtttgaatgccatattaacaaggaaatgggccactttctcttttcccttacactttgccatttcagagaaatagcaagaactttaccacttacgatgatttaacatttaataaaggagagccaaagtatttaatgagtgataaataataaaataatcaagcttctaagttgtaactgatcagaacgaacagatttaaagttatttggctgttgtcactttctgttgtcttcctggagaaaaaaaataataataataactttcatacaaacttctaccagtcctgaatcagagtgaatagatttggtggaaaagattcttaggcatctaaacataggtatatccaaattctaatttctctcatcagtctgaaaaatagccaaatttggcrctaatagagaatagtagaaagtagaataccataatccttgaatatacccaggactctgataagtggttaaaattctggaagattttttttcttatgttatttataaaaatttaaggataatacttcagctaaatgtagtgggaggaagtagcttgttcattaaattaaaagtgctgcttatacaacttccgtacctagctaggggctcactattacaaattaatcactgtttatatctggtctggtacatttcaaaactgcttaccacccaaacraccactggtgttttcttcctcgccctaagtyccactgtggtttaccctaatcttcccagagacttcccacacagccactgcctcactctctccagctcaccaccactctcaaagaagataagaagttcgtaatttgactaaagctatcctttgaaaccaacttcggactaattattttaatagtgttgataagccatctgattctatctcttgatcacattatttcaaaatatttcctaccctattgccacctttggcttacctgaaaatctcaggtctttgtttaaataaacctgaccctgacctatggagacggcagtctagggttgtgttcagttccacctattagctctattcaaaggctatttgctacctgcctatcatatgcctagtaacattctagtcactttgtaggcagagaaaaacctccatataataagaacctctgttcacagaagctttatttctttccacaaaacaattaaaagatagtacatcctcatactcactatgggatcagcattaaaaagaaataatcagagcaattccagttgtcctggagggatttctgtgaggttttgttgagtaaaaacagcaagatgcataaaagtgttcctagcatgatcttatattgatcaaaaaatgcccctgtatatgtttatgtatatatgtctctatatgattatttgagcatgggcaaaaatatagaagaattcaaacaaggttgtaaacatgggctcccctggtggaatgactgatgtggtggagaaggaaagcagagatatgtaataaaaatagaaaagacggccgggcgcggtggctcacgcctgtaatcccagcacgttgggaggccgaggcgggcggatcacgaggtcaggagatcgagaccaccccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgctctccagcctgggcgacagagcgagactccgtctcaaaaaaaaaaaaaaaaaaaaaaaaatagaaaagacacagaaataaaattattattgttattatttattatactttaagttctagggtacatgtgcacaacgtgcagttttgttacataggtatacatgtgccatgttggtttgctgcacccatcagctcgtcatttacattaggtatttctcctaatgttatccctcccccagccccccacccccyggcaggccccggtgtgtgatgttccccgccctgtgaccaagtgatctcattgttcagttcccacctgtgagtgagaacatgtggtgtttggttttctgtctttgtgatagtttgctgagaatgatggtttccagtttcatccatgtccctgcaaaggacatgaactcatcttttttatggctgcatagtattccatggtgtataggtgccacattttcttttcttttcttttctttttttttttttttgagatggagtctcgctctgtcgcccaggctggagtgcagtggcacgatcttggctcactgcaagctccgcctcccaggttcatgccattctcctgcctcagcctcccaagtagctgggactacaggcgcccaccactacacccggctaattttttgtatttttagtagagatggggtttcaccgtgttggccaagatggtctcaatctcctgacctcgtgatctgcccgccttggcctcccaaagtgctgggattacaggcgtgagccaccgtgcccggcctacgtgccacatttccttaatccagtctatcatggatggacatttgggttggttccaagtctttgctatggtgaatagtgctgcaatatacttacatgtgcatgtgtctttatagtagcatgatttataatcctttgggtatatatccagtaatgggatttgctgggtcaaatgatatttctagttctagatccttgagggattgccacactgtcttccacaatggttgaactagtttacactcccaccaacagtgtaaaagtgttcctgtttctccacatcctcttcagcatctgttttttcctgactttttaatgatcgccattctaactggtgtgagatggtatctcattgtggttttgatttgcatttctttaatgaccagtgatgatgagcatttttgcttatgtctgttggctgcataaatgtcttcttttgagaagtgcctgttcatatcctttgcctactttttgatggggtcgtttgctttttcttgtaaatgtgtttgagttctttgtagattctggatattagccctttgtcagctgggtagattgcaaaaattttctcccgttctgtaggttgcctgttcactctgatggtagtttcttttgccgtgcagaagctctttagtttaattagatcccatttgtctgttttggcttttgttgccattgcttttggtgttttagacatgaagtctttgcccatgcctatgtcctgaatggtattgcctaggttttcttctagggtttttatggttttaggtctaacatttaagtctttaatccatcttgaattaattttttgtatcaggtgtaaggaagggatccagtttccgctttctacattttktttttttttttgagatggagtcttgctctgtcacccaggctggagtgcagtggcacgttctaggctcactgcaacctccacctcccaggttcaagcgattctcctgcctcagcctcccaaatagctaggattacaggcacatgccaccacgcccggctaattggaataaaagtattccttaaacaatatggttcytagaggagagacactagaaactttttttttttttttgacagggtctccctctgtcatctaggctggagtgcagagacgtgatcataatttactgcagcctcgaacccctgggctcaaaggatcctcccacctcagcctcccaagtagctgggactacaggtgtgaaccaccacacccagctaatttttaaaaattttttatagagataaggtctccctatgttgcccaggctggtctcaaacccctgggctcaagtgatcctcccacctcagcctctcaaagtgctggcattataggcataagtgaccatgcccatcctagaaacattcttttacaaatcagaactaaaacaaggaattccaccatcgctaatactgttgacattatttgtaaagccctgtccactgcagtaattcaagaaacaagtaatacaaattattatttgaattaaatataaaaaacattacttactcatcttaagtggctgcatatctgcagaatctaaatatgttagctttaaaaattattcaaatgaattaacgttaaatgaagtgctgaatgttcaataaatatttaaatatcaataaccttactacatgttaaataaaacaaacttttaacttcatgaataaaaagtcctattcataaaaacaacagaactactsagcyataaacttaaagagcaaggtacatatcctgcattaaarccatttttactaagagatatgtgttggagtcagctaccaaaaatagtaattttgctttgaacaacttagcttaagccgttctttgtaatagtagttagatagcagagcagtggtgtattaaggctattttttttttttgagacaaagtttcactcttgttgcccaggctggagtgctgtggcgcgatcatggttcactgcaacctctgcctcccgggttcaagcgattctcctgcctcagcctcccgagtagctgggattacaggtgcccaccaccaagcctggctaattttttatattttaagtagagacggagtttcaccatgttggccaggctggtcttgaactcctgaactcaggtgatctgcccgcctcggcctcccaaagtgctgggattacaggcgtgagccaccgtgcccagccttaaggctatttataatttatcatagcaaaaccttattaattaaaaacataagcataaagaaaaataaaaacaaaaatacaccaagtattttcttagaatatatggaaaacatcttgaacatattcaggcatgttctacatttcttggtgagaagatatcataaaaatgtcacttcttcctcacctatttttcttgatttcatgtaattccaatgatttttgagttagtgtttatttaaaattaatataaaattcatctggaatatcatgagctgatcaagaatatccaaaacatattttggaaaaaaaaaagaagtcaatttaggcaagaccactcccattagattgcaaacatagatgatagatagatagatagatagatagatagatagatdtcaaaaataatttaatccatgattctggtttaaaaataggaatatagattcatagaatatagtggaaagctcagaaatagatgtaaaaattttaaagaacagatatcataaaataagaggaaacaaaaattatttcataaaatgtgtgagataactggcttatactatggaaacgtaatttcatattttacattaaatataaaaataaaatttagactaattaagaaattgatatgtaaagcaaagtcacagaagaaccaacagaaaatgaagttgaacataatttgaaagtatgatcatttattttacctctgaagcaatatagtatgtaataacaaaagaaaaatattcatatacatgatttccttttacaaaaaataagagttaacttggccaggcatggtggctcatgcctgtaatcccagcagtttggggactgaggcgggcagatcacctgaaggtcaggagtttgagaccagcctggccaacctggtgaaacactgtctctactacaaatacaaaaaaattagccaggcgtggtggcaggtgtctgtaatcccagctactcgggaggctgaggcaggagaatcgcttaaatctgggaggtgaaggttgcagtgaaccaagatcgtgccattgcgctctagcctggctgacaagagcaaaactgtgtctcaaaaaaaaaaaagagttaactaaagcacacacttcaggaaaatatttgccactaacaaaatattcatcataatgtaataacactaagaaaaattaaaaagaaaaacatcaatacaccaaaaagtaagtgggccaaaacacatatattctcacaagaggagattcagaaagtagatataaatatggaaatatgttcaacctcactagttttcaaataaatacaaattaaagcgataataagctatgctaacacccagtgttggtgatgccaattagcacaacctttttggaaagcaatttggcagcatgtttcaaaagtcataaatatattcattccgtttgaagcattaatttcagccttagaatcctgaggaaataacttgaaagaagaaaatccctaggcatgaagatgctcttgccgtagcatttatagaattagaaacctggaaataatgaaactgtttagcaataacgaatgattcagtaaaataagatatgtcgatctgataagagtgttgtgcagcaagcaattctttggccttgtgaatgttgcgggctaattgacaccccagctccctctgcatcccacctgccctttaagtcttcactccctctttatccagcttgattcacgaaaaagccatcagcctggtaaggagtcctatactgggtttcttaggacgaagcttcagctttttaactgtactcgcctggaccccaagttacgcaaaaataccttcacctcactggctcctctctccttccactgcacctgaaaaaaacatgctgtctcctcttttcaggtccactccaacctggtttctgccccagtgttcccctgaacctgttcttgctaaggtcactagtgaactccatgcagccattccagcggacactgtaaggtcctcatctaacttggctgttagccagcattcttgaaactgtcttttccattgctttccatggcaygcccactccatgctctcctccttctctgtggccaggcctcaattcccttgctgggccttgctggtcccttcyctccctgtctctaaatattggagccatttaaggcccagttttggctcttcctctcttcttactctacatttcgtctgtagacaatcttattcacttccatggctttataaatcatctgtatgttcatgtctcctttatccccaccccagattgatcctctgagctccaggcccatacccaacttgacacatttgcttgagtatcacacaagtatcttgaactacatacacctaaagctgaagtcttgaatcttctacccatctgcctctccatcagtatgccccatctccatgtatggtacctccatccatcccatttgctcaccagcatcctccatatccacatcccccacttccagtcctgccccatgccacttctaaggggtaccttgactgcctcgttctttcccttttcattgtaccatcttagctcagtcatttcttgatgattccttgataccatgtgaccttccagttttattctggtggaatgttctatacttctactagtctataagctctttgagggcaaggaccatagctgtttggttcactggtatattcagtacattgtgcagcacttggcacatgttgcaagcttgatgaacatttatggaataaataaatggaataattatagttatgtaaaagctacatatgtgagaactagaaggaaatgtggaaactttaaaagagttggtgaaaatgtgatttttaaaaattctgatactcttgttataacgtttgagtgtgaattcaatttaagacatatatgtatacaagataagatgtgtggtgcggatataaatgctgcgttgaagattsagcatgaatgagagttcaggcatttgttgaagatgagttagtgggaatggtttgggatctttcactgtgctcagaattccctaaagataattgaactccagtccaggtgaagtggactgaaagaacttgccttcttccagcatgataatatggccagaactttttgaaaatgggaagataggggtgacctccggggactagattagacttagcaagcttatcaaagaaccagggagacagcagagtcttaggtggcagtgcctaagtctgggaggaagtgagaagtataacagaagacagagagctgccaggttgtctagactatggctcttcatagggggtgataaggttaccacttcctgcactcccaggttccttttacttagygctcattcccatcagatcccatcatgcgcctgatgcaaaaggagtccactgttggcatgttaattcctataatttcccttctgaacaggacacctggctgccttgttcctttggaccatttccttgggaaaaagttactttggggacatttcaagattgtctttttgtgtccctactatacacacacacacacacacgtacaggcacacagatgtatccctgtacacatacaaacatacacacacaaaaacactccctccacccaattttgatcatatgtttgaccacaagcaaaaccttaactaattctaaagcacatttcacaggccaccttctttaatcattatctaacaatattagcaataaggaatagttgacaaatgtatcttcacacctaggatcatcaaggcacgctgtcttaaatgaaccccagatcaaagagaaacagatgaaaaamgtcatgtgtttggatgggaataattaatatcataaagacagaaatttttctaacattaaggcatatatttaatacaatttcatttagactcagtcccctcaacccctttggataaaatgaatatagatgaataatgctcaggaaatggtaagaaaattatgaaaatagagataaagcaggagagatttgccttatcagatgctaaatatatttaaaattacaggagtaaaaacttaatggcattggaatagaagtagatcaatagattattagagcagagcagagttcagaaatagattccagataaatggaaatttaatataggacaaaatgatatttcagttcagtgggaaaaggaggtttgtttttgtttaataaatggctgtgacataattgattaaccatctggataaagttggacccttatctcacactgtatataaaaataaattccagatggattaaagatataagcttaaaaaataaagcaataaagatgttggaacaattttatatttgtccataagctagagtttgggaagcactttatagccgagacaagaaaccctgtatttgattactcaaaagcacattgtgtaagggtaaaagatgccacaagcaaaagttacaagacaaacaatagattaggagaaaaatatgtgtcagaaatatgacagataaagattaatatctacaccatacagagagctcttgaaaattgataagaaaaatatacacacaaagcagaaaaatggtcaaagaataagaatatgctctttacagaagagcaaaccaaatagccaacaaaacatctattcttttatatttttatttatttatttattkatttatttatttatttatttatttatggaggcagtgtcttgctctgtcacccagaaacatctattctttacatcagctcttctgagaaattctccctcctgtggcaggtcaaagggtgagatcatatgaggctctatgatggatggaaatgaggcaaaaatcatcattttttccccatatcttccccgcacagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaaggtatgtggattcttctgggttatttttgttataaaatcaaaaaaacaagggaacctcctgagtttagtttgcccaaggaatatgaatagttccccctctgtagactcactccctcactaccccctggttcccacttttgctctgggtcctcctcacctctggtttacctcattcatttactccaagaccccactatcagatatgcctggacaatgacaagagaagggcaagttggataggagagtgcagaaaagccagatagcactgggccgactacccaaatggtttagataattcagagatctgaaaagcaagaaatgccctgggtgagatgagaaattttaacaaccaatgttccatcagtttgagttcattgcattcatacatccatccaggaagtatttactgaacatctactatatgtgaggcactatgctaggtactagggatacagtgactcccccttgcccctaaaaaaaagactgtacactgggatagagagaagtaagtagctcattacaatgcagtgtgtaaatacagggaacatagagtaccatgagaagcacatgaaaaatgtaccttaccagacatggtggagggggaaggggtaaggaaagcttcctggaggaagtgatgtccagacaaggtgagggtagagttgagccagacaaagasgatggggatgggtatttcagacagagaccaacctgcatgatggccaggagacaaaaagctttatttgaagaaccagaagagcttctacatggccaaggcacatggggtaggggaaggtggaaaggggagacggagggaagatagataccaaaggaggcagccaggggaccatgaagggccttgtgaaccgtgaatcctgcgagctgtgatgaracactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaayagtatctggcacaacgtaggcattcacaatcaataaatgtttcttgaatgaatgaatggcttgaaggtggagaatggaccaaagaagggaaagactgaaagactgagttccaamagatcacttggaggggtccaagtgagagrgaaagtgaaagcggaaagctactggagggtccaggtgagagggaaagtgagagctggaggagaagccaagggggatggagagaagtggattcaatagatggtcagtaggtacggtgggcagactgaggactcctgagtctcttcgaatgagaaagactagaagtagagttgagttcatggagtaggtctccaggactgagtgatgatcattaatggagctgagtgggttttatggtgagagctggagttacccaatatcttagtccattctggctgctataacaaaatrccttagactggataatttataaacaatagaaatgtattgcttacagccctggtgactggggagtccaaggtcaaggctccagcagattcagtgtctggtaatggcttggcctctgacttcgcagatggtgccttgttgctgtattctcacatacagaaggggcaggggagctctcttaagcctcttctataaggacactaatcacattcatgagggtgcagccctcatgatttaatcacttcacaaaggccccgtggcttaatactatcacattgggtattagattccaacttatgaatttaggggagacataaatattctgaccatagcacccaattgatcctaaatccttcaaaaggcaatttaatgcaccaggccagagaagtgagcttaaaaatgctctcagccactgggtggtggctgtttgggtctgattgcttggaaaatcacctcaattttccactttactttgtccacactgtgcagcctttgtgatgcatttctggttaattttgttcattaaaacgcagaccttgctcacctataaaatatgcctctaaagtatttgagatcacyttgtaaagctagttggttgcttttagcgcctccatccgttgcacccaacccttcacctgcygttttctgaatatcttacatattctgaacgggcaaacaaatttgcttcccagcctcttgtactcagccagccggtgaccattgccaagcctttatccatggccttctttaaacctagaatggcttccccctttcacaaaatcctgtctccctttctgctttgaaacattggagaaaagtcacctcttccacatgcccttgccagattctgctctgactttctcagccattctaacacccctttggtcctccatgcacacccctatcttggcacccaggttaccagagggaactgaaaccactcatatggttgtttccttgactgtgctgtcatcacctaaattattttacctcttccaraataactgtaaatgctttcctagaagaaatcatgaatattcatttccttgtgatatttccaaatagagttttgtgcctatttggtgcttgaaaaaaagtatgacttttgcagtcttcatcaccggacacttatagattccactggagtgtattttcactgggagtccctctgagctgactgtccctgtgttcattctactcacatgtatcaagtgtctgttcagaggcttttgcagagaggtcatgccagccctccaagcctctttgtcttgagaacagaagatgatcatttcacacacaccctctgtacgtgaaccgaattttatgtggaattctgactttcagagggagtgttattgctgtggagaaggaccttaaagtaagggtttttagactttgggaaccacacactaataaaatttcaatgagaaaattagggttgccaacggagtcaagccagcttcttattttgtcaagacttagatttaaaaagcaccctctcggccaggcatggtggcacacgcctgtaatcccagcactttgggaggctgaggcgggcagatcacttgaggtcaggagttcaagaccagcctagccaacatggtgaaaccccgtctcaactaaaataaataaataaacaaacaaataaatagtaccacctcctattcctattaattcaccaaaggaaaaagatattaataccttgttattagcactggtccgtggacagaaggggatttgaaaggtgctattctgtgttgtggccccaaacctgggctctatacaattgttccatggggagcaatgcaaccacaggttcctgggtccaccccaggcttgctaaatcagaatatttaggggcatggccctgggatctatagctttgtaaatttctcaggtgattctgatagagaactgggtttgggaatcactaccttggatagagcatatatgtttaaagagatacaggaaatactacatttctctaatgctgatttagtagttttgaaatccttgttattttgttcttttggggttttctaaccaatgagtaggttttcaaaggcaaataagaaaacctttatcacagatttggtgacagttgaccccaagaagatcgtggaacccagcccatggaaactacactttagagtatgttaggtaaatatttgcagcgtggatttttctgaaggtgcaggatttctaatgctccggttttcatgttctaggcacttcttgctcggtgacttgttttgttcttatgccttggccaattaaaagctgagatagtgatccctaggagagtatgagatgtaaatgagctgtaaaatggcttcttcmtagtgattaytcatgggaggcttggaactmgaggtgggttcagtctgtttggaggcttgagctgtgcacttyggctgcctgatgcgaatggcctatggggaaggaaccacatactgattgaaatgttagcaaacagctggcaygctcctgcccactatgcagaggaagcaaaaatatttatctttttttgcatttacagctatgcttgactatagcaggactccaccgtaaatgacattttccccccttccctccagatgtttcagttgtcaacgtgatgttctccttcggttcttggaatttatcagacagattcaactttaccaactgctcatcattaaaagagtaagattttatttgaaatttgaatattctctcgttgatcttaatttacttatttgtttgactcctcgatttcctaaagaactcttttgtgagacagaactttccaaaatgccttttgaagcatggtgtaatgggagataggagagccaccgagctaataagctccgctcgcacattctagccctgastagtaagctggcgctgygagggagagaaatcccctgtgcttaagtgttcatacccacagggaaatatgtcttcccaggaccgagaggcagccttgaagtaagtaaagaagaagggacaagccaggtgtggtggctcacatctggaatcccagcactttaggaggctgaggtgggcagatcgcttgagcccaggagagtttgagaccagcctgggcaatatagtgagacgccatcgctacaaaaaaacacaaaagttagccaagcatggtggtatgtgcctgtagtcccagctacttgggaggctgaggtgggaggatcacctgagcctaggagatggaggttgcagtgagccgggatggcgccccgcattccagtctgagtgacagagtgagattgtctcaacaaaaagaaggagcgctgctaggttctcttctgattggaatggcttygggaatttgggcggaacgagaagccttgagtgtaggggtaaaaagtcttacttgagaaggacaaggtgaagtccctttcaccaaaagaacatgttcctgctgccccccttttcaccatctttggcctctttgagctacataggcccctgagttagtgccaaacctcactccttgcttctaaagcagcaagaggacagaggaaatatgtttctcagatgcctgacttgccaattggaagttgggatggaggcctgcagggcaccttgggaggctgcatgagtagcagtgctgtagatcactgcatagtttgattgaccagttatgtgagcaccaaatgggagtttcttttgtcctggcctgggaaccatggtttctatggggaaaatgaatttgaacttgaagctgagctaggaggctgctcttgaatgattagaacaggagcccctgggcctcatctcttccactgaggcactttgaaaaagatgacacaaggcccagttcaattattgctaagaaacagaatggatttaaggagaaaaaaatacaaaaattgctacagaaagcctcagaagttcatgaaaataggaaaaaagggtgtgaattaaatagaattatatagctcaaagacagttgaaagaacgtagctcccccgatgcccactttaaggccagatgaaaggaaccgactagccccaggtcccacaacttggtaattaagaaccagacctcagacctaggtcccccagggagggtgagcgccctttccataggtaactgcttcctgttaggaaagcacttagtacagtaatcacaccctgggggtagaagaagcgagcaaatcacaaacccgtgtctagctcacttaggtggccggatccacgcaaaagccagtgtgtcctctccttccacggaaactgcagtttctgtagatcagaatctcagaatgtttcctcatttcttggagaaggtataaaacaaactgggtcccccggccctgtgctagcaccccttgctagagctaaggcttcctctggcctcccttggccctgtttccagatcaaccctgatttccctttttaacattccttctcataagtgcttttcaagtcctccacagtttacccaatcatgataggtgatttgattagtagaaacacaattcttccttaatttgattataaagcaaacacaggcacctcgttgcctctgcttgccagctaacactttctgtctcacatcttccaggcagttggcagtgtgactgctggagtgagtgagggcttcctgattttggaaggcagagtgggtagaggcggggagagagagagatccatctccagagggacttacctgagggtagacaaatagcagaactggattcagaaacagattcattgggttcctattatctacagaccagcaggtgacccagcttcaggtttccatggcaacacccctgcaggtgccattccggcccatcaacctgagggcttccaagagcagggcacaaagcctcacaggaatgtctgtccagggatttttttttttttttgccttcttttaaatgcttgcatgccacatcacagagggaaattctaggatgtgaacattgtcctaaaacgcaggaattaagtcagttttctgtgttgctagatgcccagcatgcgtagaaactggctgcgcgtggtgtaaaagtgcaagaaggtgtatccaccccttcacagcttgcgacccttctgattatgagagaaaccaggtaaagtgacatttttggtattgtaagtcttaaccgccgggcatggtggctcacgcctgcaatcccagcattttgggaggtcgaggcgggtggatcaattgaggtcaggagttcgagaccagcctgaccaacatggcaaaaccctgcctctactaaaaatacaaagttagtggggtgtggtggcgcatgcctgtaatcccagctactcgggaggctgaggcaggagaatcacttgaacccgggaggcggaggttgcagtgagccgagatcgcgccactgcactcccagcctgggtgacagagtgagactccgtctcaaaaaaaaaaggtttaaccaaaaataaatgtttgtgactgcctggtcctaccttctcttttatgtttgttgcacactttgaatttaccacccatctggatgttgaagggatgttctccattccaggaacagtgtccagtggctgtcgagaagacatcaggaggaggaagacccaaggagaacaaggggaacagaaccaaccaggctttacaggtcagaccctatttttgtgtggttgaggggaaaacctgtctttgaaygaccatgaccacaactcatactactttgggttccttaaaaaaattctctattttactttctaccaaaattcccttttgtrtctttggttttttaaccaagtttcacttaattagcgcaatacatcaawgkctggacactcacataaaataaattaaaactctgtaattatgaaaaatgatgttgctctggtcgaaataaaattgtaaaggtgactttgcggctcactggtgaagagctggaaggaagtttagcattccrtctgagggatttcaacttgcactttatataattgcgtttctgggggttatgtgtgtggatgggggtctgtgcaaagtgtgcaaactaacctcgattccgttgttttttttcaactttgtagggacgtctaaccagtagtgaacactgctaaaccagaattgttatagaatgtgtatttctctcgccttctcacaagcagttattaatccatgaactttccttggaaatgcccgttattttcttcatagtaaattacataagcccccacgtcagtcatgtttgaaaagaggggacatgtcaacgtaaacatttctgggcggaacacatgtggctgtgcttacaacttcactcagtcaacaaaagttcattgagcatctatatgtggtaaaacacaaaaagaggataagtcctgccctcgctaaccttggagtctagcagaaatagacaaattaaaaatgacagctctggggagaaaagggctccattttccatttctctaatctgtggttttgacttctccacttgctgcttacctaaggtcaagtgcaaaggtaaataagtagcatattttgaatcattactgaaaagtttatagtaacttcaggtgaattaacaaccaggcagagggaatatgaatcaaatggatatgaagttaattaaaggcattagaaaagcttgatgctcaggtatctccagactttagcagtctctgaggtcttgttaagtaatgggctccttttctcatcccattggtttggaaaactaagacacagcgacaaggacttggatcaggaagacagtggctttgtggctttttctttttaattaaactttgttgttgttccagggtttgtttgtttgttttttcgttttgataaaatacacaaacaaaatttaccatttttattgcttttaagtgtacagttagttgaggtaagtacattcacatcattgcacaacctatctccagaactcttttcatcttgcaaaactgaaactctatgctcgttaaataataactcttcatctctccttccccccagcccttggaaaccgccattctaattttttgtctctatgaatttgactactctaggtacctcatgtaattgaatttgtctatttgtgctggcgtctttcacttagcatgatgtcctcaaggttcatctgtgtggtcgcatgggtcagaattcccttcttttctaaggttgactaatattccagtgtatgtatataccatattttgtttatccattcatccatggattaacgcttgggtcgcttccacattttagctatgatgaataatgctactaggaacgtgggtgtgctgctatttcttcgagaccctgctctcagttcttttcggtatatgcccagaagcagaattactggattgtattgtaattctctttttggttttttgaagaaccattgtaccgttttccatagcaacgataccattttgcattcccaccaacagtgcacaagggttccagtttcaccccatcctcaccaatacttgttattttcgattttgtttgatagtagccatcctaatatgggtcaggtggtatctcattgtggttttgatttgcatttccttgatgattaatgatgttgagcatctttgtgtatgcttgctggccatttgtatatcttctctggagaaatgtctaatcaagtcctttgcccatttttaaaattgggttatttttgttgttgttgagttgtaggagttctttatgtattctggrtatcaaccccytatcagatatatcatttgcaaatattttctaccattccataggtttccttttcattccgttgactgtgtcctgtaatacacagagtttttaattttgatgaagtccagttcatttattttttcttttattgcccatgcttttggtgtcagatccaataaatcattgccaaattcaatgtcatgaaactttctttctgcatttatttgtaaaggtctgtagcacttatattttggcctctgattcattctcagttcatttttatatatggcataagaaatgggtctaacttcattcttttgcatgtggatatccagttttcccaacatcatttgttgaaaaaaatgtcctttcccccattgaatggtcttggcaccctcgttgaaaatcatttcaccatatttgtgagagtgtatttctgggtgttcttttctattctattggtctatgcctgtctttatggcagtamcgcactgtttgattactgtagctttgtaaagtaaattttgaaatcaggaaatgtgaattcttcaactttgttcttctttttcaagattgttttagaaaataataaacttttaattttgagataattgtagattcacatgtacttgtgagacaataatacttaatatcttttacccagtttccttcaatartactatcctgcaaaactatagcaaaacatcacagtcaggatattgacgttgacagcagtcaagacacagaacagctctatcrtcacaaggctccccaggttgccctttcacagtcgcatccatttccctcctccctcccattctccatctctgatgcctggcaaccactgacctcagctccatttctataattttatcatttcaataattttatataaacggaatcatccagatgtaccctttgggggactggctcttttaactcaacataattctctggaaattcwtccaagttcttttatgtatcaataattcattcctttttatcgctgagtcgtggtccaggcagcggctttttaaacttctttaattttaaagataaatatcataaagtcactacctcctggtttcctgcagtgtatctctctgcaccctttgaactgtgtggttaaaaggactggggtcaccacaagagaagaagaaggctgaaaataaacaaaagcccagatctgtttttagtgcttctctgtggattacccctctaagtgtggagaaagacattttgttgatactgacatgttttctttaaatatgtgactcagagcagaatctctcttttgtttgatagggaatggagtgttatttgtcacaggagggatttctcgtgctctgtcaaacactgctgtctttcattatcaggtggaatgtgtaacattctggtttccactttgggccttcatgttggccttgaacaaagcacccaatgtctttgtgattctgtttctaccagagaagtcactcacagctttgcttcaatgcatctgcccacaccacatatgtactgagtacttcctgtgtgctaggcactaggaatggagcaggtactgtcctaggcgtctaggatcctgaacttgagttgattctttctagaggcatttattgcacacctattagatgcaaktataccgacctccacagattccatgaggaggattcagatgaatcaggcacatctctggccatcagtctcaagaatcttatccatgagtacatgagtaaaaatacaagattttaaaaatattaatatgaaggtacaagaaagtacacagagagcctctctgtgcccggggctttgtcttagtccttcctgtttgcttaaacccagtgccttgaagttgaaaacacttaatcagtgtggttggttaagtctttgattgatggatggattgattgctggagatggcatttcagcccacctttgaggacgagaagcatccagacacatgaatgcgggtatttgaagcagaggaaccagcatatgcacagtgtaggggtaggagccagaagattccaggacacacgctagaggaaaccctaagtaggcacagaggatgcaggaaattatgagacacaaggttgaaatgaccctggagcctgcatatatagggcctcacataccagtcctgtgagtgctcrctttattcttcagtggcartggaatgccattcaaggtatcttattttatttttttagtgtatgagtttgctaatccaaggatctggtacttatgaggtagggtcctggttcagtccctactaggccagtagccctcacactgtttcatgaccccaagacctacycctgtatcctgaccctgaaacgtatagcgtcatctgccaagggggctgagttacagaaaagtgtgaccacaatagagaaatgagctcaaaaatctatgtatgaccttggaggaggagtatttcaagctataaaggccagtgtctgaccgtctgtctgtttctttccacatatctagtagttgaaaccttgtcagggaccgttggccctttyaccctgccctgaccacttctccttccatttcttaacattctcatatctggtgccttcactcactgagaccagagatagttcccctctcttttgtgcattcaaggagagattgtgaagatttatgatatgatgtcattctaatatttgttattaccctcaatatgcttatcactatagggcagaaataaagcatacaaagtcatatcccctggcaatttacattcaaatggttctttctcttccttgcacctcctcttctcttcctccatcacttcttcccccctccgagatggagtttcactcttgttgcccagggtggagtgcagtggcacaatctcggctcactgcaacctctgcctccccagttcaagtgattctcctgccttggcctcccaagtagctgggattacaggcacccgccaccatgcccagctaattttttccaatttttagtagagacagggtttcaccatgttggccaggatggtctcgaactcctgacctcaagtgatctgcctgcttcagcctcccaaagtgctgggattacaggcatgagccaccgcacccggcccctccatcacttttgaatatgcatttttgatctctcacaggcaatccagatgaatgcttttggggaccttgccttcaagagtgaaattaaatttcacatataccttgctgagtagcttctatgggcctagcatagagccgggtactgtagaattaacttacaatcattcatttattcattcattcaaaatttgtttgctgagcaactactatgtgctagacaggcaggcaaagtgtgtgactgcatggagcttacatggtagaacttataatattttggaggaaataagattcattttcatgaagcagttgcatgtgcacaagagaaaaagatacaagagagaatgccagaatgtactcaaatgaacagtggtagctaagattcgctgagcctgtgccatgccctgagctcagagtatctaagcctcacaatggacctattttccccattttatagataaggaaattttagctcagagagagcaaatggtaggtaagaaatatgaatccaggcaatctgactcaacagagttttaaccattaccctacattgtatgccctaaattgaatataaacattggttaaaccatactactgatgatattaataaaagtcagtctggaaaggactctaatattggcttctcttggcattagactgtcaaagcctgcccccgatccatgccacacatgtagggtgggagcaagacctccaacctggccaggatgtgggaggagtgtattaacctcaaagacatgggagaaaggggtggggcagggtgtggtccgagggaaggagtcagacccagacacggctgggcatctgctccaagacarggagagcagaataggcttagtgaggcaactgaggccctggggagaggggagcagcaagaatctcatgcatgagtcgaatcttggccaaagggtggactttgaggggctgggtttaaattagaatcagggccctccactggctgggaagagctgccctccctggccctggagttttggtcacccagtccaggtctggggagccacactcagaaggctcaaatgccaagaggaatagcaggttgttcggagggtgggcttggcagccaagtcagcctccttttagagtctgcagctcagagaagtgagtcttgatctcttcgcacagggcattggtctgtcaccttctatctggaagtctcaagctctgtgtccagaggcactgctcactattggcatttccagggccaactgaaatcacatctcaagttccctggagcctgtaccgaggggcccccgtgaaaaggcatttgtcccaggggctaagcatcaaatggataaccattttgttccatttcacactctaatttttcttgagtggacctgtattttgctattttctttccatatctcacctccttttactctttcccatttccacggctggttaccactcttaccaatttatacatttcattaatatattagttctatcctcttctcagtcattaataaagatgttaaataatcctgaaccgaatactcactcctgtagggccctacaggactctttcctttaattagttgtgctacctttcatctatctaatgtccttcggtttcagatttccagctggttttgaatccatgtgactttttatctagtcctgtttgaactaatttcatgagtgaaaatccgagagatgttttactgagtgttgattcaggtccaggcctacagagagtttgctatattcagatttttttttaacagattaatagagtacaatttggccttaataaactgagccctcctaatgcacctctttccaatattcttttcaatcatagcagtattttctccattaatgtcatggtaatttgaattgtgttgacgtcagacttcacaaaaggtactcttactgtcagaagtaatcctcttagaccttttgaaagataactatttcttagtggttgtgctatttccaatatcctataatgacttagttaaaaataaaaaataaaaaggatcgggtattctataaatctcctaattaaccagcttctaatgtgctttcttatacaaaacagggactgaaagccagagctcatagtagtttattaaataagttcaaattgtgcagccatttaaaaataaccctgaagtctttaaaacgtaacctacaggaagcacactattctgaggttaattgctggacaacatagggctgtgacggttatagtcaacggtattttgatttgaatacatagaaatccttggacatagagtgagggaggaatcccacgatagggctctaagaatttgtctctttgtattgagctcaattatgttttacaattaactccctctaaaatgcataagcttatagggctggctactatatgccaggttttatgaattaactcttgatgaaaatacaaaaattgatctaaaatattgaatgtgtagaacctttatggggaaatgattctttgctcttttgtctgtactggatttttcaaaatctttattggtaaaaagaaagratgtatttctaagaattgttgcaaccatacagggcagccatggagctgactctacattttgttttaaaaatgttgttttatacctgcactatttatttaggagggtcctcttggtagctctttaacccatttattaagattagaagaggttccaccagcaaacaaaagacaactaatctgagtctgtttraaagcagactgaagcacccactttcacaagacaggccagggctggattccatcctagatggccaagagaaccctctctaaacaataggggtttaaaatgtttttgaagtagcaaggcggtctccactcagggaaataaaaagttaataagatgatgtggcaagtcctctgatggtgttcgtagagccatttaaggagcaaaatataacttccttaaaaaatcttttttacattagttgtaaggctctctttatcctctgcagagaatggagaagaagcatttacttggcatgtttgaaaattttgcttgagcagacatcaacagtataaatataagaagcaggaaggactatctagaaagaaaagaaacctgggaatcatagttgacttggatgtaaacgtgagtctgcaatgaggtttacataaaaaaagaaaaaaaattctatcttgctcccctaagaagacagtggactcctctagagcagaggtcggcaaatgttttctacaaagagccaagacagtaaatattttaggctttgcgggccgtatggtctctgctgcagctactccactcgactgctgcagtgcaacagcrgccagagacrctacccagacgaatatttatgggtgctgaaatttgaatttcatgtgtttttwtatgtcatgaaatattattcttcttttgacattttgtcatggcccatacaaaagcaggtagcgggcaggatctggcccacagactatagtttgccaactcctgatctagtgcacacatagatcatgtgtcccccacaatatctggcctaaggaccctgtaggtgctcaataaacacttgttctcttagctgtcaccacgtaagagcgaagagtaagccttttgctatataacacacacttgacatttgcaagagatttatcttgaaggctttgctaatccccccattccaagtaccactctagcagataatttcccccataaaatgcagtcaagtataacagaataattaaagtgaccctttcaggcccttagtgattctattaatacagggctaacgtccttcacaaagtgattaaaataamttctgctaccaaaatcaattctgtgtcatgttacatcattgctgtgatgacattaacratgaatttacctcaatctgcaaaaccagtccaaagcgctgatgagtgatggggacgactgtgccgtgtagcacctgtgtgtgctggggagcagaatgagaaaatgtctgtttgagcaggatgggcagcccctgtagcccagcaatgccaccccaatgagtgttccatgtacaaaggagsagaggatactcaattgcttcaagaagcaggtgttaggcaggtgttggacatcacggagttctcccagtggctcaggggcttcttcctggactcggtcctccaagtggatgcactcagcatttagaatttcaccaaacgtcatgtgattaagcatctctggacyttggggtcattttcaaatatcaagactgagtatattctgcgatggtagaggatrtaggggaaaaaagagtgtgagtatgatgttcactcttgctgaagttctgctggactttatattgggtagaatcttagaatcttatgtccygttttggtcaccgtattatagaagaatacagacttgctgaaaatggtctacaaaagaacagtgaaattatcagaatgatagacagtagcatctgtaacataaaagtgaaagaactcaggattgttttatcttgaaaagggaaaatgattcttgctatcaaataaagggcttttttttwaaagggagaatttgattagatatcacaaatggagaagtaaggtggcattcacctatatggtatgaagctaggtagcaagggactccaagggacatgttcttgaccttaggcctgataaagtctattgaaactgggtagcaagaaggaggttgtggtatctacaaaccttggttggccacagtggtttagacatccaactacttgatagtaggtgactgaacaggttgatttcttgaggtttttccccctgcagtatcctcctggattcaaatagcctcactgtaacaaaaatatgactgctttcttgggaactgaatttatctggaatgacatttatttcaacttaacgatgagtctgtcattggcctacggtcaatggactctctttcttttccttgattttgcttacattgtgagcctccagaggctgtaaggcagtaaacattttcaaaactctagtgatacctcactcttcagacagaatatcagacttttcaactgtattttcaactgtcttgtgagacaaagactaattggtttgacctcatgctgtcacatgttgagagacatgaatctgcagccctcttccttgaattcattgatttcattaaacactgtctgcttgtgttcgcaaaatgttgtaatttcccagtgatttcttcgaactgcagcgtataaacagatttttttggagcgatgccatttcttagctttgatctcctgttttaatcttttctttccaataggtcttctacattaagtccattgagccacagaaagtatcgacattagggaaaagcaaygtgatagtaacgggagcaaactttacccgggcatcgaacatcacaatgatcctgaaaggaaccagtacctgtgataaggatgtgtgagtcgaaatactaataatttatcctcggtaacgtaacgctcaaacctgtgccaaaggaatatcagtgtgattataaccttaatatagtcaaattattgccatgccccaaagcaggccaattagtcagagtatttgacataatataattccaacacgtaaaataattttcacaacagatctgaagttcattgtgagagaatctgttctgtgttattccccaaaaatctcagtatatagtcatttcaggatgttgcctgtttggggtcttgattcattttcagtaacaaaatcaagtatatggagtagcaaacatcattctttaggtgatgcacttggaaaaatagttgagtaccttgaaatttgatgrggaattttttggagcagctcttccagtgtgccacccaaagttgaaaaaacaaaacctcttggatccattttatgtgracattttattctttgtagccttctctttactggtttggtttcagcctccaaaaattaaattactactacatataatggtagtaaaaaagaacaccccaacataaatatctggtcaatgtatctcttgaacattattatttctgtcacttctttcccaaactcatcacatcggtgaaacttggagaaagacttttcaatttctaccgatgtccttgtgcaaatggttactcccccttcgaaaaaaaaaaagtgatgtgataactgcagttattaaataacacaacagattatttgagttttctgcttgttaactcatataagtttgggctaatttgaagtaaaagatgttacagtctacatagagtataatactaagcttattttcatcatggaaatgcatttaagacaatctgctgaagcgtgatgttttgatttttaactactaaaacagatttgtacagcattctaatctgctatgcttatttactgaattttcttctttaattcattttctgcacatcactgccatgcccttcccctcatagcagtaaatttggaatatctgtgatcttgatgagaaaagctgctcattggtggcttgcctgtgttctgctatttgccagaattatcaagcacacattagaggctgtatctatgcaacataggtttttttgtgctgtttatcctggctaaataccttattgcaaaaatctttcattttatgtagcgaaatctgtgaagttagacacctgtgtattcactgaaaggcaatcaacttcatggaaaataagtagtttttcggagcattaccctgtttctgactctttatgttctcattttaattccgaatgtgtcttgagatactgcagttattaaattaaatgactaggagacctttctgcatgtcgcatttcagtaaccacatctgtgtggtgaagccaagttcacaagcagtcaacataatactcagttaatcctatacctgagcccaggctgtaatcccaagctcttttaatatggtacttttaaaatgggtaattattttaaagagaaaaatactagtagtggaatgacctacattttcacctctcttcttctgaaatttataaacaagtttgaattttaatgttcaaccactttatgataaatttcctagagctttgctctgaatataaacctgaaaatgtgcgtctgaggtggcgtaagtacaaactgactcagatgtttttgaatttgccttatcctaaagggttagtgatagcattaaagttaatcatcatgcacatggcctttaagtagtaataacagattctcatgtagcacggttatactgagcattattcagacacaacccaggcttaatgatttgtgctttagaggatcattgtagacacacagaggaagctgcaggtgacagcgggaatgtcggagaaagcttcgctctgactctgaaagggcgccaagcatcagctgttggacatcaggagcaccctggacagccccagctaagtcccagcctggatactccttagggagcatgttggccccaatgctgattgattctgagatgcctgggctcttggtttaggccccctttgaacagcagaatttccatctctgtctggtgctgtgttttaccctctcagtgcttgactagggctttttttcttaagctttttattatggaaactcaaacataatacaagagagatgagtgtaatgaacctctctgtagccattcccggtttcaaagcctatcaacattttgccaatcttgcttcatctatcttatctgggatttttgggggggcatgataagaaccaaacaccatatccttcactgctaaatacttcagtacctctctaacagataagccatagtgccattatgatactcaacagaattatccacaattcttaacataatgtaacccccagttcatgttctgctttctattagtacttcttcagggcaatggttacacctccttcctttcccacttctaagggcaatgcaaataagaaagataaaaatgtactaaagaaagaggaacccaacccctaataataccaacttgggtcactggcccctcatgagtcagtagttgcctgcagctgttctgctccttcatgaagtgttgtagttcaagtgaaattcatttgctgtcaccttgggtaatcaactgtgctaagtgtctgtgtcatgtgagagttctttttctactcttttctaggatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcaggtactttctagattcataatctttttctcattgtggttaaaggtcatatgcccaaagatcattgattttattcaagtaaattcagaaacagtggtcattccaaattcctctcaccgagttctccttaggatttactcctagaaaaatgcatacctgacaagacatttgcttcccatgctcatcgtgaatgctatgagcacacctttttcccttcaccatggctgctgagaaactcacagctgaaatgtttgcctaggtttttgatatagatatatgacactctttactatgtgtccctcctgcttgtgataaaaggcttctttcttacctctttcattttatagactttagatactttaagctgttttgaattctttgggggaaatattgggagctatcaaaatgaaaagcagaatcaaccttttcaagatgttccctaagggggagatggaaaccccaaaataaactctccyagataaatccaatatgttaagaaaaacatttatctccctagttgaatttttaaatttattactattatgtattttttgcattttcatgggtacataatacttgtacatgtttatgggacacgtgatgttttttctatgatcatacagtgaatatgtaatcatcaaatcagggtaattggagtatccatcacctcaagcayttatcatttctttctgttaggaacattccaattccactcttctagctatttttaaatatgcaataaattattgtgagttatagacaccctactatgctactgaacactagatcttattctatctcattgtatttttgtagccattaaccaaaccctctttatccctctctggccccgccacaccacccttcccagcctctgatacccataattctactctctatctccattagaccaactttctcagctcccacatatgggtgagaacctgcaatatttgtctktctgtgcctggcttatttcacttaacataatgtcctgcagttccatctgtgttgttgcaaatgacaggatctcattcttttttgtatgctgaataatactccattgtgtataggtaccacattttctttatcctctaatctgttgatggacacttaggttgagtccctatcttggttattgtgaagaatgctgtaataaagattcctcctagttgaatttaaattcactttcataatatttttattcctaaatctctttaggactaaaatcctaacgatattttctttgcctgacacagtacgaagctaattttcaaagtactctctaggtaaacctacagacaaaaagctttgttaaaaaaaaaaaagaagaagaagaagaagaaaaggaggggaagagaaagaggaaaaaaagtagagaagaaaaaaatcacttttaatattcttatttaagatcaagtgagaggtggctatattagtttgctagggtggacataaagtgccacagcgtttgtggcttaaacaacagaaatttctttctccccggttctggaggctgaaatcatggtgttggtaagattggtttctcctgaggcccttacaccttggcttgtaratggtcatcttctctctatgtcttcacgtggtcttccctctgtatctctgtcctaatctccccaattttttttttttttttttttttttttgtgacagtctcactytgtcacccaggctggagtgcagtggcgcaatyttggctcactgcaacctccgcctcccagattcaagtgattctcctgcctcagcctctctagtagctgggataatctcccctttttataaggacatcggtcatgttggattagggcccaccccartgacttcgtttaaccttccttacctctttaaccacccacgtctctaaatacagtcccattctgaggcactgggagttagggcttcaacatacattttatggggacacattttwtggggacacagttcagtccataatagtaagataaggagaactgaaatttcaaaaccaaggctctagcatgacatcccccactctaggaccaattccattctccatataaaaggagacattgatgtggcatgccccatgtgcctggtgtgttcatctattgactaggttaatcctcacaacaaatttatgagatctgctatggcttgtcccttttgcaaatgagggaactgggggaggaaaagggttcaaacaactcaccccagcctcccagacagctggtactaggaggttgggctctgagccacagcagtatcctgctttgctataaagtaagaggctccctactgttctgtcacctgcgacattctgagcctgtgtgtcttggctgctccttggtcactgtgccttgagcaagaatgtggctctaaatgctggccatcgggagatcacgcttggctcggttttctggtaatggctacagactggcatgaggccaactcagcccttccccattgtggctggaggattcagagatcagtgtcttctctctgccctacacaaattgggttgctcaggcccacctcctggtcttgtcatcaggggctcagctggctgttggacctgacgtacccaggctcttgtcccctagaatgagtgtctggtgacctacgtgaacaggggtgcaagggcagacagagctgtggacagctgtttctttcacacccagtgaccgctttgcttatatgcactgagaaacgtgaagttatttggcctggttttagagagatrgamtgyagctgttatttatayggcgtaccaaataggaatttacactttgcatgtcatctgtaattctaccttgcccaaagtgtttcctgtctctctaaataacataccattggtaggttaggrgtttgattttgaaaattcttagattgaagtctctttatatagattaaacagtaatcaaacaaaattctgtttagtgaaaccttttcaaggtacagctcctgatctgattatatgtggcgatatgacacaaacaaaattcaaattccatcaaagaatctgggcattttcctagaattaaaataggatctgacctgaatttttatatttatgcatcttgaaacccatgaatttgtggctggtatcctgaaaagattccyaaaattgtcctgtatttgaaattaaaattcattaatttgctctcaracataattgggtttaatattaaacatgaataaattgatagctttgttcataaatgcaaaatgcctgtgtgttagctatgaaacccttattgttgcttttattccttgcagtggtggtcaaaatataaccatgatgggcagaaattttgatgtaattgacaacttaatcatttcacatgaattaaaaggaaacataaatgtaagtctccagctgctttgtaataatagttgttttcaaggatggttctattttcatcacactatgctatgttgggggtattttytgtttctgtgactttggtgttataaacttttacctatgckatcatatattctatccatgctagaatggaaataataagaccttatccttgtagctgagtatttctagttgcagcaatgaggaaagagaaatgaacttggtacgataagacctgacattttctttttatgtgatttgtggcaagtcaccctaatgaggcaatgcttatgaatatgtgtgaaaatgctccgtgaatggttaaggtgtgatataaagaattgcatttctgtgaagagtaggtggtattgttcccattgcacagagagagttgggttcacagaggttagatgacttgccaaggtcccagaaatcttgtcatgtgcttctccttctcttcgacccaatttgttccctaccatctgatgtcaccttctcttacctttcgtctccccacaggagaaatggtaggaggggtctggtttccacctttgcccgattctcccactggtgcctccagatggggaycctctagagcaggggtgtcaaccttttggcttcctgtggccacattggaagaagaattgtcttgggccacacataagatacaccaacactaacgatagctaatgagctaaaaaatggtttgtgcataatttccgtgatatccaccaccacagataagcaaaaaagtcctcacattcaaaaggctggacacggctgctctagatggaagcttctgatgccaagaggggagatgagggatttcacatacaagtcaggcctccaagtgtacttgcacacacttctaaatatccttccccattctttcttcccctttttccctctccttgatgagatatgtgaggtggctgcctctctggggccctgcctgaccacttcctgccaaggctgacacactccctcctcaggagcagtgtgggttcagacccaaattccgggggccgcctgataggccgtccttacagccttgtggtgcacacattcacctgctgacacagttcagagccacttccaagcctcacactgtatctgactccaggcctcatctccatggtgtgaacacctccagttgaatggctcgtatagtttgaccctctgagcagaggcattacctgagtttgtcacggacttgctctccctcctacttgctgttcccaaatcaagttgaattttttgagcacctactgcaggcaaaacattttgctgggtgcagggacaaaagataagtgagatagtcatattgccttcatggaggcaggcagcaaatctacattgggattgaaagttgaggctgggtgtggtggctcacgattataatcccagcactttgggaggccaaggcgggaagactgcttgaggccaggagttcgagaccagcctaggcaacatagtgagacccccatctctataaaataaaaattaaaaaagttgacagcacagagtatcatcaggttctaggtcctctggttccctaactgttcagaaaccctgtgagtccaagaagacaccatttcttttcacattaaagagaaattaaacatgcatgggattaagtacgcctgcagtatggagtggggtgggtggaagcagggaggtgagttcaggtacagaggacagagtcctcgcaggcccgtgctgggaacatcactcaatcctgcttagtgggaacctagagggtgggtctggaatgaccaagagcgatagctgtaaaactgagctggggccacaaaaagcagcgtcagactgaaaactttgcccttaattctgtaggcagcagggagccactgaagatctctgagcaggaagtgacataggtctaggtacactggactcacactggaccgagacaattagtgacaatgaaagcagtcagaaggttaccaatgggaaaagagactatgcagaaagcagtagactagggaaaggggaggattctgacccaaaaggcttcggtgtcctgtcttgagtcctgggaaaccacgagaaaagaagagagtgtccaacccccagcaggggccagctcctgaagtgcttgttgccgctgaatcactctttgttggggaacctcctgcagggcggttattattttggcaatggtgcacagctgagtttggagaggcaggaactgaagaaaggctgggagcccagtgaggatgctcatgccagtgcaggtgtgtctgagacgtccacagtctctctgggctgacagyagctccctttgggctgtggttagcagagcaggtctcaagtgctggggcatsgtgaagctagagwtgaccagcttgtctttatagcagtatcrttgaagggagagtgggggtgacatcatgggagtgagagcacagaggaggaaraaaagagcacctaggactggtggcaaagcttcattttaaggaatgacagacagtaggatgggccgtgaaggtggccgagaaggtgctcagaaaccagtgaaaaagagtaaatcgcatggcgcgagtttgtcaygagtatggaactgtagagtcttgaggataatagggttgggtgatcctctcacctgcaatccttctagaaggcatcttcagtaaaaagccagcctgctaggagttaaggctgctgaggcagtagagacagtggttttcatcctgaggacagaaatgtgagcaggagattcagggctatagtttggaaagatgtgaagggaaaggaaggttgtgcttgtccaaatctcagctctttacatcatattttcccaccaattgcctcttcctattgtcttttttatgctctagtatcagggggtggcrggggtgggggaaaaatagtttttcccacctgataaatttctttttatgagttataattgcttttctgtagaatgtttgccatcctcccctaacccaccagcctcctctgcctgtccttctgtacacctaaacaggacaatatatttatgttatgtatttactaactttttaaattttattttttatatatatakagagagacagggtctcactrtgttacccaggctgatctccaactcccrggctcacgtaaccctcctccctccgtttcccacagcgctgggattacaggcgtgagccactacgcccagcctatttatgtgttgttgtttttttttaatcctgtaaatcaggccaccttttttgcattgttttcagttttcatgctcttcatttcatgggagatgcattgttccttttacttttgttttctcctgttttctgttatgcctgaaaacccttgtcctccttgtgtctagtgacttctgctaaggccctgcaggaggttcccccaacaaagggtgattcagctgcaacaagcgcttcaggagctggcccttgctgagagttggacacttttcttttctcgtggtttcccagggctcagacaggctgaccccaaggacacctaagccccttgggtcagaatcttcccctttccctagcctactgctttcagcctagtctcttttcccatggcataaccttccagctgctttcattgtcactcaygatattaatcataatattaactagcatgttttgagtgcttactgtgtgccgggccctgatctaagcatgtataatctcagttaacgtagccctcatttaatgtaatgtagggtgaagtcaatcctgtgagggaggtagttttgctgtctccatattacacatgagaaaacagaagcaccaagaagttaagttgctcaggtcacttagctcttagagatcacagctgggattcgttaacaaagttactaaaacattcttttctttttgtccaggtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaagtatgtttcttttctttctgggtgggatgtcaccccgaccccttgactggaaaggtgtgtttatgctcgtgagtttctacatgtgctctgatttctccatcttcattttgttctttacagaaagaaaatgacaacttcaayatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtaagtgacctggcagtcccacctgctgtctttacctgatttttgtgataattccttggctaaaccagaggccagaatggaatctttcatggatcttcagatcctcactttaaatagaagataaacaaagctggtactgcragcccaagcaaaatagctccaaaatagctggytgaatccatccctgtgcctgttcgaacgtcaaagcgttggacacaccattgtctataatcctaatgagtcttgatagcttttgttctagccacacatttatacagtaggatcggcaagcaaaatctctagacccattgacaaatgagctgtcactcttttctcaaatgcggaggtgacatgtcttagcagaaacccaaaacaaacaagggcctcttcagcacactctgggtagcattagaatcagatggagaccagataatctctgggtcatgggctgcttccttcaccatgaagtcatactttctgcgattaatcttttcccagatatgtttgggggacggatcactgctatatttatatcccataataaagatgtgagaccactgagaagggaaacacattagaagtcaccctttatagtattcatgccgtatgaggctctgtacagcctatataaattcttcttgatctatcatcataaataattggataaaagacaatgmaaaagaacttcagactggaaggcaacaacaaaaatgtgttcatgtcccactggcaccagttaatagctctgtggccttaggtaaatcacttgagtttcctgagcctctcttagtccatctgtatgataaatggggttaataataagttttatttgtttttttagacagagtctcactttgttacccaggcaggagtacagtggcacgatcttggcttacagcaacctcygcttcccagttttaagcaattctcatgcctcagtcacccaagtagctgggattacaggtgcgcaccaccacacctggctagttttttctatttttagtagagacggagtttcactgtgttgggctggctggtcccaaactccttgcctcaagtgatctgcctgcctcggcctcccaaagtgctggcattacaggtgtgagctaccgcgcccagccaatagtaagttttaagtcaggaataacaactaggctgggagagacaactcaagcctataatgccagcactttgggaagccaaagcaggaggatcacttgagcctctagaagtctgggcaacacagtaagaccctgtctcaaaaaaaaataaggaacaacaactcaactcaccagtgttcccacctttcctgttagttgagaagagcaaatgctaacattcttcatcattcatgacatagctcctgagagcctacgctgtgatggggacagacagagaataaaacagacaaaaacatctgcctttatggaggttccctaaagagacacagcgtgaagaatataaataaaaattgtgttacttggtggcagttgctatggagaaaaaaagcaccagtgtgggggggtgggggggtgggaacaggagcaggtaggggggccatgctgcaggttttgcaacggtgggcagaagaggcctgcttgtgaaagtgacatctgtataaggaggagtgggaacaagccatgggctatctggggtagaacgttctaggcagagggagcagagggagcagaggtcctgaggcaggaggctgcctggcatgtttgaagagcagcaaggaggccagtgtgactggagtggagggagcagagcagaggcttctgaggttagagagttcatggagacaacaggagatgattagaaccttgtggaccatggcaagggcttggcttgtgggctgcagaaggcatgggagagttttgaggagggcgccatgagctgacttattcagatgacgtcatgaatttagtcaggacagcctaccaagaggcactcccaacatcccatttcagagatgaggaaaaagaggactggatgtgcatacctaattcagggttccatagctgagaaacagagcaggtggcagagctggtatggagagcttcagctatccgggtccaaatccatcctccagctactgtgctcaratgcctccacgggggcagcatgagtccaaggatggaaacacgccttaatacttgtatgtacatcagtgaaataattaagcttcatgtagagtttttcccttgacaagtttcacaaaatataacccaaaaaaatgctaaaactggaaaaatccctcagggatgatctgatcagcactgccaatctggtttttgccacagaatgttttattcaaaataggatgccaggtacagtggctcacacctgtaatcccagcagtttgagaggctgaggtgggaggatcgcttgagttcaggagttcgagaccagactgggcaacatagtgagaccccgtctctacaaaaaatttaaaaattagccaggtgtggtggtgtgtaccgtagccccagctacttgggaggctgaggtgggaggatcacttgagcccatgatgagttcaaggctacagtgggctatgatcacaccactgcactccaacctgggcaacagagcaagactttgtctctaaaacaaaaacaaaataagcctgcctgtaaaaatgataaaaattgagtttcttccttagaataaagggcaggcaggggcttcttgcctacaggttactactgcctctttattgccctcactcctgcaacttaaaacccccagagcaaagagggccaaaattaagactctgagggtctagtccagcatgtgtcaactgacatttcaggaaactgaggcacagtgaatattctggatttgcccaaggacacatagctaatctgccacagaaatgagagttgaactcagatatcctacccagctcactgcttctttttgtattgtgaagccattttaggggggaaattatgtaaataaatacagtccccaactcaattgggtctaatgacattctttgtcccatcaggtcaagctgggaaacctggagctctacgtcgagcaggagtcagttccttccacrtggtattttctgattgtgctccctgtcttgctagtgattgtcatttttggtaagtgccctgtttaattttgtcagagaaattattccctggggcctctcgccgggcaggcagactttcagctttcaggggctgtttgcttcaattaagtataaatgggtgaaagcccaaatcaaaactttgagaaacgaataataggtacacgctgagggctttctaaacatttcttttggccaggcgtggtggctgatgcctataatcccagcactttgggacactgaggcgggcggatcgccttgaggtcaggagttcaagaccagcctggccaacatggcaaaaccccgtctctactaaaaatacaaaaattagcygggcgtgatggcaggtgcctgtaatcccagctactcaggagactgaggtaggaagaattgcttgaacccgggaggcggaggttgcagtgagccgagatcacaccactgcactccagcctgggtgacagagcaagactccatctcaaaaacaaacaaacaaaaaacaaaatttttttttaaaggatgcttcattaatagaaggctggattacacagatggtatcttgggatttgagggatataatctactttgcttctccattccttcaaattgtggtgacaaatgttcatttatgtaattccccaagaacttctctgggattttgggctcccaggacttggttatttcatcttgaccaccccccaccacccatcaccccagcctcatttcagtcttgattttctgggcagaaccacactttagaagtgtggtcatgcctgggcacagtggcacacacctgtagttccaacactttgggaggccaaggagggaggacggcataagtccaggagtttgaggttacagtgagttatgatcgtgccactgcatgccagcctggacaacagaatgaggccctgtgtctaaaaagtaaatgatkttttttaatagaagtgtgatctatgtcatctcttaaagtggtcccgggcccatccacacacagtgagcccatggtggttgctcattggccaaatctggtccaccaatatattttgttttgccgtgtagcattgtctaaaactattaagtagcttataacatttaaaaattagtgattcacatttggaaacgtctcttgaaaatgtgaaagatttggatcattggatcccaaatttccatagcatcagtttattagagctgagtagcagctacgccctaragagagggaatgtgctccctaggttttgaccacagtcgccaccactccatattgtctccacctaggccatttaactcatctatgtacctgatatctgtagccatttcgtttgtgactctggttctgagctgcttgtcatttgaagtctattttctctcatccttctttgaaaaaggaactcttatccaccaacaaatagcactttggctgggcccggtggctcatgcctgtaatcccagcactttgggaggctgaggcgggtggatcacgaggtcagcagatcgagaccatcctgaccaacatggtgaaaccctgtctctactaaaaatacaaaaattagctgagtgtggtggcacgtgcctgtaatcccagctactcaggaggctgaggcaggaaaatcatttgaacccgggagctggaggttgcagtgagccgagatcgtgccactgcactcccgcctggccacagaacaagactccgtctcagaaaaaaaaaaaaaaaaaaaaaaaaaaagcactttgtatttcctgatttaacataggtattgactttctgaaatttgacrgctagtacaggcagttgccagtgtctccttctatacactcatttattcactcattcatccctgcatctatttaccttatgttcattgagcacctgttatgttgctgataactgtgcaagtctctggagctagaaaaaaatgagcctttgcgtgcatgagccagtgttgctcaaactgaggcctgaggaacagtggtcccaagtgactgtcctggaaaaaggggttccatggtcaagtaagtttgggaatcactacatcatactccaccctttcttagacatgcacaatgcatgttattaagactgttgactttatgaagtagtccagtgaagagccatatttgtttcctccagcattattggtagcagagcccgtctattatgtaatttcttttttttttttgagaaagggtctcacttttttgcccaggctgagtgcagtggcacgatcacggctcactgcagccttgacctcctgggctcaagtggtcctcccacctcggcctcccaagtagctgggactccaggcatgcaccatcgcacccatctaattttctatttttttgtagagacagaaaaatatctttctctgttgcccaggctgatctcaaacccctagcctcaaggcatgctcccacctcagcctctcaaagagctggaattacagacgtaagcccccgcacctggctgtaatttctataaggaggagaagcttcctagaataacagtggttgattgttgaatacctatacttttttaaacaatacattcttaatgctttttgtgagttacttcttataatcctcccagcatcacagtgagataggcactcttacagagaaggcagccaggcacagagatgctgaggaacttaacccaggtcacatagctagtaaatggcagagcaaggacatgaacccaagcaccaaactgggttggtttatggcctctgcagcacagttagaagcaatatggaggtatgggagttccttgtggctcgctcatcatgtcaccccattagctctatgcaggtttggcccatgtagccaactgtggatctgcggttcctttctacgtttgcagcacaactttatttctccagggatgcttacaaacattcaaaaacaatggaacaatgcaagtggctgcagctgtggggaagaaacttggcttgtttcattacgtttcagccaactgggatctttggttacaagtgaaggttatttgatttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgttkttgtttttaagaactgtaaagrttgctatttgttttcatttttggtttttgagttaccatgtccctctgatgcakcatctctgtctcttagcggccgtgggggtgaccaggcacaaatcgaaggagctgagtcgcaaacagagtcaacaactagaattgctggaaagcgagctccggaaagagatacgtgacggtaggctccaaaattgtgtttgtagaaaaacaagccttttatatttatacttttatttttttacccttacatagagatggccacagtaatgagaactgtttgtataatagaaggcaacggaagggcagggcctgggcctggctttgtgttttatttcagctcttctctgcagccaaccargtcattatctattgtttcttctttaatgaaaaccaaggtcatactctgtgttagacaaaacagcagaagatcctatccattgtttgttgagttaaaatatygctcttgggattctgttttgcaggctttgctgagctgcagatggataaattggatgtggttgatagttttggaactgttcccttccttgactacaaacattttgctctgagaactttcttccctgaggtaaaagagcattgatcatattccgaaggtygagtcttgaataataatgaaggtgcttgttgctgttgtcaaaacgagtgtttgcttccaaggcagctataatgtgcttggtacaaaaataatggcttaagtttgagcagagcagggaggagggtaattattaattgcattgattagggtataaaacagtgatgggtcactggtgattattctttgcccagtaacaaaaacctaggagggacagaagctcagagtgatgatttttgctttcttttactctcaatgtagaactgaatgtgtagctgggaagtgagctagtttatttaaaaatcaataaattgtgagctagccaatttgttgtgtttatctgcatgacttacattgcagtgactagattattcactattacttctcaattggaaaggaaaaatactactggtcaaaagggaggaaagtagacatggatggaattggagttgaaaacaggcatttttagccatgtagagttcttatggttctcttyggtagtttttctttagctggtcagtttgtattgtcctcatttagtagacgtagatgcacgaactgattaattcatttgttctagggctctgaggagtcgtctacttaaccttttgggttgctggtcttacctatgttctcacgcctccattttctcacccactcactcagccttctccatttaccctcccaagtctttggcgaggtacactcatcctgcgtatcatcactgccatgtcctgataccccagctctgccatattgcccttcttttttgcggtatgatgaccacatagaggcccaacctcttaaacacatcaataccaatgatcacatttcaatctagacttctaagcaacggctgaaatctctccaggccaaaggagagtttgtatcaccttaccagaagcttctccggaacaattggccagaagcctagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagctttttgtgctggtgaagtttgtttcctttaacttatcctccaagagtaccgaggcaccgagatctaccatttgccacctcatccatttctatggcagaacaccgcctggggaraggaattcgattccccgaatcaggatgactgtgtggggcttctgcaaaggttgcatcacgagtcctatttctgagctatctgagatccccattaagaatttaaaagcaataaaataacggagatttttgactatcaacatgaatgctgtgtgggcttttacagttaatgattgcccttgagtgctgaataatctgtggcctgaaaaaagaaatgttcttatcttctaaatttggtaatcaagaacaagatagagtaatgaatgtaaaggaacactgttgcaagttgagtgtttccaaaaaaaaaaaaaaaaaaaagatcccaggaacaatgctaccttattttaggagaagagagatagttgcaaaggaggcaaactgatttaactcagtgttgtgtataatcttgaaaaacaactgggaaagtcataaaaattgaagtcagaagttgtttaaaggagagaacccaggaaaaaacatgcataaatttgtcagaaccctttcaagaagacctaagtcaaaactgattttataataattaagaaaagatagaacagggaaacagatcgtaagaagacaatgccacttaaatgcattccaggctgcagataagtcctggtattaattaggctctttatggattgatcagaagccgaatcctctaggcctggaggttgggggctgtgggggtaggatttgggtgttcagcacctacaaaaaagcaacaggcaaaatccagaggagattgtaggttctcaaaggaggccagggttctttgctctgcctgtcggttttggcttttaaagccttgctttttattttattgactcttctttgctttgcataaagtaggagaagaaataagggtaggcagaggatctaagctgaagaaaagggaaatttgaatgaaaggaggaagcagccttaaaactcagagagccacgggtccaggcgcggtggctcaagcctgtaatcccagcactttgggaggccgaggcgggtggatcacttgaggtcaggagttagggaccagcctggccaacatggtgaaaccccgtctgtactaaaaatacacaattagccaggsatggtggcgtgcacctgtaatcccagctactcgggaggctgaggcagagaattgcttgaacccgagatcaagaccatcctggctaacacagtgaaaccccgtctctactaaaaatacaaaaaaattagccaggcatggtggcgggcgcctgtagtcccagctactcgggaggctgaggcaggagaatggtgtgaacctgggaggcggagcttgcagtgagccgagatagcgccacactgcactccagcctgggcgacagagcgagactctgtctcaaaaaaaataataaataaataaaaagaattgcttgaacctgggaggcggaggttgcagtgagccgagatcacgccactgcactccagcctgggcgacagagggagattccgtctcaaaaaaaaataaagaattgcttgaacccgggaggcagaggttgccgtgagccgagatcgcgccactgcactcctgcccgggcgacagagcaagactccgtctcaaaaaaacaaaacaaacaaaaaaacacacagagagaaccagggcggcacttccgtatttacgattaagaatcaacctgtttctcctgtctatttacatgaagttggttcagcagaaaaatattaagaaccagaaaatgcaaacctagggtctgggggtttttttggtttgtttttttggggcttttttgctttttactaggggaggatatggccaaaatagtttcaggtcttttgcttgggcttgcagatttgaaactatgaagcaaaattctctacagaagaaatttacttcacaagatataaaattagctcaaagtttctattattatcaaaaaagaagaaaaacttgaatgttttgagtttagagtctcattctgtggacttaaagtattgcttaacatacttttaaagtttaaccattgatttttaataagattgatgatacactataaaccctttttatattccagagctacctagcatttagaaaccagtggggtgatagcattgtggtctagtttgctataaattaggaataaaaccagtaatgataactgacacagggcacttactctgcacccattttattttcacactaaacctctgaggtgggaaccattactgtccccatttcagagatgaggcaagtcagacacagagaggttaggtaacacatcccacgtcatgtgaccagtatgtgattaaaaccaggactggaacccaagtagtttggtccagattctatgcttttaactaccccctgtctttcaatatcattgtgtattgaaacagtagatgctacttaggtaagacttgtaaaacttaacaacgtaatttagtctttatctttagaaggtaaattgcttgaagaggggtctgatatttgcataatcttcatcaatgaccccttctttaactcttaaatcacttcttctaaaacgtgggatgataccttcatctaccaaacctggaactaatgccatgataattattattcttagaggctttcggaattcagtggcgtttcttgaaagctgaataattatttattatgtattagagaatacgcagccaccataaacccaggggcgcttcagattagcaaatagtgtctctactttattaaaacggacttgggtattataacaaaaatacactcttcatttcctttggatgttatgaataataaaagtgtctccttcctctcagtcaggtggcttcacccacatcttcactgaagatatgcatgtaagtctctacgttttcatttttagcccagtgactgcctgatgttcatagtgttatcatcatcactatcatctcyattattattactttgaatttttattgtgggttttttttggatcatsaattcaatattgaataattcattgtcttggaaaacccattgtgggtctactttctaactttaaacttatatatgattktgtattatactatatatttttttctttttatcagaacagagaygccaacgacaagaatgaaagtctcacagctttggatgccctaatctgtaataaaagctttcttgttactgtcatccacmcccttgaaaagcaraagaacttttctgtgaaggacaggtattagtccattctttgatgttttaaaagcctttaagaaaaaatcaggccgggcatggtggctcatggctgtaatcccagcattttgggaggccaaggcaggcaatcacttgaggccaggagttcaagaccagcctgaccaacacagcaaaaccttgtctctacaaaaaaaaaaaaaaagagagagaaatcaaacctgagtcccatattttatttccaaaccactatctgaacttggtatcttgagaacatgcacttttccaaaggctatttgattgggagtttatgcagccttctctccattttagatcataccaccccaacacaatttttttgttgttgttgttggagtctcactctgtggcccaggctgaagtgtgtgatcataggtcactgcagcctcatcctcctgggctcaagctaccctcctgcctcagcctccccaagtagctggaactacaggtgcatgccaccacacccagctaatgttttgttgttgttgtagtagagatggggtcttgctatattgcccaggctggtctcaaaytcctgacctcaggtgatctgcctgctttagactcctaaagtgctgggattataggcgtgaaccaccatgcccggcccataaattcttaataaaaaaagcagaagtgttaatttttatttttaaaacatcccgaaactttggaagactcacatcttgttaccactctagtttaaatgctgaaaacacagaaaatgttctagagatagaagtggttagaatctaaacattaaaaaaaaaaaaaaaaaagctcccaacccaacaggccagctccctgccctgccagtgagcttccatggaaactcccatgggtgtccagctaggcctgcagccaatggttcacccagctctctttttcaacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggtaagtgtcacatccctcagcaatgtcagaggtaagacaataggcagttatttttagcggactctgatgcctttgccaggataaatcctgaatgctcgatggtgtcagcacttaaccatgtttcgtcttggtcctgacccagaacagagagagggaaagtaaacattgtttttgctgcaactggcctatgcaaatgtaattcatttagaatttcgtcaggtgagacttttcaggtgagtttaccttctcacgtcaattcacacccagagcccagtcagcccatttaagaaaatgtactgagaaaagggaatatttcaaacaccagagaacaaactgtttcaggccctctgaagcattgtagaaatacccgttgcctaccaatatgctgtaagctaattgcagtcaattcctaccagtcattccgcattaaagcagctctccaaagagctgcctccccctggagtttgctttgttggagttactgtgtgcatgtggttgtcactaattgaactttaaaatcttttcaaatgcaaactttctatagattccagtggagaagagggtgggccctaaagtctgctacttgatctgaatctagacttcaccacttacttggttttataaactagagaattggaagaagattttaggactattttgaagtacagatgagaaaacataggcaattgcttagccctaaggaagcctccataaatgttggccgttacgattataaaatattaatgtgaaaataagggtgtcctgttgaactcgatcttcacccagccctctgaggcccctggtacagaagattcttatcctttaattttaccagccatccagatttcagcaaaactgcataattgtgtatttgtagctagttccgaaatctaattaaactttgaataagatacactgctatgccacaggttttaacagtgctacttaagtttagatccaacagcagtgctttaaatagactgtgcttagtttaatgtttaatgcaatcttacaagtagatgcacaacaattttttttttaatttctcaccaacccctccctctccctaaggcaatacccatttattaagattaatgaaatctgccttcttttctgtttacttggtataaatcatcggaggctttggggagatgttgagccagttatttctgggacgaatatttttttgtttcccactgtctttgctttagccacaacagctgctagatggaggcaccaggactctcacccagttccctggtcttggtcttcaaaggccaactcctgccccaccacagtctcactggatcagaagctccggaagtggagcccagtaatccatgattttcacaagtccctgggatagtagagagagcaccacactaggggtcttggttagaagcagcaggtctgggctctggaaccatctcagccccggtcagctgtgtgtccctgggcatggctttttccatctgggcatctgttttcaatccaccaaatgacaggcgtgtgtgggcgttgcctttaaatccctttccagctctttctactggatcttgtgattcttaactctgagctttcaagggctgctcttgggcattagaggggtgagatgttcagaaaatctgggctgcgagcccaaacagcctccttgagcaaagcattctgggtcaagacttcacagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggtaactttcccttccaagacaccaaggatttgtgggtaaaataataataccatttattgaatgtgccagacagcatgctaagagctttacctatcttttctcatttcatccccttaagggtcctgtgagctaagtgtcttcatgaccattttgtatatgggggaactggmacacagaagagctgtgactctccccagatctcactgctactgtgggacagcaccagggtccgagagctcttagccaccgccctgtgccctgaaaagatggaatctgccctggtctgttaaagtgtcgaagcctggcccctgggggaggggaatcacgtacgcagcggctgtggctcgcctaaaagttgtgtttagtggtgacagagaaacctcatggccctgtgattccccaaatcagccacacatcagaatcctcctcccccaccgcctccccgcccccggccccgggaaggtaatgaaaactacagatacccaggcctcattcttcagagagatggcagctctgtaggtctagagtggagctcaggcatctgaatgcttaacaagagcccgcaagggattctggtgattagccagggttagacccaggagcatgggcagagtgtagggccagatgttacttagctcagtctagctactctccagaaagttctggagaattcctgaccacaggcctcctgagtcaagacctgtcccttcacacagcccccgagagcccacctggccccctgactccaacccctgcgggagtacacagcccctatccaagggttctcagcctcccttctgatctgtgctggaggaaaagaggttctaagttttgtggtcagggcattacttggggtgggggaggtgggcggtggagggaaagagaagagaagggtgaggttgtaaaccactaaataaaggaagtttctcatgagaattaaatgtcatgcactagtcctgctgccctccctaccttggaaatttctgaacttccacttctgccctgcactgaagaggagactcaaggaggtatcacagcagggayagaagctgcagggtggcaggaggtggcaagaggaagcccggggactggggagggcagatattcctgcagcaagtataaaggaagggacagggttggggtgggatgctgagagacttaagatgtcttaggtaacttgcctgcgcaagggaaagcaggtgagacccagtggaatcctcctttcccagctggacgtatcgcttgtcaagcttgactcttaactggcgcttcgagccccagccacgtggctggcctttcgtcatcactaaggcactttgacttcccagccacggttcttcctccaccacagaggcctaatgtccattgattacggaaggttcgttatttagcaaatactctacagctgacccagggctaagtgccttgggaggatgccgtggaaacagaacacaccgcctcccacttgaggtgctcagagtcctttggaatgcagacatccgtgtctgcgaatgtgagccatttccatcacagcaggggaggcagccccacccccagccaggaaaaatgcatgtggcttaaatttgtagaaagagccaatcgggatgggccgagtgtttggagaaaaaccttagaggaaatggaattggctctggttcagggaagaagatggagtccctctggcccagcaccggaaaacatgtccaggtgggactgtgcagtgtgtgtctgggaactgcccgggccgggcctggcctggcccatggagaggagataaggctgcaaactgttgaacggcaggctgcttccttcgagaagtgctgttaacaccaaaaaacattgtatttggcaaatgtataaaatgttcttacatttatccttgttactaaggatacttgtgcatttttttaaatgtcgtttatttctggcttgctaaagggtgattaaatacgaatgtaaacaaaggtacactctccacatctaactgttcctaggcattaacccactgatgagcattagtctgccatatgtaagtttaaacataaaataacaaggtatactgtgggtactgcacgtcgctgtgaatgtgcacgcgtgcgcgtgtgcagatgtgcattcgcgatgragagaggaggcggttttctgagttttgcatccaatcccaagtggagcaacgtgtattttcttgggcgtttcatgttgagtgttagaaaaccctgtctcctgccttactgctgtaaacagaaactttaattctttggaaagtacagtggattccacagaaagctaactgtcacttttgtgtcttttccaaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggtatgttttcaataaagctcccagccagactcccaaataaatctggcggggaattagagggtgaggtgggtcatttacaatgaaacggtatcatctctactgcgggaggccctgtgtgtttagttaattaaaaacagtagttgataaaactgttaacacgtgttcacataatagattttaattactgagattgggggagaaaatattgtaatgatgcctggggtactcatcaatttccaaagattttaatatcaggattgcttataactttcagtgtcgtcaaaggaaatgcaaagtactccctattcagcacttataattgcaatcagaatttctcaaatggctctgctctgggaagacaatgtgtgaagatatatttcaatcaaattgaggccgtcttattttagaatgataacacaagacaaattccaccacgttccccatgcaacgtgacgccctttattttcatggattagttacaaatgtttggtgtcatgcacttaatgtactgtgatctcatagatatttttagaggaacgctgtaaatcactacaggaagatgattgcctagctgctggagggtttcacccgcttgagaacttctttctaattcatccccaccgcacccaccccatgctcttcctaaagaaagaaagaaagcccagtttggggcacatttgggaatttcagagagggagccaagcagggaaggtaactttagaattaggaattttctatgcttttctgttagtagagacttggagaagagattgctgtgttttggtttgatctttagctttatgaagattctgggcttcttcacgatctcgttagtggaggaggaaaagattacagtggggtttgggaattgctcattaagagagctgagtcttctgtggctttgctctggatggtggggactgcagtgtcatctgggaagaattcattccctaattggagaaggcaccactttgccgtggagcgtgttatggttatgtcctctggtgggagaatagtccgtaggtcagctgtttcaagttttctgccactgccagatgcggctcacttctccatcaaagatggcaccatgcacagctgccatccgagagcgggaagctragctgaaagtcaacacttctcagcgttctgaattgtatcaatacacccatccacatctgagaggccggagagtgggctgcattggttctcaaacttgagcatctagcagaatcgcccagaaagctcactaaacaccagtcgctaggcagcatgctggagtttccgatgcagtaaatccaggctgtggcctgagaattcacttccctaaccagcttcctgatgctgcgggtgctgcttaacaactgttggtagagtggttaacagcatggactctggggccagacattttggaatcctgcctctgccactggttagctgtgtaatgttgggcaagtttctaaacctctctatgcctcattctcctcacatgtgaaatggaaatgatggtcatggttcctacccatctcatgaggtgttttgaggattaagagtcagtattataaaaagcacttagaacattgccaggcatgtgagtgctacctaaaactttattccatttgatccagatctcattgaacccttgtttaaaatgcaggtgcaaatataccagtgcccgggctttccctcgggactgactgaatcagaatctctggggagggagcccaggcgtggatgtattttgtaaaccttccagatatctctgatgtgtgttcagcctggacaccactgggtatcttggagaacaagagacaaactttgcacagggcctgttgactcacctttcgctgatcctgggcttgttattcctaacctagaagatgttcatgcctttactttaagacgttttagaagccccaaaggtctccaaagagaaatatttgcaaatgattatagtcgggaatcctccagcattycagtcatgagacaacaccggacccaaacaggaaagacaggaaaggagaagatgggttggaatcaggaagaggtcagatgtctgaggcaacttttgaggttttgaagcctttttaatgctttacatctgaacgtgttttctccctttcatttcgaaacattatttatttcacagtcaattaagaccatgtgtttctgatttgttaacactcgactcatcatcataatgttacttgatgctgaaggaattcatgtcgactcttgaaatttttttttctttatagcccctggggaaaagggtaatggaaaatcatgatttcagaaatccacataaatcttccttttcaaattcagatttgccggtacataagatttgagccttgaaaaggaatgggccacttgtttttaggggccttgcctttaaaaatgattgttagtgcctcttatggggcctggcccagcccccctttcatggttggcagttgtacgagaagctgcagagaaggcacatgatccgttctatgcttgtgtgacaaactgttagcagaaggtcaatataaaaaatttaagtttttcatttcctttcaggcatttcccccagcctgaaccaccatatttctaattttctttcttcctcccttccctcctccccttctttttcacttcccccacctacccctcccaagcatgtacacccagccattttaggacttgatttcccaaatttgcctgaggtggtttatgtaattgaaaaccaaggtgcggtgaacaaactgattctgtgtgtccttgtgtgctggggaggcgggaggttgggggcagattctttcaaggaaaggaaagtcggaaatcaagagyatcctcacgaaccacttgaaatgacagaacctggtgccaaggcagggacacgtttggaaaaaaggcccccacactcgtgttcagctaaatgctcagaagcacagcacctcatatagcaatctaaaagttagctttcacacctctcagatgaggatgtgttctccctgaggtgtgggggattttctagaacataaaggcatcttgccaatttcttatacatgaaatcatgacactaacaaagaggccctgggaagtaatgttctcttcttgcatattgagaagaaaattcctctgtcttgccaaaaatccaagcaaagtcccctagagccatacttcctccaggaccataagaaaccatccttctctatcaagcattccaggctggtgtttaatgaggcaacagtgagacagaatgccctgatatctgcatcctccctaatgtcagcaccaggggtagggctgtgcacacacaggactttagtctttccttaatatctaggaattcagatcagacagctggaagagaataagaccttttttttttttttttttttttttaatttaaggaataccactctagtgcaggctggagtgcagtggcgcagtcttggctcactgcaacctccgcctctggggttcaagcgattctcctgcctcagcctcccaaatacctgggattataggcacctgccatcatgccaggctaatgcttgtatttttagtagaaacgggttttcgccgtgttggctagcctggtcttgaactcctggcctcaagtgatccacctgccttgtcctcccgaagtgctgggattacaggtgtgagcaactgcatccggccgakaataagacctattgctctgctgggtttttttcccctttgcaaaattttgaacatgtttgattttgttgatggagtatctcagactcactcagcttacgttttgtcaagagtggaactttggaggagttagtgaaagtttgaggatttcacatgggagaagggacatttgcttcactttcaggaagagatgagaaaaaccaataactcgtagcaagcgtgctgaattagcaagagaaggttgacttgtaatcaaagttaagtgtgaaatggttttttgaactcttagaaaacgagcttgccaatctgctgtatctgagagagagcatcttggcaccctggaaaactgttccgacaaaaatattattgccttcattctcctatmtataagaaagttttcaagattattagaaattcttgaaaaagcacaagtacatgcctgcagaaatattaatgcctccaatttgatttattgaaggtttatgccagcctaccccagtctgtctctttctctagcagttaccattttgggacaattacgtttaataaaatatctcatatacaacagagccctaggtgtctccaccaggagtttcttactagtatacttcctttaacagtgctctgcctaccagtgctggctgcttctgttccatttagtttgtccttgcagaagatccattagccccgtaattaaacaacccactgtcccgattaagtcattctctgttacttcaattacattccattgttcattaaatcctgatgtttgcacttcagcaatcttgtttttaatactcctaccatttgtggagaaacagtgaagttaattaacaattcttgagctttttatttttctctctaccatagtgcaaatcatttccattatgacttgcaatagtactgaaaccattactaacttcatagttagtgttctgagcttcctgatcaaagagtgaaaccactttttacaatcattttaggtaagtcattccctcgttgatggcaagtcatggaaaatgaaaaattaacatgtaatgggtgctttaaatgactttcctcttcatacactttcttctcatgcctgtaatcttggaattagaaaataatttagttatctaaatataaaagtatttactttttttctttatagctcaaatgtgactctattatgttattgttaggatcattatttatatttgtacccctcagagaatggtaaattttatcacaagtcatggcggagatagaaagcattttccagatttgtcttgttgctattgtcaaagttagcattccatttgaaggtactgttatytagagcagggaccagcaaacaacagcctgtgggccaaatgtggcccctctgcctatttttataaagttctattggaacacctgttcatttccttattgtctatagctgctttcctgctacagtgcagagtggagtagttgtcacagagatcatatgrgttttaagtcttaaatactttctggccctttgcagaaagtttgttggcctttaatctagagcttgacatagtagagaataggaaccagaatcctccctcccacaaacccacaaacaggttggcctctttcctccccttytgggacacagcaatggaaatgccttgccactatttacaagtctgaaactcatggggctctttgccaacacacaacacccacccccacccccaaccctgcacccgcaaatactgtgaatactaaaatcagttatcttgggctaaatcagacagctcttcatacttgattctaggatggacaaaacgttagcaaatgctagcaagtatagaaaaattggtgagagaaacctaaatttgagaaaattatctccattacttttttttttttttaaatggaaaaaggctctcgttaccctgtcctccaccccttactcttctgttagagtagcagatcccttgatccaggaagctgtgatttatggatctttgtggggaaaggaaaaggggagcagagtgaagaggggaggctggatgggcaagcgcagctcaaaggggaacgtcaggcagaatgtcccagggctgctgactctggcttggaaagaagcttagatcagaagtttccctcagacttgcacttctaactggcctcatgctgcttctacggaacttctgaaactgaattttctttcttgtttcttctctctttaattcaggttggtataagaactaggcttttctcttgactttcattcggccctgaaataaaattagaaatatattttataggttttatttaatgaaagcaattattgctccaaggccttttatgataaagttgccagtttgtaataaattatcttacagttactttctaggcattataaggtatcacagaaaggaggcagcaacgttcctgcttttattagccaagaatatggttgaggagacagtgaggtagccagatcatcttcccatgtgggaaaagacctgttcccctgcccttgattcatcctgccagycccctgcagccttatcctytytgcctcctcaatacccaaaaccaccaaatcatgtgacgggacgatgggtaaaacyggtagtgaaaggggaatgcagttacatgttcccaggccgtgtgcagaagaggtggggtttggagtctgatagtcttgggtttgaatctgggctcagccactttactctgggcaagtctctcaacctctcaaaacctgtttcctcttctgtaaacrggcaatgaccaaaacctgccctcgcatatttgtggtgaggtcagaaaataatacatgtaccacgtctagccatctttcctggygtgaagtaggtgctcattcttttttgattcagttttccttgtctgaggtgtgcttttctcttgtctcctgtaagcttcactaagcagaaagtgtcccgtcagtattctttttggttggttatttattgatgatgtgggatgtgggggagttgattagctgattccatcatcatgaaaagcatttcttgggtgcctgtgtgcttatgttcttgttaaaaatgttacatatgaccgctgtgatggggtgtttacaacctgtggcagacagtatcccattgggcagatgtgaacaggagacgaccgtgataaccygtgagaggctgatggctgacatgctacaaaggggccaggcctttccagcctggccctcttcccgggccttctggaccatacattttccaatagtcttttctttctcataaccctccttggtaataggcatcattcccaaatcaatcaggatgcagttcagttgtacagaacagagacccaagatgtctgtggcttcagcaacagagaagctgagttctctccctggtggcattctgggtgggcagtgcagggctggtagagcagctgctcctctcttgtcctcatattctaagtgtctgctcaccccagcctcattccccatcccagccagcaggatgtaagcagggctgtagaaaggagggcagatggtcaccagccatcttttaaggaagtgccacataacatatccacttaatgtcatyggccaggacttagtcataaccagaacatgtcctgactytgagctgcgaagccaagaggccagctytgggtcaccatctcccagtgcctcctggccctgccatcctagtcacaagatggctgccaccgctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctttattctgggtgaacagaagctctgtaaaaatgtccttgggtggcaccggaggcacagggtgctccagattcagtgggttctgtggggttcaatatcaagctggggtgaggaggtcaagcctcctctaccagatcgcctatgtccagcctgtctcctgggagggcattcattgaggccttcaagcagaggggaactgcccttgggaggctcatcaccttggctggcctcttcgcttcgcagcccagagtcaggacacgtcctagttatgactcccaccggctccatgattttggacatgcttctaaatctctctggtctcggtttcctcatccattaaatgaggctaataatggcacctacttcatagagcagttgtgaggattgaatgaacctataattgcattcccagtacgtgataagcactcaataaatgctggtccttattattacaaatctagaaccatattcttttctttaccatatttttttcctatgaatagtacagggactctctttcaggtggcaggaggtggttttgggaggcaggcctgggctacaagtcctccacccatacttccacccaaagaaggtgggatttttttstgtagacttcctgacctgatagcctgagtgagtgattgaagcttcctgctcaccagtctaattagagactggaagccaagtgtctccatggtctaggggcctccctcatgaactacagctctttgcgacccaattcaaatgytgcctcctccatgcagccttccttgatttctctgtttgaaaaccccctgccgacctaaaagaggtacctctctaaatccctaaaatgctccgtctgtacctcccacattctacctggcattagaatgtgttgtatatgccccacagttcttctactagtctgctagtacttcccaagcaggatgagtacaggttctgatttgtatcacctacagtgccctgcacacaataggtgcaaagtaaatggtcatcaatagacgaatctacctcagcatccacaaaatgagctctggcagtttggcacatgcagctataagtaagagaaaattgaactaaggatgcctgaaatagtaagagcatgacttgcctyttagagcagaaagtytggagggaaggagctccaagccggtccctacattccgtggtgtcagagctctgsgtcaccatctcccagtacctcctggccctgccatcctagtcacaagatggctgccmccgctccaagcgctactcccccttttgtttggatagaagacttccaacagggtgtggtggctcacacctgtaatcccagcactttgggargccaaggtgggaggatcacttgagctcaggagttcaagactagcctgggcaacmcagcaagaccctgtctctaaaaaaaaaaaaaaaaaaaaaaaaaaaaaaatttagccaagcatggcagtgtgcacctgtagtctctgctaygtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccaragctgggttacatgaccagtccctggtgaaagagaagggagttgctgctgatcatgcctcccaacccaggctggacccactgctgtgcagacctggcctttgttagcagaggagggatggctgctggttggacgacaaaccagatctgccaccgcagcttactgacactttcctgccaaggaaataggaagaggcagggcagtccctctaaacagagggcagatttctggggaagggaccagtgtacatttcacagctctttagcctttcatgggtattttctgggtattatgccatcccatcgatttggaccatgcttactttacaaaacattcytgtacttccaaaggcaggatcaccgagtgtttaagaacacggagcttgagtacccggttctaccatcttcttgctggctgaccttgtgccatttatttaacctctctgtgcctcagtttctcatctgccacaaggggatgagtaaaagaatctacctcacagggttgtttctgagatttacatatacaaatacacacacgtcatttaaaacagtgtctggcacctataaagcactccttaatttgctattattatgtgtcattatttagtgatcctgtcactcctttgagataggaacagtgaggattttaaggctcagcgaagttagacgacttccctacattccctcagctggtgagcagcagagaatgggagggtccaggtggcccggtgctgggcctggaactcagggccytgacccccactgtcctccctactcagaatcctctgtggacacttgctgagggtgatagtcactgatgggtgactgttgtcccacagatgatgcttttgtctctgaaatttatcatgaattatctgagaacaaggactatgtcataacatctctctgacatcccagccctaatactaaatagggcaggagaacatgctggttaaatgggctttggtgggagtgtgggagscggagagatggcgcttccatcgaggtgtctcccccgatggggtacagtggctgagggcagacgctgtgatgtcacgctgtctgacatggcacaggcatctgctccccatcacagagcagaggcccgcgtgcactttcccagcctgggggtggaggtgttaagaggctgaccccaagggccttgactgtacttacgccttaagaaactgctgtttggccgggcgcggtggctcacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtkaacccgggaggcggagcttgcagtgagccgagatcccgccactgcactccagcctgggcgacagagcgagactccgtctcaaaaaaaaaaaaaaaaaaaaaaaaaagaaactgctgtttgagcactaagtgttagcagcatgaaaaatgaacacatatcaatttatgtctgaatttactctcagaattccctgtggactctgtaaaatgccattttacctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccrccaccatgagaagatcaccttgcagagaaataaggcaagaccccracaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctgccactggtgagctgttcctggagcaagttactcagcccctctgtgcctcagttccctcactctacaacagggatgggaataataatccaggaaacatttctagaaaagrgaggtgaggagagggctcgggtgtgaggcttcacatgttggttccttctagrcactctgcccaccagctccctgccttctctcctgtctggtattttttgtttcttgtttgtgagcagacaggcctttgaaccccttcctagtcggtggctggcccagaacataaagkttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacacaccataaactgggtggcttataaataatagaaacttatttctcacagttctggaggatgagaagtccaagatcaagagttggtgtcctgtgagagccccctttctcatgatggcgccttcctgctggrtcctcacatggtggaaagggcagggcagctctctgaggcctcttttataagggcactaatcccatttatgaggactctgccctcatgatctaatcccctccaaaggccccacctccaagtaccatcaccttgggggttrggatttcaatacctggagttagggggacatcaatattcagatcatagcagcattaaagacaagawacacccctgagaacctcccgaaatttcagaagccccacatccacgtcagtggtccataagtcacgggctcacatgccagatgctgttctaagaactgtgcrgttactgttgttatgccctctttgcagatgagaaagcgacatacacagaggttacacagctggttagggatgggytcagaggtcacccagctggcttgcggtggactgggatgaaagccaggagtctactggcttcyactgggttcattgctggcagcctcctccttattcagagatactgagcatggagtgggcgtcctagctgtccaatgtgggctgaatctgtttgcaaatgagtggatactaatgccaacaatagtaattgtacaggttttattgccgatactatcrtcaagcctttcccagcagcctggcccygtgctaagcccttgaatgcatgatcacatttaatctccctaacaatgctagaaggccggtactgttattacacccatttttaagttgaggtaggcctgagggttcccatcttccatatgatttgtgttttcatctctcccctgagccctasgcaaatcagacattgcctcctgcagcctctgcatatatacctggctagtgtccacagtacttggggacctcctctttcggctttggagccccccctccctctgtctctgtatgggcgagcatcttccttctgtcttctcccttccttcttgcctgttagactctccrctccttaaaaccaaaaaaacaaaacaaaattcccattacttgatcattttacattccctcgttaagccaggctcaaaacattaaataattgtgcatttcacaccatacccaagcctttctgactttgtgattaccaaggtgcattagaatctaaactgctatgttatgctatttgcaaaatactcttggctcttccctgaatcaattcccgtgagggtacgtatcaggtaaaactttgttgttttagatctatttgttcttagacaaagtaaacttggaattgcttttcagtttgttttgaaatattccctagttctgtgttttcacacgtgcacaaaggccttacttcccccattagtctgattctgaagttttgctgcactaggagaatgttcactgacaaaatgttaagtaatggtgctgaaatgtaaagtaattaatgcaagaatcatagtatggggtggggatctcagtgctttaatgagggctggggaaaccatctgactgaggatgttgaaagcggaggggtagatgaatgttcctgtaattaatgctgcatattaaaaaagtgacctctttgggccgggcacagtggctcacgcctgtaatcctagcactttgggaggctgaggtgggcagatcacaaggtcaggactttgagaccagcctggccaacatggtgaaaccccgtctctactaaaaaaatacaaaaattagccaggcatggtggcatgtgcctgtaatcccagctacttgggaggctgaggcaggagaattgcttgaacccaggaggcggaggttgcagtgagccaagatagcaccaytgaactccagcctgggtgacagagcaagactccatctcaaaaaaaaaaaagtgacctctggcatggtcaatatggggacctcgtaaccttccctgtcacctagaactgcacttctgggactctgtggtcctattaataaaaaagataatcaccartctgcctcatctactgtggaacccttccaattcttttttttctttttcttttgaggagaaattagaaatcaccaaattaccatttttagactatttatgtgtatatgtatattttactctcagatatatttattcaatgcttgctctataatgagagttttaactttctgttttcccttccattatccctgaaaagaatggattatggagaaaagatgaaagtagtctaatgcaatacagtgtttgctaatgtgctgtcagaggtattagtgggacttgctaaggtttgtgtcttttatgaaatgcctttcagattgcaattatctaatagacttggaaacctgtttgtactcttgcaggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtgccctctgcgtgtgttgcatttcacattggcatttgatttgtttgttgtgatactgagcgtgtcattactgggtggctcagactctgggtgttaactctagcctgctagaaaggtcatcttcctctgctaatcacatcctgtattaagtatatgctccgtcctcccycagtgtgcagcagcatctgctatgaattcattttcgggctctactggtmtactgcaaaggagagcatatgcgtgagcaagctaacagggccccacttccctcaaatgttcatcaacattttaaagttgagctccgtgcagtcctcccaggagactgtygtgggattttatagcagataatgggacagaaatgaagaatagaatcatggtggtgacagacagtgtaacgaggttcacttccccttgatgtacagttataggccttgactaagcaggcaattaaaatcctcccactcggccctcccagtccagccccctgctaaaaggccattgataaagccttgaggcagggtcttggaagtttgagaccatgcaaatgtggggcaacttggtgatgtggctttaaagaaagcagggctgctaaggcacccctcttctgcttccttccttgggtgaccgttgagtcacttgaggaccattttagctcatttggttagatacaggatcaaagggggagccccagccaggacaccatgaccctgaccccagacccccagcttccttgctctgagcatacatcttgcaaatatgtggctgtcactacaaaggacatgggcataccccgcccgacagtcttggtcctgccgctgatgagtaggtagtagcatccttactcttttcctgagtttgggtgtcccttgcctcctaaagtaggaaggcaaggagcagagcaaggagggggcctggggacacagcctatcagctatgtcaggcttctgtgtgcctgctgatttcccagactacctccagaaaccagccatcaactgtactgaaatccaacaccaggctggacgtggtggctcacgcctgtaatcccagcactttgagaggccaaggctggtggatcacctgaagtcaggagtttgagaccagcctggccaacatggtgaaactctgtctctactacaaatacaaaaattagccaggcatggtggtgcacacctgtggtcccagctacttgggaggctgaggcagaagaactgcttgaacccgggaggcagaggttgcagtgagcccagattgcgccactgtactccagcctgggcaatggagggagaccctgtctccaaaaaaaacaaaaacaaaaccaaaaaaaagaaatccaacaccagaagcagctatgcttggagctcttacagcagagactcaaaaacrcagatgcccaaaggggcagaaaatacataaggggtgtcagccgcctgggactacagaaagcagtggagcttgacttaatgggaaaggactcgccatccaaggrgacagtgccatttgcttcagtggttgccatgtggactacagattgtattactagactgttcgattttctttttttaaagaaatcagatatccagttttttatatgcaacttaaaaacttttaaaaaaaattttatagagacagtctcactatgttgcccaggctggtcttgaactcctagcctcaagtaatccccctgcctccgcctcccaaagtattgggattataggtctgagctcctatgtccagcctatgtgcaatcttttaatctttaaatgttggcactgagttgacactaaaataataattaaacaccatgcaggttccaaaaaaagaaaaatcacatttgtgcaccacatgctcacctaggcataggttagcagccttggccagagagtctgcccactgtggtgctgggaccttcgcacactgatgcctccccctccaccccgaacaggagcctacagagatggttcatatcatgcctctctttgtgaacatgggcacacaagtgtgagcatatacaaatttgcttctggaatttttgttgaagagcttagtcgtccctcatagaatgcattattttgtcttcagtggctttacttccaggcttatcagggaagaagtggtttgaaacatcagagccctaaacaaacraacaaaacagaactcagaattcaggctaccagtctggctgatgcatctctacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcgatcgtgtctggggctgaagttttctttcgttgcttgtgcagacaagcccatgaagggckctcacagtgtacttgtcacgtattcccttctcagaaggctatgattttctatctcctgaactctctccaccctgaggttcagcagaaaagaaccyaggaaaaaagtctaggaaagccagagaagagttatcctttagccttcactgggtgacaagcgtgctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtgacttctcagagatctgagtgccagagaaacctgcacataacaagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaagggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagaygggagttttattattactcaaatcagtctccctgagcgttcagggatsagagtttttaaggacaacttggtgggttgggggaagccagtgagccaggagtgctgattggtcaggtcagagatgaaatcataggaagtcaaagctgtcttcttgcactgagtcagttcctggggtgggggccacaagatcagatgagccagtttattaatctgggtggtaccagctgatccatcaagagcagggtctgggccaggcgtggtggctcacgcctgtaatcccagcacttcgggaggctgaggtgggtggatcacctgaggtcaggagtccaacaccagcctggccaacacggtaaaacgctgtctctaaaaatacaaaaaaattagccgggcatggtggtgcacatctgtaatcccagctacttgggaggctgaggcaggagaattgcttgaacccgggaggcggaggttgcagtgagctgagatggtgccatggcactccagcctgtgcgacagagcaagactccatgtcaggggaaaaaaaaaaaaaaaaaaaaagcagggtttgcaaaatatctcaagcactggtcttaggtttyacaakagtgattttatccccaggagcaatttggggagagtcagaatcttgtagcctccagctgcatgattcctaaaccacaatcccaatcttgkggctaatttgttagtcctatgaaggcaatctagtccccaggcaaraaggtggttttgggaaagggctgttgttgtctttgttttaaactgtaagttcctcccaaagttagttcagtctacatccagaaatgagcaagagcagcttggaggttagaagcaagatggagttggttaggtcagatctcttcactgtcttctaacacatctgcttcaccgtcttataacagtgaaaggcatctgaaaggtttgtttcagatgtttttcactgttcacctttcagatgtctttcactgttatagttttgcaatggcgatttcagtatttcgccccattctatcctatagcagtcctaygagataggtactattattaaccccactttatagatgggtacgatgaggctctgggaggtctggtaacagctagtcagtggcagggccagattcggacctggatagttggctgtagggtctgtggctgaaccagtccatgctgtggcctcttacaagatgtaggggtagggaggcaagcagggaagatgcagatcacacagatgggggcagcctcttcaggagttctgagtcttatcccaagaacagtgggaagccatgggaggtcctgaagcagggaggttagtatttcaraaaatgagtggggctgtgtgtgagatgtagatagaaggggtgcaaacctggaaatagccccattagaagctgtggatttctggtgaggattggtgctgtccagcaataatgcagtggctctggacagacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccctgtttttcatggctgtacagtcccagggtgacaggtctgcaccaggaaggacctaggactctgccagattctccccttgcccaggaagaagtgagactgttcccgagcagagcttcttagacaatggccagggacagagaacacccatccttgggctttttggctgagtgggtcacccagtttgaaagtggttgcgttgggtgatgactgaggtgctgcccctgtggcattgctgtagggagtctagcagagaaagctgcaggctagcaacttgccccgtgctcactctcctatagctcagacttgccaaccctggaatcatcttgccaagagcagtcgttcttagcttttggagtttgtaaaaatccccagggagttttctaaaagtgtgcattcttgggctcaggaataaggggcatctttggctgtatttggaaaaacacggccccagagggaaggtaatggccaggaggagatcggagtcagagatgctgccctgctgggtggaagtgcttatcatggcatcagttcagggttctagacctgcaagccagcacctctccctgtgtctgggtggcaggcttgtcttgatgagttaggaggggacacagactccaaggccctcctctggtgctgttgactggagttcttgtcttgctcagctgtgcctcccctgccaggcttctcagcatcccttggccactgtggggcatggggtgggccgcagaggcaggggatggggctacccactgccattaataggaggaggcagggcaagtctctccagcagggagaatgaagaaccaccacagctgtctgcaaggcaaggtgaaggcctgtcgggagagatagaacatcagtcttcactgcagacatcggccgkgctagacacctatctgcttaaggatgataatgaaattaatccggcctgtagtcacttcccgtccaaatgatttattggcctcataccccagtgttgctgcatggtggtaataaatgacaagcctaggacatgaaggcttaaaggattctccttatgtttaaaaagytaagccataaggcaaataaaccagagagcctgaaggaaacgggaggtcattgggctccatgttytytatgcctggaccatytcaaaagccctgttttttaaaggctgcttggagaaaatcatcccccaccaccctcagccacctacatytatatttgattaagcagcgcctccgcagactcaacatttgggagtaatttgacagggctgggctgaagtttgcttttacccttttgttaaagaaaaaattttctcttgagcactagcatttccctccaaagagacaagatgctaattatcactcttattcatttactaaagcaccctagtttgagtcactgtatgtgcttaaaagcaaaaaaaaaaaaaaaaaaaaaaaaawttcatttaaaaatagggtctaattcaragttttaagkgaatcaractcacctccctccaattagtccacattagttaggttttaaagttaatctgtagtgacggccagttcctcctactatctaaacaaagtccctgctgttggagagccagcctgtttcttctttccttgtctgtccttagggcaaacagagtgtagctggtctcgtctgaatgatttactctcagcacatttgaagaacaggtttctagaggggatttgagggcatgacaaaaatatagcatctcatggactagatgcagcccccagagccccacattgctggcagggccctgtcacctactggctgacacccttggcaacccccagcaccggggaattgctttccatgacaataaccatggcagccagtgcctggcactgctcacatgcattagttcaattaatgtccacaaaaaccctgggaggcaggtgctttccttactcccattttccatctgatgaacacagaggagggtgcatttctgttccagtgtcattctgtcctgtgcagacaaagggttaagcgtgtctttacacatgaagccasaggagtctttctcccctataattaaaccctcccggtgcgcttccttaactggatgtcattctgtgtgcgttgactatgaaggggactgtgctttgctctggtgccaacagggtctggggcatgtgcacctgcatgttcagggagtggggcacactcgtcccctaggactgtggcagggtggtttctctggagtccagccttcttcctctcactcgcaccctgctgtgacctttggctgggccgagttattgcacccgcaccctgctatggagtagtggcgagtgtgcaggacaggtgttgggcaggaaattttctctaaagattacacttcgagttctgagctgcaaggttttgagaggcagaaatgttgtttaaccgctttcattaacagatgtgtactaatgcagaagtggtcactgctaacaaatttgtaattcaaaagatatttaaagctcataggaatgccccaaagggtctgttaagtaaggtcagcaatgcttctggtcaagtccatcatctgtgacactaaaagggactggacaatcgctaaaggtctgttgcagtgtgaatgtctttagatattcatttaacaaacacgtataatgcttcttgtgtactgggtactgttctagggctttgaccaacagcagctctttccgtcttctttaccgctccatgaggtgaatactatcagccccattctgaggcccagggaggctaagaaacttggccagagtcacagagttccttcactgatgcctcaaggcttgaaagcaggcgaaataaccactctagagactgtggctctgcgcagggcctgagggataccttcccccagatccaggctttcagcccatgctcctaacctccgaggcagcctggctagagagctgggcctgattgaggagaaatcctggtagttacattctctgatgtcaaattcataaagggtaacttctcttaaaatcccagggtgaatctcgtgtctgtgagtttatcaaaatgcttccctacttctactttaaccctctttttggccagcagtccgtgaagatgacagttaccttcatccaaagggggcctctctcaggcatctgggctctgacaactccaacccaacaggatcactcttgagtcttaagtgttcaggtcttcgcagtttcccacacattcttggtggcccaactccctcaggaggaagacagtctcagggctatcactaataggccgcagaaggagctggctagtggcctggaggttaatttcaagtaaacaagagagaagcaggagccctgtggcattttctctggtttccagcatcctgtaagccctcccctggatgtccagaaccttctgtgtgatttgaccagcctgtggaggatgttctgacggccccttccaatgcactggtgaacccctgtgctgaaggactcagcaaggttatccctcaagccctgagaaacaagattttgttttcatcagtttccagccttggggcatcagtgagaagagctgagggagaagacgatactgacggagggagagcaatattggcacgtggctgctgggacagcatgtggaatagaattctgttttcacrtaatattgtttcagcagaaaaggtgatttcaggaatgagagatttcaatcagagtttctgtgtagtgatttgattctcatgttttcagatttttttctttaaattatcacaatattcagaacatattcataatttttcataaaatttatagctacaatgccagcatttctcttaggtggagccatatgaaattgtcaataggtgaccatttttacctacaaaagtggtagtttcataaggttaaacataagttcaaccttacatttctagaaaatctcttttcatggaattctaagctgtgccataaacatggtatcttataaagaaatcttaccttcacttgcaagtggtttggaggatgtgtagctcctgtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcrtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccccacaaacatctgtaaataaactatttttctgtctttataatcgtgttaaagtgtcacatgggggaaatgttccagctctagagcagctgtgaaagttagaaatgcactcacacatacgcgctcacacacacacacaactcatccactaataaaatgtttctacacttgctcttgggagataatttcagagtaaaatttccttggtacaagctgtgtctatgctatcttaatgcctgagcacagcactagcagcgggctgttgccagctcttgaggagacatttgaacttttggcagcgytccttatcagaaggcccatccgaggtatttgtgattatagagtaagggtgctcgcttttggcaaaacaaagcgtctgacagtagtgaagtactggctcaacactcaatgggagacatttgggattcattctttgacaattacccagaatgaatcatcagcttccttttataaaaagatatttattggcttagaaacagagcatatccagctcttcgtggggaggaattttgtaactatgttcaaagcttctcataaactcggtgtctgagtattgctaagggggtgcctgcacagagcatttagtttaattgcatcaaatatggaggagaattgaaaaatcagccagcaaacaatgaatagctcaaggggaaaaggagaggatgctcgttaataggagcagagtcgaagagctcagtaagagttaagaatccctgctggagtcactttgcagaggcctgatggccccagccggcccctgcccagtgctgcccccaccccaccaccaagatatcatgcacaccagcagttggaggcctctggcctaaacttagcggctggctggacagctgtgtttgaggacctcttgagggctggctcttgctctgtgttcctccctgtgggtgtaacctgaaggagattaggttttaatcctttggtgcttgctaggtgggctagtacattctgataaccaatgtgcagcaggccagaagagaaattctaggtttccactctttccaaactgggaaggcaaggtccaaattaatattagaattgagaatagctttggagcttcagaatggagggaaaagtcacttagctgataaggttcagaagtgacagggtcagtcctccagaaacagttccagaatgaaggagatttgtggatctctgacctgcctccttcttgccacccgtttgtcttgtaattttgtgaatgagcccctcctcccacagagccaggcctgcccccagcatcttggcatctttgtccccctttgcccgaagggcacttccttgcttggggatttgcgagtgcccatcagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacaggrtcttgctctgttgcccaggctggagtgcagtggcacaatcgtggctcactgcacccttgacctcccacgctcaagccatcctcctgcctcagctgggactacaggcrtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaattcgtttaaagtatacaatacagtggttttaggtatacttatagaattgagcaaccattgccacaatctaattttagaacattttcatccctcccgaagaaaccttgaattcattaacagtcactccttatttcccccagccctgctttagccaactagtaatctacgatctgtctatataaatttgcccattttggacatttcgtatattctttttagattcgtgggtacatgtgcaggtttgctacaagggtatactgcatgatgctgaggtgtgggcttctattgatcccatcacccagtgaacgtagtacccaacaggaactttttcagcccttgccccagacccatccccgcttttggagtccctcatgtctactgctcccatctttatagacacttcatatcaataggaccatacaatatgtggtcttttgtgactggcttcttcgcgtgtttttgcagttcatccatgctgtagcatgtatcggtaattctttccttttattgtatggcaatttttggtagtatattcatactacatgaactaacacatagtaataatgaactacttgtagttgcaacatgaatacatgtcacagaccttatactgaccctcaaaatctagacacagtacatactgtatgattctatttatatgatacccaagaacaggcaaaattcataaatggtgatggaagacagaaaagtaattacctctggatgaagatggggtggtcattgtctcggaagggacaatgggagcacttttcaggaccttgcaatattttatatcttgataaaggtggtggttatgccagtatatatttaatgtgaatagtcattgagctgcacacttaatattagcaaaagttaagcatgtcccacattatgcttacatttcaaagcttttattaaaaagtatatgcaaattttgtgattttacaagcttttgaaaaaatgtcacaggttgaatatcccttatccaaaatgcttggaaccacaagtatttcagattttggaatttgcttggattctagaatatttgcatacacataatgaaatattttagtgacaggacccatgtttaaacacagaatttatttatgtttcatatacaccttgtacacagagcctgaaggtaattttatataatttgtgcacaaatcaaagtttttattgggttttgactgtcactcatgctatcatgagttcaggtgccgaattttccacttgtggcaccacgttagcacccacaacgtttcagattttggagcattttgaattttcggattagggatgctcaacctgtatatacctacagaaaaacaaataaattataagcgtactgctggatgaattatcatcaagtgagcatatcctgaaactaccacccatgtcaaaaaatagaagccctctcctggcctttcctaatcactaccgctgctctcttctccaaatatctaacatgatagttttgactgtttgggctttttcttttttcaagctctatgtaaatggaatcagtcagtatactttcttttctgtcgagcttcttctgctcaacattatgattgtaagatttacccatgtggcgtgtaacagtagtttgctcattttcattgttttataaactgttgtataaatatgccccaaattattcattctgatgatggatgtttgagttgtttccagtatgggacaattacaaatcgctccctatcaggatttatacttatttctgtggactaaggacctacatgtgaaatggctctgtcatagggtagataccaactttatataccacaatttctgaaaacccatttcagcatttcttaatagagtagtgtcatagtcagttcgggctgctataacagaataccattgactgggtggcttaaacatttgttccttatagttccagagactggaagttcactgtctgggcaaagtactagtagctcggtgaggaccctcctcctggtttgctgagagccgtcttcttgtatccttgtgtagtggaaagcagaggggaccagcaagctctgctgtctcttccttttcctcctctgtttagagacaaggtctcactctgtcgcccaggctggagtagagtggcacagtcagggctcactgcagccttggatgtctgggctcaagtgatcctctcacctcagcctcccaggtagctgggactacaggtgtgcaccaatgcgcccagataattaaaaaaattttttttatacagagggatctccctatgttgcccaggctggtctcaaaactcctggactcaaggatcctcctcttcttcctcccaaagtgctgggatcgcaggagtgaggcaccacgcccagccctggtgtctcttcttataagggcactattcccatcatgagggctccaacctcatgacttagtcacctcccaaaggccctacctcctaataccatcacactgggattaggatttaaacataggaatctggaggagacacaaacattcagtccatagcaagtaacaattttttaacctcaaaaaatgaaactggcctaggtcttgcctgacctctgtgaattggggggaatgtcctaacacagctcagtcttcccctcttccagggcttcccacctcccatctgtcccacagggtcctggcctccaccttctgcgtactaccccactgcctcccatggcctcatcagcctcctccacaggaccatgagccccttgaggacagagacactgccttgcttgtcatttagtcccagcctccagcacagtgcccagaacatagtaattcttgataaatatttgatttaataagtgacagcatgtaagatccatccagccatctaattcctgggtgaagttgagaaatccattaaattttgaamactcatatatcttttatctttggtttcagatatcaaatggatccactataaaagtctttaagaagatagcaaattttacttcaggtaaccaatataatattgttaaccttttgttctcacccagcttcataaagtattgctttttgcctctctcagctgtattgtcacaaaggtgagattgagttgttgctatgtaattctctgaaagttgagaaaagtcattttgatctctttgcagtcctaagaatgtgatccctgcaagaaggaaaggaaactatagatggtggttggcctggactgcccagcactgaggaagtggctgcctctttatagccctaaactcagggcagaatctcatagctttttttcaaccctttagaaggatggggcctaacagaggagatccccctggcaaactgagagggaagagtacagacaatcatcacagagccccgmagcaagcgctgaacaaacaagataatccacttagaaggtccaagtctcctgtgatagcacttgcaaaattcccagaaattggagagagacaaactaaagggggaacttttatgggaaagtcaataggctggtctctaaagtgatcttctgcttccctgatagccctggggcaggaaattcctgttccaggtttgtctccagagaaattataccccagtcaagacaatcagctctcagcccttggaaaggttctgagctcctcccaaacaggctcctttcacacacacagccagaggtagggcttcctgacttctggattcactattagaaggagcagggagcatctggccagtgcaaacagggaatgtggggttcttgattatacagacaggataattgggtaggactcctttggggaaacccaccttccatcactatatggggctgtggtgaagccatcttgcagagatcattccagcttaagggggatggtgtctttgtgttgaaaagtggaagagcatggtttttaggtttcaaagattgggccttttgaagagcctattatttggggattgaatagtagaatcttaggtttggatctcttcgtgggccctccagtcagtcaacactgctgctagtttccattcactgcaactgagagccaccgtcttacaccctgctaatactctaaacctcctgtacctctgtcctatcatcagcccctctgtcaaaatcccaacgctggatgaacccaacgattatcctttcctgaccctacagctagggagccacagaagaaaggcacataatggcacacagtgggtcactataagttcatggtacccaacttgaccagggccctccacacagcctgctctcattgggttcctctgggcaattcaactctgtgttgtccataatgtctgccttctctcctcaaagctttgacccacacagctctcctctcagcagatgacttcaccctgcactctttacagagaaaactaatcagaagtccttcaacagccagtagcaaacctaccaacctacctgcacctgccttcttccttgatgcttgtaggctgaccttcttccattcaaggccagtctctcacctgtgctttgggtccaccatcctttccaaccttcttggtatccttacaccaccagtaatctcttttctcacctgtactttcttttcctctccatctactccccattttccattagcatttcaagatgtgctcgtctctctcatctttatttttaagacagtgtctcgctgtcacccaggctgtagtgcagtggtacaatcatggctcactgaagcctcaacctgctgggctcaaatgatcctcccacctcagcctcccaagtagctgggattacaggagtgtgctaccatgctcagatactctttaaaattttttgtagaaatgaggtctcgctacattgtccaggctggtcttgaaatctggactcaggcagtcctcctgccttggcttcccaaagtgctgggattacagatgtgagccactgagcctctctcaactttaaaacaaacaaaccaaatgccttacttcctctcttccctccatttaccactcccttaccctttacagccacatttcctcactctgcgctactcttgacttgctctgtgagcaccacctcattgtcctttgagatcctagaaagggtcagctccttcctacctttggaccttcctgcaatttgcctagctgactctatctcttcattagattcagctcaagcatcccttcctcaaaaactcctggactagatttggtctcttgttaattctttagcatataattctccttcataacctttatcacagttataataattgtgtacctagaagtttgatgtctctcattggccagaatgcaaattccatcagggtgggaactgggtcttattcattgctatatgcccagtagtccctggcacataggaggtgttctaggtacatttgttaaatgaatgaggcttgagcctctcctaccagcaagagatcagagatcactagggaatctacttcctcctccaatccctcacccgtcccatcttcacgctgttcttaagatcttaagatgcagcagggggaamaatgtagctatggagagctcaagtcaaaaagctcaagtaacttcagtatacagcacaaatggggccttttaagagaaggccgattagcccatggttgctttttttaatggactgctttctctccctctttctctggcattcagatgtggagtactcggatgaccactgccatttggtgagttcaggctttcttgtgctcaccactgaactgcatgccttctgtagcaagagtggtctccttgggtaacgcttctgctgtcttcccttcagattttaccagattcggaagcattccaagatgtgcaaggaaagagacatcgagggaagcacaagttcaaagtaaaagaaatgtatctgacaaagctgctgtcgaccaaggtacacttactgttctgggagcactttatggctacctagggggtgtatgatatgtttgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcraataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgcttagagcttaggagatttgtttagtgggcagaggacagcccaagcctcttgattttctcagctgtcccatagagcccagcctatttggcttttgtgaaatactcaaatgctttggaaagtacacaataaaactttatgatagaaatatatgcaacaggaaaaattctgggaacagagcagcatcacttgagcttttccaggctgaacataactaataaaagccaaatatccatggcttcctggtttatgtaaacagccctacaactgacatttcaactgctagagatttctgatatcctcccagttgactaaacaatgttatcagcaagaagcttatgaaccaaatctaaacctgggcatggattttcaagacttttgacctatactgtgagcactggccacatttgacaattttacatttttctcttcagtttgtttttccctgttttgaacattattttctctgaatgtggatttgcttttgctattatgttttcaaaaccactaccacagtttttaatctcccaaatctgatgttgtctatctttcaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacaggtgggaatgtaggtgattagtgactgttttcaagaatctgggacagaatattaactaaaagaaagacatagatagttatagaaggattcatttatctctatatcagaatctttgggcttggtaagctatcatgtcaaagtagtttcttattctgttactatttttaaacaataaaggaaaccattcctatgccaagaatcctgttcttgaagataaactgttatctttggtgcatgatactttgtctagaatgttaaaagaaatttaagttgaccagtaaagaatgagaaattaacatttgtggttttatatcatttttgcattagagaaaattttatgataaaccattttttgttcctaatcggttactttgcagtctccaagctgtctatactctgattctgtacagaaatttatcaagtgcagtactcagatactatgagaattagccaaaagtttgtgttttgttttatattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagcctcttatctccagtccctgccactcccacatcaagactgggagctgagggccaccattccaccttgaagattatggcatctgagcaggggcagcagccaggacagtagagctgttgggagacctagcagcatatgggggaggtaatgagctaggccagagttgaaaaggagataatggaaggactttgaaccagtcccaagttcatgttcgggtatttgagtacctactatgggccaagcagttagttgctggagatatagtaacaaaacagatgaaagtccaggtcccattctaatagttggggacagacactaaatgcaatatgcaaacagtagcacattagcagatgatgagtgcagtggagaaagtaggaaaggaggctagtatgtgtcaggactaggtgatctgagaaggcctcacagagatggtgacacttgaaccaagtcttgaaagaggagagggcataaaccatgagactacctgaggcaagaaagtttcaggcagacagacgccaagagcacaagttgtgaggcacgtgcttgcttggcccatatgaaaaatagcaaggagaacaggagagttggaatgagcgcggtgaggagcagtgggataggagggccaggtcatgcagggtgttatccagagggagatggagagcctcagagggttggagcagaggagagacatggtctgattctgtgttgagaggactgctgatagttatgtgagaacaaactgtcaggagatgggaaataatccaggtgagagagattataatcaagagctatctggagaaaattcttgcccatggccactttcaaacttaccctcctctatccttcttttacagtagctctgccagttaaccctttcttcttctctccaagtgacgcttctgtctgttgcttggtatgtttggctaagcagagttgtatacytcaataacaaggacaaaaacacccgtttacaaactgtgataaacagaccattggcttcatgaatggccctatttgaaaagagattattctctctttgaacagccttccycttcgcttctgggtaaacatcctgaagaaccctcagtttgtctttgacatyaagaagacaccacatatagacggctgtttgtcagtgattgcccaggcattcatggatgcattttctctcacagagcagcaactagggaaggtaaggcccagcttgagtatttcttgtatgcagtcttakgagtttgacatacttgtctttctgataagcattcaaataataaacaattggtctaaactacaccagctaaaaagagatagcaagggccactgtcaatttgctgttatttaaaatctgtctcattatttttaatctaatttttttaaagtgaaaaacaaaataattagccccacccaactgcagaattctgcctgtgaaaaactttatcacaaagtatgcgttttgtttcctagaaaaatattctatggacactgataaactattaacccaaaatatgcaaccattgaaatttgcctaaatcaattctatttgaatatacataaaatgcctatttgaatataacacattgcttatgggacacaaaatcttgctcaagatttctaacaataccagtttgtcagtttctaatcaaagcatgagtactgttttcctatggttttctttgctgatcaatagtcccaagaactcaaagaaagacaaaaatcagagcaaacttcgaaagagatgttttggtcttatttgagcgctccaaaatatactaaactgagcaatatctgtgcctaatggatctttgaacactgaggaggagttcttgggcaggactttaagagtacctggaatgaatggagactgatgttccacaggtgcctcagactcccagtcataatctaaactctttatcagcagtatttctgcaaaacaaacctgtttttacttttgtcttccctagcattgcctagtctctcaaggtagaatcctcaacgttatctttgactcctcttccttccaacctctatccccaaattattggttaccacttacttctgtctcaaatgtctgtcgctccctcctccttccttagccttatcacttagccttatcccttcatcccgtccctactgggataactgcttcctaattggtgtccttgcccctgctgtccacctttccttctaaacttttccttttcactgtctctcaggtaatctttctaaaacataaatctgatgatgtcagtctgcttcttaaaaattgcaactatttcccattacctaccagctaaagtcttcacagtgccacatagtgcttcctgatgggcttcagccctctttgctggcctcgttattttcttgcacgccccacatacccactgtgctacagcttttacttttcccaagttcacaccatgaacttgttctcacacccctttgctcatctttcctgtctcacagtccctctgtctagtaaaatcctacccattcattcatcataaacattttattcattcgacaaatatgatttcctaatgaggaccagaaactgtaggagactcagatcagtctacatatgcctactttgtgaactttccccaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactmctgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatcttccctgagtagaattttttaaagttttgtgaaaaataatgatttttaaaaataaaatcatatttaatttttaaatatcactgttataattacgtagaatcattcaaattgccagagaacctctgcaaaatcacacatcagagccaccaatactaatgaccatgtgcttccctgaagaaactggatgatgtctataatctaatgaaataaaagggacaagctggaaaatctgcctctgccaattacttaccagtttcatggttatataaagggctcaatcagacctacaatcaagtcttttgtaaatgccaaattcactggtgggtgaggatgagagcaaatgttttaattcaggctttttacaaccattagtaatgaactatgattgaaataagttccattgttacagtaactcaaaatcatgcaaaaataataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattggaatattataaattcctccatctttttttttttttttttttactcttttggtgatggttgctttttttttttttttyyycccaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaasccaaggtattgttgatcctgtgataaggacttagcaaaacaacttgcaaagtgagtatgtaaatgatggaagaaaatgttggcatctgtttcatacagattttaccactcayagcatcaggtatgcaaaaaacagrattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacatttyatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctraagacaatcagtcactgggtctatattaaacagcaaccagagcaacaaatggcaaacaatttctattttcaagtttctttgcatatttttttggtgcaaaaccatttataaacttttttttytaacactagtgtctacagcagcattyaaaaaaattctgttaccttttctgtattaggatttaaagtctatttcttattgtatacctgattgaagctgttcttggagatgaatgttttaaatgtctatatccaaaaaataaacattttgatgtaactgtggactgtcttttttttttttcaattttctagttataatagtttttttattctaagtggctccgtggaaattatttttcagagataaggtgtcactgtatatgctgtgaataagcagctatattatgtagtaagtaaacctagtttgctaaatggtgctaaggactgctcaattacagtcctggccttcttcactatcaactgggacttttgactatgaacaccttgggataatgaacattccacttaatttgggagacttgagctttagcctcgttaacatgaaattattccagcagaattcctctaaaagatgtcacattaaaaaggcttccaatgggtgtagaccaaaaaaaatgagagcatacttagggacacaaaacacataattatttggttagatccacagtaatgggaagtaaagttaaataccaacaatgtttataaaaggacctgagttcaagttttataatcaatggcccccttgttaatacagccataggatttaattatttgcacttattctctattctaacaaagccaaaatcagtagactgtcatattgctaaatatatgctatatggttgatgtaaaattaaacacacgattaaaaaaaaattaagctctttaattatgtgcacacagattttagaaaaggtagccttttgtatatagatacctttacattctttaggctgacttttaaattgtcatcttttttcaactacagtttttgtatatagtaaaccagaagatgtgtatggaccctgttatggccaagcatctcaaagatgaagagagaattaatgatagttatatttcactcaaaatgccaaaaaaaaaaattcaacaaagtaaaaattttaaaacttgactctaactagttcctttttgttttacattctcaaaccattgtcaaatattctaaatatctctgagaatttctcttttaatgcttcacttgtataatcttaaaatcctgacagtcatacaatacagcatgtagtaggtaccttttcttgaggcacattcaagtgttttggcaaacagtaaaaagtatctaaatgccacaggttaaaatgtcaagttttactgagtcaccaacttcacctcttttgatctgcctgttctccaagaacatcattctccggaagatccaagttcctctagttgttttctttgtgttgtttccagttcttctagtcttttgcgaagtagagagagttccctttgatgttgttcctccttaaaatgatgtagagaaagcatagcaaaagaaactattagaaaaactgttaggtagcaaccttggactgcctcttttatatatgcctataacatctggcaaggaaatgctgaccactgtagcagtctaaaaacagtagcatgggctaaactaccatctagttttgcttctctcctgcctcaggctctagccttaagcaaaacccgtagtctgttcttctctaggtataaaattcaccagggagtgaattagaaaatactaatgcagggcccaggtatacttacatggtaactttccaacaacactggtgtttaacagcagtttattataaacaaagcacttggcctgagattcaattcagtgattaaaatcttctgtgcttatgttataaaacataattacttattaatactcccatcttctgaaaaagaatcaatctgattccttcaatacctcaggggcttgatacaatagaaagagcccgggttttggattcaacaggtttaggtttgaaactttgtcacttattagctatgaccttatgcaagtcacttcactctgaatcagtttccttatctatgaattaggaatagtaatatctgccctcaaagcatttttcgttagtattagacattgcacggaacatgcacagttcactgcgttagtaaattctcagtagtaattactattaacattatgaataagctacaaactctaggttactcaatgactcaatcaagtttcctcttttctatcgtccagtaagagatttcactctcagcaccaacactaaaggatcatgattcaaactgaattcagcaaatttctatgctaaatgaaagggaagaagttaaaagtagttttaaatgtttatgccatttttgtggtgaattttgagcactgaccaaagttataatttgagttttatcaccatatttaaacataaaaacctacaaaaatgtacgactttttttttccccctaaaataaatgctcatacctgcatatgaggaggaaatggtagttccatgcttggaaccatggctgatgactgaaagctaacaggattgatagatgctgttggaggcatgttaggaaccaaaattagacttcgaaattcattatgtcttctctgtatatcttttagtcttttttgaagccttgtatagtcttcaaaaggaacattttgtcttaaaaagaaaaagaaatgtttctttaacatggttataccctattgaagcacagtatgattcacagaatataattttaaactggaatttctaaattatgagatctatatataatatatagataaaaaatctgtttacctagaaagataaacagaaacatgacataacatcttaatcattagcaatcattagcattgcagactatcaactcattataaagttttatttgctaattaaagatctaaaatcttttgatactttggtactcactcctaccctcctactcacccccattcatgaatcctgaaactaaagggagactctaaaccaaaagagtgccttatcttacagaaagaatcaaataaaaatacagttcatccctcagtatacacatgggattagttccaggacatccctcatatatcaaagcctgtgcatacaagtcctgcagtcagccctgcagaaccctcataatggaaaagttggttctctgaactggtgggtttcacatcctgtgaatactatattttctatccatgtttgcccgaataaaaatctgtatataagtagacccatgcagttcaagcccatgttgtcaagggtcaagtgtaaagaaaatgctggattgaagcttacaaaattgccatttttaaataggtgaaatatggtcaaatatagagattttcatagttcaatctaattttcaaaatgtcagtgtaatattttagtaagaaatatatatttggtctttgcccttggttcctggcacacagctcctaaaactctgggaaactctgaagtgataagagtatcttttgtatattaataagataactggtggctgggggcccctgaatagcttcaggatggggcaggtcaccagaaagactgaggcatgattagagggttggaactttcagccccactctccaaccccaccccatgacatctgggaaggtaaaggactaaaggttgagttgatcaccaatggccaatgatgtaatcaatcatgcctatgtaatgaagcctccataaaaacccaaaagcatggggtcagagagcttctgggttgctgaacatgtgcaggtgtctgcagggaggcatgcccagagagggcatggaaactccacacccccttcctcataacttttcctatgtatctctttcatctgactgctcatctatatattttgtaatatcctttctagtaagctggttaacataagtttccctgagttctgtaagctgctctagcaaattaactgaacatgatgagcaggtcatgggaaccccaatttatggccatttttagccagtcagaagcacgggttacaacttggggcttatggctgcattctgaagtggggggcagtcttgtgggactgagccctctacctgtgggatctgatgctaaatccaggtagacaggatcagacctgaattacaggacacctagctcgtgtccactggaaaactgattactccatgtataggaaaaaaccccaaacatctggtgtcagaaatgttgtgttgactgtgtgagaataggaaaaacactggtttttcctattataaaaggtaatcacaaaggtgaagctacacaactttaggaaaaaatgacatggagaaaaaggctaactttccaggccttcacagatcatcatctttttggacacgacatccagtaatcaaatataatttcaaaatcactcaaaattctagatgatctgcaccacaactggccaatcttgaattgctaacatttcaatattaatgtttatggaagaggaagtaagttgaattctgttttagaaggactgagccaggaatggtggctcatgcttgtaatcccagtgctttgggaggctgaggcaggagaatagattaagcctaggggttcgaggctacagttagctatgatcgtgccactgcactccaccctgaaccatagacgaagaccccatgtttaaaaaaaaaaagaattgaaacaaaattcaaaattacaagcatgtttgtaatttacaaattactaccaaattaataaactaaaggcggcctcctactttggaatagagtattgtaaggctggcactaattctacagtctagaaacttctagaatgttctttaaaaaacaattgttcacctgttggtaataattgcacccaagaacaccagtgcacatcataaaacgtcactgcatgatattataggcagtttccattacagaaaaatctatacttgaatagccaaggcgctgaaggctaccactaattcactaaattaaaaagatttttcttaacttgaatcaaatgtgtcatataatgccactaccaacaacttaatatgacaaatctctgctttaaaaatgctgatgatcctgattatcagatgtgcttgaatgtgactgcaaaacccgaaactacagctcaataaaatctccacaccaggaaaccaaaactgacctttgattcaaagttgtaggcacaattttcagaactatgcaatagctacaac

SEQ ID NO: 12409 - DNA, 47572 bp, Homo sapiens
  misc_feature (1)...(47572): n = A,T,C or G, or insertion/deletion polymorphism (see Tables 1-2)
tcccctggctcctcctggtgcaggatcgatgaggctcttgcccacagcctttgtcccccgacttcctaccacctggtgtcctcaccccatctgggccccgagcacacagcctctggtcctggtttccactgaaaatgtaaactatggtccacgccacattctccagtactcctgtgctattgtgaaagtaaaagacaaaaatacacgtgcttggcagcccgagagcctgggtgagattattgagaataatgcggtggctctggcttaaaaaataaaagccggaggatctaccaccagctctgaacacacacccgtgacacaaactgactcatgtgcaattgcccattagtggcaggtcttgccatttttcgtttttttctgagtcgagatcagctgcggctggggagaacattagttctgtctgtcggctccatgagtaagcagaggaaagtctgactacagaggcatcttctcaaatgtccatgaaaggctgcaagcccgagagtaacgcccctgctgccctgagtggtccacgtggtgtccagagtgtgagaaagccacagagagcttttccacacggagccacttaaggcctgcctcagcctgagaacacttgggcagaaaaggacagcacggcttcctcctcctccaggccgggcctacaagcacccacagttccgacagagaaagtctcttcttaatggtacgcatgtgtcttactgtagctcccagttagtcccctaagcgtgaaccaccacccacccatgctgctcccctcccaccatctctccataaacaggacccaacgcagccaaaaactcatggtcatgtgaccttggcatcagcttgctcgttaggaaccgtgcctggaggtgctctgagcactgactgccaacctcagcagggccctttgtggtgttgaggtgtggtgtccgcagggcagcctgcagcctgctggggtccagcctggggcctcaggtcctgggaaccctggttgaggctgggctgcctcagtgcccctccgcagcctgctgcacccaagcactctgagaaaaggagcaatcacccaacttcagtctgaaaatgagaatgttgagaagggcatgatgaggggaagcagaccagagcccaccggcaagggtagaacgtcagccccgccctagtgggacagacaagagagaagcctcctcacaccaggaggcagtatagccggagccttccctccagggctctcaggagagcctgtgctggttcatgaaaaagtgaggcctctgggctttgctgctgcagagtgaggtcagagcccacaggccccacagatcatcctgcctgacaagcacaggaggcaccactgcttgaattcagagggcagctccgagggtcctaggtcccctgtgaatctccacagaatcctgggacctcagagcctgcatcagttggtcccccatgcagggacttagtgactctgcagccccagtcagggcctgctctgtgccaggcattgctctgcagacccaaagggactccaggccagtcctcatcctcagggcccacagtgtaacacagaggccgtgccgcaggctctgctcctctgccagcaagctgtgcagtcttgggcaggttacttcagtgctctggtctcagcttcctctgcaagtggtggcagggctgtgctggaggcatgagaggggtgtgggagctgcaggctctggcaggtggcacgctggggttcttggagaggggtgtgtggctgccaggggactactgctgtcattgccatctgcagagacaaacagaaacccaacacggcagccatcactggggccccttcatgggagggatagggtggaaattgcaggtcccagcaaggcctcaaagcaagtgcccagcctcccctgatcagtccaacctgaagccaggtcctggtgtgcacagagatgcacggctgggctgccccacctgcttgggccacaggaagcatttctctaaaggtgagcagcttcctctgcaggtgacacggcctccacccaaacccagaggctctggctctcccactgcggcttgccgcrgccccacacttgcctgctcccacactgacacctccaacaccacaggggctgctgggtcacgtggcccagatggcagggctgctcagacagtcattttctgctcctggccgcctcgaagctggcagcctccatgtcagccgagccgtgggtcagagcagtgcccccaggaattaaatatgttgccttcagaacccaaaaaggcctgtcaggccctgtgcttcctcctttgaagtaggggatgcaagatgtagcaatttctcttttactttagaggatgtcctggtatgaacctgatcactggtgccctaaaaacttccatgaagttaggtccctgaatcctcggagttcacctcccacccacagatgcaaatgtgtctcataaggcctctagctcatgaccctcctgttcctcctcctgcccattatgtcgtcactgtaatggatcagtgtggtgtccggtgcactgctcaggtgcccagatcttttcaggcaatattaggacagaggacagagttagcgtggccctgcactaaactgggaatgagtattgttgttcctcccatgtaaatgcaaactgtttccgatcctcttttctaattggaatagaaaagaatgcaatggccaatcactggcctcattaatctgctacgatgatacgtctgacacagcagatgcaactggagctactaccgggttcaggctaagtggtctggcgtcactttctaggatccatcagtctttgcaatgaccaggccagagaattagacacgacagtccaccaccctcgcctccgtgaggcctttaatggtggtgccatcctcccaggatgcaacgtgatttgtgatttactctcttggccatggaaaggggacttccccactatgatgtctgtcaccacacaggcctgggatccaatatatggctactccagccaccaagtacataaattataattacatactcagggggcagggaagcggccactggatggtcttctggcccaggggtctcactgtgcccaacactttagccaggattcctttttattacctggccccgtcagccccttctctaacagggaggccacagcgacacttttggcctccagtatcaaggtccactcacatcccgcgtccatttgtcctcaaaatctctggattttcccagcgtgcagccagctgagtgagtgacagcgggattctacagaacatccttgtcaaggtattgcctggtccttccttctggtgacctggccacctctgcaatcaatggttccagacaggaaattagctcaagtccaggaatggagtagggaaccacgatattttactggagtccccgcccttggcctctttcttccttcctctgccgtccgccagggcggcttggctcaacatgacccatcgctttctccaggcttctgggagccatcccagaatcatctttgacccacgacctgcagaacttgccaggtaactaatcctatgtgccaagcaagtgcctccgcctcaatagttcttctgtccccctggataaagcaccctggaaatctaataccgggggtgytccctggctcctgcaggcacatgctggctgcctcgtgcagttcctggacatgcaacctctctactccctggtcaggcctagcaggtccccatccaggttaccctggactttctccctagtcactgctggcagccaagagacaaggtggagcagcccccagtgagggcacctgctgctctggtaggggaggcccctggagcatcttccagcacagaggaagtgctggcttccaagggcaggaggggcccctctgcaagctctgaggggacaggggtctgcagggccatgccctcagggcttccacctggatgtctcagcccatgtttcagggtcccagattttcccaaccggggtccagaccttcacataggccagccgtggccaggcatcaaaacatgcctagagctaggtggtccccacagtcactgtcggctcctcagccatactggttctacctctgccaaacatgggactccttttcagcaaccagagaggccctttgttctcacaccaagcctgatgggcaaccgtgggtaacgtcgcaatctccattcatccctctgtggagcatcaaccccactccccccatgcactgaaagggggaaactgccacacccacaaggcctccccttccaccaggaaaacgtcccagatcactcttggtgaaaacatttaacaattggggccctaactttgtgccaaagactacccatatccccacatcaaccagaatggtgtcctcggtgttggccgggaaacggccaccgcaccagctgagtctcaggcccctcctgcaccacttgtgttaattggggtcttccaagaggcaggtgccatggaagctctgacgtgactggagatttatcagtgcaatgtctgtgaaggatgctgggggggtggccaaagaggacggaagcctcagaccacaggtgagacccctgtgaaggagatacggggagccttggccagcacgtgcccctagacagtgctggccaggccgagggagaacttctggagccaaggtaacccctaaaggattctggtcttgtgaggaggggcctggcttccccctgggagctgctggcttggaagcaggaggcattgcccaggtgagagttcggcatggacccaggggagtggcacacggtgcccgccgtcagctgtgctcaggagcagcaggcaggagccctggactcatggctaccatgtggctgccacactcaggcacacttaggcacatacactcacactcaggcacacttagacacacacatcacactcaacctcagacgcagacacacaccacacactcacagatgcacacacagtctcagacacagacacacaccacacacagatacacacaccacagactcaaactcagtctcagacacagacacacaccacacactcagatgcacacaccacacacactcagtctcagacacacacacacaccacatttgcaaacctgctcatcagaagagggacctcgcccccagccgctccgccaccttccaggacagctctgaagggagccctgtcccggagcccagggacctctccccaacccggctgcgcctcacctcaaggaggaaccccggccctggctgggggactgtgaccagggtggggagtggggaccccagacagagccctaccagggacccctgtcactctgtccccggctgggctcaggtggggacctcacggtggtcccagggcccagcaccaagcccacctgtggtttccagcgggaaaggggtggcaggggtggctcgccgcatgcccaggctctgccccaacctccgcgcccaggctctgctgtccctgccctcccggctccccaccctcaggccccaggagcagcagtttctgcaggagctcctgacccggggcctctcgcgggaggcctgagcaagccggacacaggacacggggtaggggaggggtggggcggctgatggggggaaccctgcaccccccagggcagctgctaccaaggggcgagtcccagggcccccgtcggccctgcgtgcggggcgcggtccccaacacccagggccccggaggcggacacagccccagccaggtcgtccgggaaatggggcgggggcgacgggcggccgggcccgggacgcgaagtccgagcagcagcgggcaggggctggcgggggagctcggcccgggctgcaggggggtccccaccctctccacctcctccagcctcccgccctcgagggtccccgcttccctcccatccccctcccgtgcccccggccccctcctcccatccgcggggccgcagcgcttcctggcggcggggcgggtcaggccggcggggcggggtataaagggggcggcgccggccgcggttccctccctgctgcttactcggcgcccgcgcctcgggccgtcgggagcggagcctcctcgggaccaggtgagcgcctcccggaccccgcaccctggaagccgctcggcccgcggggggtgaccccgagtcctgggaaggcggcggcggcggctccgtccctcgggyccccgggaagggggactccagccccagggacggcggggggctcggcgggttcggggctcctcctcgcggggctggggccgcgcctgcccctgtggctccgcgtctctgggtccgaccctcgggcgcgcgacttggggccacctccccgcggcctcctctggggcggagccggcctgggcggggtgggggggtccctgtctgcgcccgagctcggtgctgggacccccgctcccgagacgaccccggcaccgcacgccccgccaggccccgcgtctgcgagcggttcgggtccggctccggcccgcggggaagacgccccggctggctgggacctccgggggcgcagggcctctccccgggccggacggaaggggcggcggggcggggggaggaggggctttcggtgcccgagggcgggactgggcggggaggggacgcgggtggccccgacgccccatcgctgcgcccctcccggcctggagcccaccagggccccgccaggcccaggagaagctgcagacggaggcggctccccagggcggcgggacccgggctgacagcgacccgcagcccctgccgggccgcccacacccgccctgggactccgccggggcgctggtggaaccgctgggcctgggtctccactgctggcaaccgaacggatcggccctctgtggagccgcaggtgtgcgggcgagcggcgcccatccgggctgtgccagcagaaccccggtgcccgcgcctaggacgcccctggagaagggaccttccctttggggtcggaacccagaaaggaggggcctgcgatccgcggagctccttgttcttgggataacacagctctggcttggaggcccccttgcacttcgactctggtgattatttcaagaaaggccagaccgggcacggtggctcacgcctgtaatcccaacacttggggaggccgaggcgggcagatcacctgaggtcaggagttcgagaccagcctggccaacagggtgaaaccccgtctctactaaaaatacaaaaaaaaattagccgggcgtggtggcaggcacctgtaatcccagctaatcgggaggctgaggcaggagaaaatcacttgaacctgggaggcggaggctgcagtgagctgagatcgcgccactgcactccagcctgggtgagggagcgagactgtctcaaaaaaaaaaaaaaaaaaaaaaaaaaaggaaagaaaggcccggtgagatgctttctcttaaacacggccctgcacgttgagttgctgcctcctgtggcctatttcacgtttatgcaaagtcgggcgcctgatgcggggctcacccgccacaagcaggggtcctggcgctgctcatggaaggggccctacccagcccgcggggcactggctgggacggggctgcccaggtccgcccaggatccaaacacccagccccgcccagcggcccttcctggcctgcagtggaggctgtaatgggcaggggtggtgggaatcccagctcacagggcgcctgctcttagaagggcggcatctgggtccagaggtcagaaacgtcagatgcccatcccagaagtggcggggaacctgtctccacaatggatagcagcactgtctttttttttttttttttttttttctcatttcatagataaggaatgatgccttgttggggggtttgttctgcatgtctttggtttttgtgcagtacaaggctatttgggctgtttgatcactgaccgtgtgtagtgatgtgcattgcctggttgtgatgtccccatgttcctaatggatgttcgctttttgggtttttttggttttttgtttgtttgtttgttttttgagacagggtcttgctctgtcacccaggctggagtgtggtggtgctatcactgctcactgcaatctgcacatccctggctcaagcgagcctccacctcagcctccgagtagcggggactacaggcatgcaccactgtgcccagctaattttcttttaagagacggggtctcactatgttgcccaggccatggatgtgtttgtttgtttgtttgtttggggtgtttgggggtttttttctttttttattgatttgaaaaagctttattttcccgaattttttattgtggtatacaatataaaatgtactgtcttaaccatttttaagtgtgcagctagttcagcgacagtaagtacattcatagtgttgtgtagccatcaccaaggtccatctccagaactcttttcctcttgtcaaactgaagcccatggagcaccaactcgcatcaccccttccctcccctggcagccaccatcctactttatgtttccaggaatttggccatttaggtgactcatatgagtgaaatcgtatgaaatgtctccttttgtgactggcttatttcacgtggcttaaatgtcctccagattgatccacactgtaacgtatgtcagcattcccttcctttgtaaggctgagcagtattccactgcatgcatgccctgcattttgtttacccattcgtctgttgctggacacttgtgttgcttccacgtttgagctactgtgaatgatgtggccatgaacacaccacacagatacctcttggagatcccactttcacttcttttgagtatgttcccagaagtggaaatgtggatcatttgattttttcatttttttgagaattaattgcctcactgtttcccacggtggctgcaccattttgctttcctgccaacagtgcacaagggtccagtttctccacatctgcaccaacaggtgtcattttccgggttcgcttggttttttttaaatgttaaccatcctaatgggtgtgaggtggtatctcactgtggttttgacttgcatttccctcatgattagtgacgttgagcatcttttcatgtgcttgttggccatttatatatctcttgggagaaatatctgtttaagtccttgacctatttttgaatcaagttgattgttttttgttgttgaattttaggagttctctgtatattctggatattaatcccttattagatacacagtttacagatattttctctcattctctgggttctttttactctgttaatgatgtcctttcactagatagatgcaaaaaatgtttttaaattttggtgtaatctgatttatctattttttcttattgtcatacccaagaaatcattgctcagtcccatgtcacgaaggtgttaccttatgttttcttctaagggttttaaagttttaggtcttaaaacgtaaagatccattttgagttaatttttgtatatggtattaggtaagggtctaacttcattcttttgcatgtggatatctagttgtctctgcaccgtttgttgaaaagactgtctttatcgaatggtcttgacggcttgattgaaagtcatatatgcaagggtttctttctggactctctgttttattctgttggtctgtatgtctgtctttatgccagtgccacactgttgatgactgcagctttgtagtaagttttgaaattaggacatgtgagtcccccagctttgttcttatctttcacgattttttttttttttttttggctattcgaggtcccttgagattccatctaaattttaggatttattcactatttctgaaaaaaaaaacaatcactgggatttttatagggattacattaaacctcgagatcaatttgggtggtattgacatcttaatatagtaagtcttccaatctatgaacatgaatgtctttttttaaatgtcctcttcaatttctttcagaaatgttttgtagttctcattgtacaggtctttcacctcctaagtcaatttttaagtattttattatttttgatactatagtaaatagaattgttttcttaatttcctttggattgttcattgttagtgaatagaaatacaastgatttttatgtgtttactatgtattctgctattttgctgaatttgtttattagttgtaacagtttttgtggaatttttagggttttctacatacaagatcatatcatcagtgatcagagataatttacttatttctttccaatttgaatgcctttaatttctttttcttgcccaattgctctggccagaacttccagtacagtgttaaatagaagtagtgaaagcaggcatccttcctttatttctgaccttagaggaaaagctttcagtctttcaccactgagtatgatgttcactgtggctttttcgtataatatggcttttattatgttaaggttgtttccttctattcctaatttgttgagtgtttttatcatgaaagggtattgaattttgtcatatggtttctctgcatcaactgcaatgatcatgtgtgagttttttttcctccttcattctgttaatgtgtattacattgattgattttttttttttttgtatgttgaactatccttgcactccagaaataaatcctacttggtcaattcattaaattccatttaattgcatcaaattataccaaatttagtttactattaatagtattttgtttaggatttttgcatcaatgttcataaggaagactggattgtagttttcttytcttgcaatatctttgtctggtattggtatcagagtaatgctggcctcgtaagaatgagttaaatagtgttcccttctcttcaagttttttgaaaattttgggagggtttggtgttagttctttatgtgtttggtagaattcaccagtgcagccatcaggtccagaggttgtttgtcaggagatttttgagtattgattcaatctccttactagttatgtctattcagattttctatttcttcatgatttgattttgtcttgataggttttgtctgtctggaaatttttccattccatctgtgttattcaaattgttgacatatagttgcttatagtacactcttataatcttttttatttctgtagaattagtagcaatgttgccactttcacttataattttagtaatttgagtttcttctttttttcttagtctagaatctagcttaaggctggtcaattctgttatcttttcaaagaaccaacttttgttgtcattgattttctctattatctgtctgttctccattttgtttatctttgctctgatctttattttttccttctttctgctagcttgttctttttctagttccttacattgtaaggttaagctsctatttgagacctgtcttttttaatataagcatgtatagccatcagtttcccccttagcactgctttcactgtcgaacaagtttttaaatttgtgttttcattttcactcatctctaagtattttataatttcccttgtgatttcttctctgatccttggttatttaacagggtgttgtttaatttcgtgattttttaaatgtccttgttgctgatttttaactttactcctttgtggtctgaaaagatatcttgtatgatgtagatctttcaaaatctattgacacagactttgttgttgcaactaaccccgtcattgcaagcccttctccgtctggttgaagtgacttccaggagatttaaagggctggcacccttttctcccttcatttttctctttttcctcttttgagasgtagacattgaagactagcacattcaaaagcaaccatatatgtggagaaaataaaaaagtcattgcacatgctcaggggaagtcacgggcttagaaaagacctaagaagaccttaagtttatactttatgctgatccttagcacagagacagcaacaatcaaaattataaaaacaagaaaaaccagcaaactctggggaagaaagagattttgatttcacaaggcatacaaagaaactttcctatttcaaaggaaaaaaaaacaacagaaactgtcactgaaaaagacttggtggtagatctactagacaaaggctttgaaagaactatcttaaagatactcaaataactaagggaaaatgtggagaaagtgaaagaaaatgtaggaacaaatgaaaatatcaataaaaagctagaaattttaaaaagaaaccaaagggaaattctggagctgaaaagtacaataactgaaatttaaaattcactagagaaatgcaaaggcagatttcagcaggcagaataaagaatcagggaacttgaagatacaamaatggaaattattgagtctgaggagcagaaataaaaagattgaataaaggtgatcagagcctaaggggtctgtgggataccatcaagcaaaccaacataaacattgtaggagccccagaagaagagagagcaaagggagcagagagactatttgaagaaataatggctgaaaacttctaaaatatgatgaatgacatgaatataaccatccaagaagcccaaaaagctccaagcaggatgaactcaaagagacccacactgaaacattctaatcaaattgtcaaaacccaaagacaaagattttgaaaacagcaagaaagaatgattcatcacatgtaaggaatcctcaataaaactattagcagatttctgatcagaaactttgaaggccacaaggcagtgggccaatatatccaaagtgctaaaagaataaaaactgtctaccaagaagcccacatccagcaaaactgtcctttaaaagtaagggagaaattaacacattcttagatcaacaaaagctgagaatgttccttaccactagacctgccctataggaaacgccaaagggagtcctgygggttgaaataaagggtgatagacagtaattcaagtgaagaagtaaagatctcagccaggcatagtggctcatgcttgtaaccccatcactttgggaggccgaggcaggaggataacttgagcccaggagttcaagaccagcctgagcaatatagggagaccctatctctataaaataaaaatatttttaaaaatcgaccaagcatggtggtgcacacctgtggtcccaactactggggaggctgaggtgggagaatcatttgggcctgggaggttgaagctgcagtgagctgtcaccacaccactgcactccagcctgggcaacagagcaagaccttatctcaaaataaataaataaataaatatctcagtaaaggtaaatatatagacaattataaaagctaatattgctgtaacaatggtgtgtaatgctgctttttgttttctacataatttaagagactgatttaaaaataacattatgcttttggacacataatatataaaggtgtaattttgtgacatcaataactaaaagggttggggacagagccattcagggagcagagttttgtttatgccattgaagctaaactggtataaattcagtgtagactgttataattttaggatgttaaaatgcaatccccatggtaacaacaaagaaaataactaaagaataaatacaaaagggaatgaggaagggatttaaatgtttcaccatcaaaaaaattaattaaacacaagacagtgatactggaaattaaggacaaaaaaatccataaggtatacagaaaaaaaatgcaaaatgaaagaagtccctctttatcagtaattactttagatgtaaatggattaaactctccaaactctctctgttaaaagacagagattggcagaatggatttagaaagccaaatccaactatatgctctctacaagagatgcactttagatccagaaacataaatagattgacagtgaaaggatgggcaatgacatgccacacaaatagtaaccaaaagagagcaagagtggctatactaataccagacaagataggctttaaatcaaaaaaggttacaagagggaaagaaggacatcatatattaataaaaggctcaatacagcaagatataataattataaatatttatgcacctaataacagtccatcaaaatatttatatcttacactgggaagattgttgctggctctcagtctgcttccagtctgctcatattgcttttgttgtaatgatggtcatatgtgggagctcagtrtcaagagggcagacttgagcccacactgccaggcttcagacctcagctattagctgagtgccctgggcaagttacctcactgggccttggtttcctcatctgttggagtggggatggtaatagtacctatgtccaaggccataagtccaattgtgaatgttgaatgaagggatataggacagtatctggtacacaattattatagatttttcattgacattttatacattctgttttcttcaaagactttttggttcctgttttgcactcagatacttccttttcctggagtttatttgggagcaccatgtgaggtagtacctttatttctagtcacagggtgagccctcatcccagcctgcttccaccactctgaaaggccaccatgtcatagcctaagttctcgtgtgttgttatgcccatggttgtgtggagtgttggcctgttccagcaccaaaaccaaaactgtaattttatcrtttcatttgatagcacaagctttctcatcactctattttttattttgctcaactcttcttgctttttctaccaagtaaaacttggattcattttgcaaactcctatctacaaaaatgcaaaaaattttcttggaaactttaattaaaattgcattctattatagattcagttaggaataactgatatttttaaatcagtttaagatagtgggatgatttcttatccaaaaacaaggtttgtctttccaatatatttctcaaaaatttttttgagtttttttcataagtcctgcacatttttattcagttgattccttgggtttatgttgtttttcttamtagtgtaaatagcatttttctgcaacattttctaactggttgttagaaaatgtttcttctaactgatagaagaaaatcaataactttttgtatgttgaggactaagctctgatttttttatcttgcctatattsttatctaaggggtctrgggagtcatgccctacaaaccataaattctcatcagatggttttatctaaccctatatgcygtgacttactttccatctgactctggcatgacactacacgaccaagaagaaaataaaaatattttaccccaaaacatgtttctttgccacattttgaaatggccctgcaaagctgtcctttactggggaaaatttgcatctgtaaggaatctctgttaacatagctagctctttttcttccaggccctcccaattctgaagagattaaccgagagtctagcagcttttaaaggtctcartaggaaacacttgtcattgattgtctctaagggcagccactatgagacttcagaagaaccttggtctccacagtcttttatcttaacctgagcatttcctttctatgatcccaggtctttagacaaactcaaccaattgtcaaccagaaaatgtttaaatttacctgtagcctggaagccatctctccccgctttgaattttcctgcctttctggattaaaccaatgtatttcttaaatgtatttgattgatgtctcatgcctccctaaaatgaataaaaccgagctgcaccccagccaccttgggtacatgttctcaggacctcctaagggctgtgtcatgggtcatggccactcatatttggctcagaataaatctcttaaaatattttacagagtttgactcttttcatcaatgatatatttttctaagtggctcactaaattttctctccctaatctcccctcctttctctttctttctctctttctctctgtctatatatatatatatttttttttctcttttttaaaaaaactttgttcagatgattttctgggtagacaatcctatctttaataaggacagttttgtctcttcttttccaacagttatacttttatttttactgtcttattgcattggcttccaacacaacactgaatggtagcgtaagatctgcactgtttgcccccaccccattttttttgtactgtagtaagcattcttctaatgcaggattttttaacccagggttagatctacgaatggaatccctgaattcctggacatgatttctgtatatgagcatctatgcatttgtgtaaggtgaaattgtgtagactcttaaaagggtccatgaccacaaagataagaaccactattttagctttttgtgtaaaatatgatgtgagctcttgatttgaaatgtatatcctttatagagttaattctactcctaaatttcttactaggttttaccttgtctggctgttgttgtttcttagttagaaattgatgtttcagggatctattgaagcaattgcatattttttcccattttatgttaatgtgacttacattaatgtattccctagtgtttgtggcaacactgtactttaacttcatattatagttctggtatagtggtccttaatatgctattggattttagtttttaatattggctagaatttttgtgataatgttatgggatttttagggtgtcacttttctggcctgaaacctctatggccagtggcgcctttgcccaagttcttgtcctgtgtccaggaagaatgaggtacacagacaagtggagggtgtgcaagacagagaagctttattgagtgttaggggagctcacaggagacccgcagggggcagcccctctctgtaggcrggttgtcttgtcggcgggttgtcttgtcaaatgttcagctctcagcagagagaaggccctggagtgggtggctcctctctgcaggcaggtcatcccattgtctctgcagctcttagcagagaggaggccctcgagagcgtgtctcctctctgcaaacagggcatctcaactagtgttcagctctcagcagagagaaagccctggagagggtagctcctctctgcagctggtcgtcctgacatcccttcaggtcctgaagctctcagcagagagagcacctcctctctgcagctggtcgtgccatgctctgccctgctctgactgagcctggggcttttaaaggcctcagagaggggaagtgcatgctgattggtccatgtgcagccatgtgcaggcccagaagaaagcaccttgagttcccctctggtccgtaggacgggcaacccggcccccaggcttcaggcctgccccagcctgaaggtggggcttcactggggacccatcctcttctgcccaggagcctatctgcctcctgcagccatccatggtgcccaggctgctggtaccaaggggcaccggtgcccagccaccctcagcacccccccaagcctcccctcctgcacttctcagtgcccacagtttggagggggccaagtcagcagggggctggcatgtcagcactgccacaagcatgcacccacccggccaggctgtgacagtgcccaggctcagccccaactctgctctgagattggagtgggtggtgggagcgggaagaagctgggcagcgggaacaggcacctccaggcctacaagggaaagaggggccttccctggctccccaagagtgcagcgatgcctgggtcagcagccccagttggggcagctgaaactgcaccaggagtgggggctggctcctgcctcctccatggagcagaaggcccagatccacagccacgacttgggcagttgtacctggggaactctcacctcgccaaactgcaaggggcagggatcccacttatccccggctcctgctggctccgtggagcatggtacctggccatgtcctctcgcagcctggggcagggtctccagacctgggccagcatcccagacaggggcaacaccgccgtgagctccccttcacccagcacaccacccggcccggccccatggcagcggcccccagggaggcagtctgcggggttgggggcctgtctgcctcttccatgggccctccctgagcagccagtgtgatggcagcggccacaccagatgggctgccgctgccatcagtaatatttatagtgatatttatctgtagagttacttttagggacttttttttttatcaagctttggtcacaggttatgcmacatttaaaaatgaattgggaaaaagtttatctttttatgttctaaaacaagttaaatagcatgaagtgcttgtccttgaagctgtgaaactcacccacaaactgcctgagctggcacctttgggaacggacttcattcctccctgggccccaggctgagcaggtctggcctgggtcacctcatccactccagacgccgcaaaatcacagcaacccttcagggccctctcctggcagcgcctcccctagtcccggtgcttggacactcctcccatctgcaccgaggagagggcggcactccaatccctgcatyacccctggaactgcacgctctgaaccaggcccggtgccctttctgcccagctgcccggctgctgccagccccactctgcggagccagcagcacagtgaggcccgtcctgatggcctccagctccactctgcggagtcagcrgcacagtgaggcccgtcctgatggcctcctggagctggagcttaggccaagccacagggcatcagggaggatggacgttcaagggctggatctgtttgccccagggtcctggcacccaacagaaaggaaagccaggctaatgacggctgtgtccctacacttgacagagtcctccctccctccttatcaaagtcctgtttaaagggaatggagccaggctggagagagagtgcctagctctgcaggggagccggtctggggaagctgggatctctctcccgccctcccctctgcactgcttccagggcagccccaggcagtggggggcgccagacagtggtgctccattcccttccatggccgacgcgcccagctacccacttccacccagccctgnnnnnnnnnnnnnnnnnnnnaacaagttaaatagcatgaagtgcttgtccttgaagctgtgaaactcacccacaaactgcctgagctggcacctttgggaacggacttcattcctccctgggccccaggctgagcaggtctggcctgggtcacctcatccactccagacgccgcaaaatcacagcaacccttcagggccctctcctggcagcgcctcccctagtcccggtgcttggacactcctcccatctgcaccgaggagagggcggcactccaatccctgcattacccctggaactgcacgctctgaaccaggcccggtgccctttctgcccagctgcccggctgctgccagccccactctgcggagccagcagcacagtgaggcccgtcctgatggcctcctggagctggagcttaggccaagccacagggcatcagggaggatggacgttcaagggctggatctgtttgccccagggtcctggcacccaacagaaaggaaagccaggctaatgacggctgtgtccctacacttgacagagtcctccctccctccttatcaaagtcctgtttaaagggaatggagccaggctggagagagagtgcctagctctgcaggggagccggtctggggaagctgggatctctctcccgccctcccctctgcactgyttccagggcagccccaggcagtggggggcrccagacagtggtgctccattcccttccatgccgacgcgcccagctacccactccacccagccctggaggacatggaagggcctcaaccatccaaatcccamccaaaactgagcccagaggcacccactaaacatctgtgaccccacccagggtggggcaagagggcgcaagccccccagtccagatgctggtgayggtgtgtgctgggcrcagaccccgcttccttgaagactgasggcagtgcccccaatccyrctgacctgctgtgcgtgcgcctgccatgggggagggtgccaggggagaggcactgggggtgtctgagcgacccccacccctgttgcaggacttcagggccacaggtgctgccaagatgctccagggcacctgctccgtgctcctgctctggggaatcctgggggccatccaggcccagcagcaggaggtcatctcgccggacactaccgagagaaacaacaactgcccaggtgccaggggtcgggggccgggggctctgggcatttggggggcagttgggaccagtacccaggtgccaggggtcgggggccgggggctctgggcatttggggggcagttgggaccagtacccaggtgccaggggtcgggggccgggggctctgggcatttggggggcagttgggaccagtacccaggtgccaggggttgggggccgggggctctggcattcgggggcagtgaggtcaaacccacaaacaggcacggggccaggaaacggggctccaacagcagtccctcctraggctggctcgtgacaggtcctgtgccccacagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctayggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgccygactccaccgagatcraccaggacaccatcaaccgcatcatcaaggtcatggtgagccgygggcgggagcaccgtccacrcgccaggggtggccayggtgggcygtccacccrctccgggcctcactttacccctctgtgagtgcggaggccgaaggaggaagctccgggcagggcctgggccactcaggtgtccctccatccccacccagactcgaggtgcagccgccccaggtctcgaggcacacggctaaccagcatgtctgtcttttctgcagaaacacgaagcctacggagaggtgagtggcgcttcccttcctgccagtgctggccggcagctgacccagcagagatgaccgcgccaggctgccgactcctggcgcctccaggctggaacagatgagaggagagggagtcacctgctccatgttggacctgaggccttggagtctggagaaagggctcccagccaaagctaggctgtttagatcccgtgagggtcagcgttagggtcacccacagagcacgtgttacaaggagaggtcgagggtctggcctccgggcaggtgggatccatccaccctggactcgaggcccgagcccagcccagcaggtcaggggagaaggaactgacatcatcggggtccatgacatccccacctccctgtgtgtcccagctccagctctcaggaaggggagcaggcatctgagatctcccccgtgaggcttcctgcaaaaacgtgccctgcctcagaatcgctgctcagtaacagtggtttcattgccrtgtacaaatggtgcctccctcaccagtgccccttgctcttccatccttttgtaaaatttattcttttatatttgtttttttagagacagggtctttctctgtcacctaggctggagtgcagtggtacgatcacggctcactgcagccttgaactctgaggctcaagccatcctcccacctcagcctcccaagtagctgggactacaggcacctgccaccatacctggtgtgcgcatgtagttccagctacttgggaggctgaggtgggaggatcgctttcgtattgtttttttgtagagatgggatctcactatgttgcccagcctggtctctaactcctggcctcaagcagtcctccctgcctcggcctaccaaaatgttgggattccaggcgtgagctgcacccggcctttcttcccttctattttctgtcatggcttaagccaggcttggttttttaaacttgcctagaacacctgaccgagagccaaactctttggcttgtccctgatgggggcagagcctcacagcaccccatgtctcacagctccctcacgcccgcccaggttctcagggcatttcagcatctccttggcccctgctgagagtcgtgggctacacgttctgagaccctgccctgccacctgaggaatgtcccacccatgcaaccttctgtctctgcttcctcgtttcagtgctacaaggtgagctgcctggaaatccctgggccctctggccccaagggctaccgtggacagaaggtaagatgcccagattacctgcagggtctgcgctaccaggaagcccctgatttgttttgaaatccacacttggccgggcgtggtggctcatacctgtaatcccagcactttgggaggccgaggcgggcggatcacaacgtcaggagatcgagaccatcctggctaacatggtgaaaccctgtctctactaaaaatacaaaaattagccgggcgtagtggcatgcgcctgtagtcccagctactcgggaggctgaggcaggagaatcgcttgaacctgggaagcggaggttgcagtgagcagagatcacgccactgcactccagcctgggcaacagagtaagactctgtctcaaaaaaaaaaaaaaaagaaaagaaagccacatttaaggccagctgtatctcaaattgtctcaacacttctgtccctggagaaactaaaactctatatgtctaattccttttaaatagtatattgagaaaagcagaagcttgtaaaaaatgagatatgccattaaaatactttggtaagcaagcatattcaagtaagtaaaatgtgagatgcactacacttaataatatgattgctcattaatatgaaggaacctcttttgtggcttactaaataagcagttttagggagcctggtttgaatgtcccctgcattttctggtttgaacatcccctgcattttcctaacagaggtgcatcaaataaagtccttccaaaactcactaacagagtatgtgaaactccaacaattcacatctgttaaaaattataaagaaaagcataggaggagaaagtagcttctaaggagatgaaataaggaattgaccatcatagaggatgttactgctacgtagcttcgtgtttttctaaatttggataacagctgtctagaccagtaggtatctggatgtactttctccaggatgagacatctcgaggctgcaggtcaaatcctgccatctccctccctggcttctccagtcctggtggcaatgccgaccctactacagctgggaatgaatttgccacttggggcagccttggctgcacacagcagtgcagtgacccgttctgttgggggggccactggaagctgccacagggatcactgtggttagagtttgaggggtggcaaggtgccaagcggagcccaggacagggcacagctgtgatgttccagaagcctctgcccacctcatcccctgccctgagtttcctcccttttcttccttttgacctcttaattcttccyctttcctctgctcctctttgcacttaaattgggagcatatcaataaatagatgaatttatttaataaagttctgtatcataggttaaaattttaattccaagagagtgtaacctttatgtggtgttctgaagtcctgatctgtctaaagttacttagataaaggaattaatctttgtagtgacggtgacccaggcatcgctggagaatcagagcccagtgttggccacagtcacagctactgggtgcagaagggacccccacgggccaggcacccccaccccaggggkctcttctggctccattttgcaggtggctttgtgggaagcttccctcagagctgggagaaatgggtcaaagcaaacccttgtctgacagaggctggccctttggggagcagctgacaccaagacttctccacttgggcaggggaatcagtaacctctgctgtgtcacctctcagaggagctgtggcagggtccccagctgcctaccgcccaccctaccctrcctcgatgtactcttttctctgcttttagggtgccaagggcaacatgggtgagccgggaragcctggccagaagggaagacaggtgagtgtccttgccccacgcccgccccgcctgcagcccagcgccccagggctgggctcacactgctgcgttgtccttcacagggagacccgggcatcgaaggccccattggattcccaggacccaaggtgagtgacctcggccaggggcttggctccaccctgaggccccagcactgccaggcaggctccccccagcccagcctcggcctcagcctctacgaccctccccccagttaccaaggaacagaagcacctcgataacttgatggccgtcccaaaacccagcctccagcccgacccagggctcagcctcctccgcagactrtttgtcgagaacaytagatgccagcggcccaccgagcactccyctcagcctgcagggctggcccttccctgcctgtgtctctgcagagctcctcactaatgcccctctctcctcctgcccccagggcgttcctggcttcaaaggagagaaggtgaggctcttgccctgacagacctcagacctgcgccagcctcggcccagacccacctcttggcgtccgccgcagcctgtcactgctcctggggcaccggcctggtcttttctcagtggtggctttgggggctcctggggggtcctgtggccttgagtttggcccaagggctttgccccccagaggcagcagtgcccatgatgctttgaggcaccgagctcactgcgcyggctttcctcctacacagggtgaatttggagccgacggtcgcaaggtaggctggctgggtaggcagagcccctccttcctgctgctcagggcagaaggaccggggctaatggagttccctcttccttctctcttcagggggcccctggcctggctggcaagaacgggaccgatggacagaaggtagagggagcctcgggctcacagctggactggtctcacagaggcatcccagcctctgcagggcccccagatccagcctgatctgtcagcttacacatgtgtacacacgcatacacacacacacacacacacacacacacacacacgaacttcagctcctgccacatcccactgccccacccagggcttcaccagcctgcatctaattcatggctgcacatcccggcttggggcagctccacagctgcacacagaggccagcaacaagcctacccactcccaggtcaaaccacaggacagccccacccactccttccatggctccccgtgggaacatcctctgtgcccagggagctctgccctcagggcctctgggaggcagccagggatggcctgttcctgcacaacggccactctgcctccccggagacagctccacagcagccgtggcctcatgtgggcacccgtgtgccaggaggagagcgctgcagccctgcggggcagaaccgggtgggctgtgtcttggtcgttggcacacatggaccccagaaccccgccctgagactcctcctgcccccttctccttcagggcaagctggggcgcatcggacctcctggctgcaagggagaccctggaaaccgggtaagggccgtttgcacccctccttcagcctcggcccagggggtgtgggtgcctgaccgggtgggagggtagttgctgctgcagtgggagcrtgggttctcccggcagcccagcagccccagcccagcagccccagcccagcattctgccgggtcggagtcatgtgaggaactccccctgggagctcctggcrgatccccgtggcctggagacctgatgcatcccaaacttcggtgtcactggacagctccatttccctgagcagcagatccaggcctggcctcttggtcactgagcctggggcctcacagtgagggtgggaggtgcgtcccgggctgggacaatggagcacttgggccctggctcatggggagaaccccacccgccgtgtgccgagctccacctctcactcctctctcagggccccgacggttacccgggggaagcagggagtccaggggagcgaggagaccaaggcggcaaggtaagtggccttgtcagggtayggggcaggcrgggtcaccagcttccaggggcctcctggaggcagccccagctgagaagctgagcagagaggrcctttctggaaacactggtcagtgaggagccaatggccgtgggatgtggtggagggtgccctgcccgttgcttcatcagcttctaaccagggcttgggcggccccrccgctgctcaccgaggcctcagcaacaaacccacctcctcccaggtggagccccagggagccccacccacacctcctggagctccccatgggaacgttggtgccccaggggctctgccctcctgggccgcctgcagtgtcgccccgcccctggcggccccaggatccccaagggcttttttctgggagcttggacttarggcttcccactttctgtccaccttccctcagcccaagcccaagtctggctgagtcctctgwgcagatgcacaggyrtcctgcccgtgacacacactctgccctcagctggcacggaggttccagcagcccccagccagcatctggcatcccaggtgccccgtggacatcagggaggtgcagtcccaagcccgaccgtgggtcctgcccccgcagcgggcatcstgcaccccccttcccctgccaaaagacgtgaggctgattctgcaaacccttccagggggaccctggccgcccaggacgcagagggcccccgggagaaatcggggccaagggaagcaaggtgagcccctctgcctcttcgcctgcagctgagctggccacactcacgcccatggcccagatgaacagtcacgctggccaccatctctgctgtcaccatgktgccgcattgggctctggggacacggggagggacaggaagaacaggccatgtgccctgagccaccagcccctctgacctgtgccctcctcacgaggctgaacaagttccaggggaccctgcagggcccccatgtgcctggcaagcagattccgctggaagataataggggctccacaccacacaccgcacaggcgtgaccatgcctcagggcccctgcctctgggtgactgtgctgtcctctccttcttcaggggtatcaaggcaacartggagccccaggaagtcctggtgtgaaaggagccaagggcgggcctgggccccgyggacccaaaggcgagccggtgagtccctcctgcccctgcctcagggcccygctctgggcatcctccttgcagcttgaggaggaccatgggggaagggcacctgggctgtaggcaggatcccctgctggcaaggcacagccaggcccccatcctcccaagaagtggacccggaccaccccacgggaccccccagagctggacttagaggtaaagcccaggcaggtcctccatggtgttccctaaacccagcaccagctgcccagggcatcctgtgagggctgagcagggcccgtcccagtgctgaccactccaaggggactctgtctgagcatggggcctgcctgggagtgaccgcagtgactggacagcaccaggtccccaccaggccccagcccatcacctaaaacgccactcaccagacatccaactccacctggagcctccccagatcattcctaaatcctcggcatgggcgggaccgacgcagcagagggacgagggctggcagcagagccactggcgcaggctgaggctgttgggaaggagcctggggatcgaggtcccaggtcccaaagccagagccctcctgtagagaaggagcatcggccccggcacagcccccaccctccacaggctctgggcttggactcagccccctccctcacccacacgcctgttctctgcaggggcgcaggggagaccccggcaccaagggcagcccaggcagcgatggccccaagggggagaaggtgagtcctcgtgtggaggcagcccrgggtctcactgtggtgcccatgggccctgctgacgagggccccaaccccattcctcccagagaacaacagaaccccagggcctcactctccagmgttcactctctgcagagtctgggaatgcagccctgagatccccacaccccattctctgctgaggaagctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtgatgctgaagggctgtgtggtaaaaccccggccaccagctccccttgacatcaggtgaaggggcttcctcccaggaagtggaygaggtcctacccatgtgtgggtggcctcagggggaccgagagaccccgtgctcagagcggcagctacaggcaccgggaaggagctatgggtgaaacaggcgactgttgcaggtcccccgggacagacggggttcttcctcccaggcccccttccccaacccccggccacacccgcctctcacatgggacccaggccggaggcctcagctgagacccgtggggcctcccttccctycccacagggggaccctggccctgaggggccccgcggcctggctggagaggttggcaacaaaggagccaaggtaggggagcagggtgggccgcaccccaaggtaggggatctgagggggtgcaggggggctgcaccccaaggtagggtggccrggactgcaccccaaggtaggggacccgggtgggtgctgcaccccaaggtaaggggggcccaggtgagggctatacctcaaggtaggggacccaggcgggtgctgcaccccaaggtaagggaccaaggcaagggctgcaccccaaagtagggracccaggtgagggctgcaacccaagatagggktgcttaggcaggggctacacccagaacccagcctactccactcagtgtgctcagggctgaaggtcaagtggagccacagcctccsgggagggtcataggggccggggccagaccygtcttacccccgaggccctgcagtgtccacaggattgatactggggactccagggtgctgctgtcagtcaagagaaccccaaattcctcccctttcttccagggagaccgaggcttgcctggacccagaggcccccagggagctcttggggagcccggaaagcaggtcagtgtcagtgcaggaggccggtgccctctgaccccacgggtgggtctcccctatccatgtggggacagcctggagctagccactgtccccatagcaaacccaggcagcagagcctggcctcagaagccaggacctgctcccctagaccccgagtacctcatacccaccctcagccccagccccccatcctgccctgaaggacccaggttgtggagtcaggggcaaggcagtgggcctgaggtcctggatgggycacagggaraggaggagctgggaccctcaagacagaggtccacggcccccacaggcagcaggaggagctgcggccatgtggcctggtggtcagggctggacggggcatgtcaggtgacccctgggcatggccagtccctgcctgtgctgacttctgaatttctctcctgccctcagggatctcrgggagaccccggtgatgcaggaccccgtggagactcaggacagccaggccccaaggtacgtgcccctcccccagcrggacgtattaggggttcggggcagctgcctgaggagcaggacagggggccggcctgggggaccctgttgccggcagacgtgcctcaggacgggcctgtgcctcctgttctcagctctggagtgaggggatgcctccggggtccaggaagcccccctggctctcctcttcagcagtgacccttgggtgtgcrtggcacatccttcctgaggcagggcctgagggcagctacgtggcctgagtagggtcctccccgcgtgtgggcaggcttcgggtctctaggcacgtccagcccccactggaggtggacagggcgaggttggccctgccaggcctctgctcacagccagaactcgacggcacccctagcccacttccaccccagtgtgcaccttgcgccctgttgagcacagccccccagccccaccccgtccyatgaccatgctgaccgactcaacgtcctcctccagggagaccccggcaggcctggattcagctacccaggaccccgaggagcacccgtgagtcacagcctgggatggcagctcccaggagtgggtggacattgtcccaagggccctgaagattcctagtagttccctcaaggcctcctctgtgcagaagaaagtgtgaggtccctcctgcgggacagagtggtgagaaggcttygggtgactcagtgaaggataggtccagcccagcatcaggaaaagagcacagctcagaacgcagcacagtggcctcacccagagtgtgaatgagcgagggagggaaacggggctgcagaaagctgcccagagggaggaaggagcactgggatctgaggytgagtcaccctggcttctgtttgcttcacagggagaaaaaggcgagcccggcccacgcggccccgaggtatgtgtgggtcctggccacctgtgcccacccagggtgggggtctgcacgcccaattgctgggaacacaatgcccaccgtcactgacaggaccacccctgtcttgagatggtcctggctccccaaggcccagccatgtcacctatgctgagctctgggggagctgtcagccactggctgrtccctttycaaccaaagttcaggctttgccaaaaaaaccacatagatgctcccgtttaaaggaccccaaaatgccagatcgatttttccacataaaaatctcactggtgtccctggtagagacagctcctctgtcccaggctaacatgtgttcyctgtcacagggaggccgaggcgactttggcttgaaaggagaacctgggaggaaaggagagaaaggagagcctgtgagtgtcrccgtcccgaagcccacagcagctgggcagaggcagggaggggccctgaggctgagcgtgtgcatctatgagtacaggagaacgccaggcagcttggccccagccatgagcaccacccccaccttcctaaagggaacggctggctcaggggccccctccctcaacccagcctcccttccagcgtcccctccccagtgaccccccaacatcccccccacagcatcccccacaagggtcccctccctagtgacccctccacaacatccccccagagtcccctcccagcatccccactacagcatcccccaccagggtcccctccccagcgaccccaacatagcatcccctccagagtcccctcccccaaaagatgcctccacatagcatccccctcagagttcctacacacagcattccccaagggttccctccccaatgtcctccccacagttatcccccagaaggtgctctgtgcctccaaatccctagcctggccaagggtttaaccagggctgcaggttggtctggaactgagcacaaaacaagggatggataacgatggatggatgggcaagtggatgggggtgggcaaatggatggatgggaggatgggtgatggatggatgagtgaatagaagagtgggtggatagaagatggatgaatggatggattgctggatgagtgggtgggtggatggataagtggatacatgggtgaatgagtagatgtatgggtgagtaggtgggtaggtgggtagatggatgggtgggtgggcgagtgtgtggttagatgatggatggctgaatggatgagtggggggatggatgggtgagtgggtgtatgtatggatgggttagtgggtgggtggatgaatggatgggtgcataaaggatggatggatgaatgagttagtgggttggcagatggatggatgggtgagtcagtggatagatggatgggtgggtggatagaggatggatggttgggtaggtgatgggtggatgagtggatagatgggtatgtgagtgagtggggggatgggtaggtgggtggatggatggttaggtgaatgagtggatggacagacggacagtgggtggatggatgagtgaacggatggaccgatggatgaatgggtgggtgggtagaggatggacggacaggtgagtgggtgggtggatggatagatgggtaagtgagtggatagatagatgggtgggtggacagaggatgggtggatgaatggatgggttagtgggtggctgggtggatggatgatggatgggtgactgggtggatggatggatgggttagtgggtggctgggtggatagatggatgggtgattgggcgaatgggcgaatgggtggatgggtgggcgtggagttggtgggtacatgataatggggtggaatacccatggattggaatgagctgttttggctgcyatttctgggacacccagctctgccaggcccctacccctctggtgggccaggctctgacggtggccactcatggcctttcyagctctggtgccrgcatagggaaggaggaggcacagccttgtcttactccttgcacctgttagcyccccccccgccaagggaggacccgtggttggggacagcacagggggccctgctgtgtgcagggactgtccctgkggccactgaagcscacctgttcttgttccttctcaggcggatcctggtccccctggtgagccaggccctcgggggccaagaggagtcccaggacccgaggtaggttggtggccagtccccatgccctccccccracctgccaggccaacacacacccaagcctcgtggttctgcccacrgtggacccacgtatcagtgrgcagtggcctgggagagactcagccacccagccttggccccrgagtctcagcctcatccttccttccccagggtgagcccggcccccctggagaccccggtctcacggtargtgtcacatggggcagaaccagtgtccttctcctgccaaaactagacaccaagagcagcaggggtgggggaaggtcagctggcacggtcagagagcaagatcagtggaggaggtcagagggcaaggtcagagagcaagcttggttggggaaggtcacagggcaaggttggtggggggaggagrgtggcagcgaggttggtagggacaggacccgccagcctccccgcatggctgcctccacacgtgggctggaatgtcccgggacccccaggccaggaccttgctgtggaaactcttctggggccccggggggactrccctgcctgccgtgtgcattgcaggagtgtgacgtcatgacctacgtgagggagacctgcgggtgctgcggtgaggcactgcccacggcagggtcggggcccatgcaccgggtggagggcgggagtgcagcarggctgggtcatcgctgggtccygcatgtgcacgtgaccctagggtctgaggtctcccyggtaccccccgatgaccctgccacccccccagactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacaggtcagcggggcaggggcgggtgcagcattgcggggggccgggcggggcgtgggaggcgatgagatgggagaagtccagacgcgtccctccaacgagggcctctgcatggctggggatgccccagaccccgaggcctctggcaacsacctcacgcgtgcggcttgcagggacgcgtgtgggcgtggtgcagtacagccacgagggcacctttgaggccatccagctggacgacgaacrtatcgactccctgtcgagcttcaaggaggctgtcaagaacctcgagtggattgcrggyggcacctggacaccctcagccctcaagtttgcctacgaccgcctcatcaaggagagccggcgscaraagacacgtgtgtttgcggtrgtcatcacggacgggcgccacgaccctcgggacgaygacctcaacttgcgggcgctgtgcgaycgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccgggtgagcgtgtgggcgcggggcagtcggccgaggagcagcaggccccagcygctgyctagcgtgagccccagggacacccctcacctgagggaygaatgtgcagcccaggatmttgggctgtgggtgggaaggggtcgggccctctcggggctgcagggcagaggccagctgcaccctgagcctgtctaggcagatcagtgaacggccgctgagggttcgctagrgactgaccctggcctggcccggcctctctcctctcttccagaccctcagatcgtgtgcccagaccttccctgccaaacaggtaatgcagggcaccctgagccaccaccccagactagcaaagcagccctggtgtccttcctcctcgagggccgggctgggggaggggccgtgcagggacccggggggcggcggagccactgcggaggctgctccttagggagatggccccaggatggcagcacaggggaggaggggcttggggaaggcaggctcccaggaacgcaggaacagcatcacgaggccatgaggtgggtgctgctagcctggcgctgtgctcggcatgtggccactggtcttgaaggcccaccatgggccttgcagtctccctcagctgccgcccagctcccatgggctggccgtgcatgtgccactcggaggaagccctggattcagkgagtgaaaccatcccggggtggaagcactgacaccccccagcaccagcaggtcttgctccaaccctggcctgcctcggagctgcagctgcggctctcatctctgggagtgggggagcccatgtcccggatgtggcccacgtgggtgtgaagctggagctgggggtgccgtccaggctctgctggacgtggtgctgcccccatggtgcactgctgcaccgtacctgggcccacaggaggtccccgggggcgttakgagctgagtccccctcagtgagccgtcccctccaggagtgtgagggtrgggatgccatggagacagggtgggagggtccgacctggaggaccacagggaggaaacctcagggtctgcggtacgaagtcagcgcttcctcagcacgcgggtcgcggtgtgcgttcgggcgttccatggggagctcccggtgggtgagctgggccactgagcacattcacaggccctgaggctgccccaggggaggarccgtggactcagagccgaggttccccatacgtgctgcgacagagaacctagggcttgcacctgggtctggctgcccttcagcaggcgggcagcctctggccccacaacagtgggctgtgcttctgccgccaaggtgcaggcgtcctcccccagggtccacatcagcagcaggggcacctggaccctgagggcaggaaccagaccttggctcctccacccaccccctcgttcctgatggggcagggaagtctcgggaccccatgatgggcgacatggcgatggtcactgtgggtgctttgctatcaggtggggggccttcctctccactcygggtccagtgtgagtggccgctatggcttcccctccactccaggttctatcgtgagtgggtgggtgctgcgtctgtggatgtcacgtgacctttcctctttagcctatcatygtagttgggagttagttagcccgttgagcgtcattgaatttccagtgttgagccagccctgcgtgcccgggataaacccacctggccgtggtgtgtggccctgtttatgcacgtgggccctgattcgctgatgcctgcctgagggtttgcgcttatcggcgacatcagcctgcacttttcttttctcgtgatctctctggttctggcctcagggtgacgtgggcctcgtagggtcccgtggtggctcctccccagacggtgacatggagtgagcccattctccctcctgggagtgggtcactcaggccaccagagcaccacagggaaagcagccagggaggacacggaggcccttgaagctctggcctcttctgaggcctccaggacctgacagtgagtgggagcagccctggcagaacccctcccctcctctcggccgccctgacacctcatccccgacactcagagctcatcctccttcccagctgtttccaatttcaaagtgaactcgaccttgtggctccaggagatgcagcagggacagtgttaaatcggctttcaccagcccacacagccaggcatcctcctcggccctcctgggcactgggtggacaccactggctgtggcctggccctggcctggccctggccttctccagacagccctgtccaccccaaagcccagccaccctgggcctgcagcaggcctgtggagttctcagttgcgtggggaccagagggtgctggagaaacaaaccagacgcagctgaaggcagtcagggcagggcgcamtcagcgataagagctgcataggggccacagcgtaacctgagctccagtcggtggaaagaaaaggcagagacgttgcagaggccaggtctgctcaggggaagacagttctgggtgtagaggactcacatcccagagaggctgaggaagggtttaccaccgcaagctttctcaggcgggctcttgaggggtggctggggtcttcctggcgacgggcctgcggcactggaagccctactggagtttggcctgtctccggcacaggtttggacggagctgttttgtgctgaaaggttttctcggggtccgtggtgtcccccaaaggtgccaccgtgcgggtctcctagctccctgccagcttcctgtccctgtgctcactgcccccacgcctcctgccaaggccgagccacacacccgctccacctgcatttcctctaccgactcgccagcccaaatgccgctcttcactctggcctcgctgagcggctgcccgaggaggagctctaggccgacgcccaccgcaggccttacagtcttctctggacgctcccttgcagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcsgggtcagcggggctacrgtccttccaggggctctggggcagctcccagcctcttcccaygctggtggccaccgtgtcccttgctgcggctgcatcttccagtytctcctccgtcttccwgtggccgctctctttataagaaccctggtcattgaatttaaggcccaccccaagtccagaatgacctcgcaagacccttaactcactcccgtctgcagagtccttctttgctgcatcaggtcaccctcacaggctccagggtttgggtgtggaagtctttggaggcccttacttagcggcccagctgggctgccgtgcgtctgggatggggctgagggagggtgctgcccaggtgctggaggatgttccagcaccaggttccagcggagcctcggaaacaggccccagaggctggtgagcctcgctgggtgtgggcactaatcccgtgcatggtgactcgtgggcgctcacggcccacctggtggcaggtgaaggcttccggttgggcagcagatagtcctgggggaagctggcagtcctggcaccatgacgtatctgggctggtgtcatgcacagtagggcgaatggccacagctgcctgccagcagccctgatcccggggtgtctgcacccttccagcccaacctctgggtctccaaaagcacagtcgggggagcatccaccaggcacaacctctgcggtcctcagaggactgagcagagaatcccagggtccacaatgttggggagcggcagggatcaccatccaaagggagcggcccccacggcgagctgaccccgacgttctgactgcaggagccctcatccaggctgggctcctgccgggcacggctgtgaccatttctcagggccaggttctcgtccccacacccactgcacagggcaggccaggctggtcttcccactgtggggatgaaggatcctccacaggaggaggagagcagagtccacagacatcccaacagcctcagcctccctgtgcctggccggcccccacagcttccccgtctcctccaggccccacagacactgatgaatggacagagacccccaaaaccagctgccccttgcatgtctgtctccatatgtttggtgacagcagtgaaaatgttattagttttgagggggtttgggaagcccagcggtacctgaggagtttctggacatttaagccggttcctaggtgtggccttaacagggaggctgcccttcctttcactgaatragctgcgtcactcataagctcactgagggaaccccatctgccagctcgtgygtgctcagacggcgtccatgtctcaagcgttctgtgaaggctgyggtgcagcgtgaggtcaccctgctgtgttcagagctttgctcactgcctgcggggctggaccrttgcacctccagggccccsagaaaccgagtttcgggtcagggtcctctgtgtgcattcctgggggtccatgtaccagctgtgacgacgtccaggggttgggctgagaagcagacacccttggggaaactggctctgtccctcccctcccccatcccaggagctgaggtcttggtgaggccacagggccaggtccacgcaaggactgtccgtgtcctgtcctgtggtctctggccccacgtgacacccacacrtgtggtaggcagcctggcctgggttgtggctatggccaggcccccaagctgtccccgatgcccagggctggtgaccacccaggcaggtgggggccccacttggtaacagagtcatagggcagaacccacctgggctgccacagaaggtctggctgcccctgtgcccactgctccccaccatggccaatcagaagagtcaggggctcctggtctttccgggagggacgtggcccagccagctctaggtgttctgagcagctctgggacccagcgattgaggggtcaggctgggggtgtcagagccagggtcctccttaagtacctcccacactacacagacagtggcccttttgtgggcagcaaattcttgagccatgaaaggatgctttgggccccttccctcccaggagggcagcctgtgcagggatggtgctcagcaggtggacagggcctggggcctgtgtcagggtctcaggcctgggagcaccagcagaggagayggcggctcccagcagtgccgcctgaaagtgtyttgggctaaggacccacacccagggctgccctgcagaaacgcccccgcagagcccagtggtctgtgaggttgcaggcagggtgcgaatggaagggcacaggtgcggggctggcacctgcccggtcctgcccacctcycctccgcccagcccgcacctgcgtctccccacagagctgtccgtggcacagtgcacgcagcggcccgtggacatcgtcttcctgctggacggctccgagcggctgggtgagcagaacttccacaaggcccggcgcttcgtggagcaggtggcgcggcggctgacrctggcccrgagggacgacgaccctctcaacgcacgcgtggcgctgctgcagtttggtggccccggcgagcagcaggtggccttcccgctgagccacaacctcackgccatccacgaggcgctggagaccacrcaatacctgaactccttctcgcacgtgggcgcaggcgtggtgcacgccatcaatgccatcgtgcgcagcccgcgtggcrgggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgygccrccgtgttccacgagaaggactatgacagcctggcrcaacccrgcttcttcgaccgcttcmtccgctggatctgctagcgccgccgcccgggccccgcagtcgagggtcgtgagcccacccygtccatggtgckaagcrggccsgggtcccacacggccagcaccgctgctcactcggacgacgccctgggccygcrcctytccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccattgcgtgcctgcttgcgagcttctgtgcgcaggagagacctcaaaggtgtcttgtggccaggagggaaacactgcagctgtcgctcgcccaccagggtcaatggctcccccgggcccagccctgacctcctaggacatcaactgcaggtgctggctgaccccgcctgtgcagaccccacagccttgatcagcaaactctccctccagccccagccaggcccaaagtgctctaagaagtgtcaccatggctgagggtcttctgtgggtggacgcatgattaacactagacggggagacagcaggtgctgagcctgttgtgttctgtgtggagatctcagtgagtttttgctgttcagaccccagggtccttcaggctcagctcaggagccccacagtgaaccagaggctccacaggcaggtgctgacctgacaggagtgggcttggtggccatcacagggcaccacagacacagcttgaacaactaccagtatcggccacaggcctggaggcatcagccgggccatgcttcctctggagggctagaggaggactagagaagggcctgccccggcctctccccagcatcccagggttcctgatctcctggataaggatacaagtcaccacactggactggggctcagcctgctctagaatacctcacctaagtcacactggaccaggctcagcctgctctaaggtgagcttacccgagacactggaccagagatcagcctatcctgggataagctcacccgagtcacactggaccagggctcagcctattccgggatgagctcacccgagtcacactggaccagggctcagcctattctaggatgagctcacccgagtcacactggaccagggctcagcctattccgggatgagctcacccgagtcacactggaccagggctcagcctattccgggatgagctcacccgagtcacactggaccagggctcagcctattctaggatgagctcaccagagtcacagtggaccaaggctcagcctgctctaggatgacctcactggagtcacactggaccaggactcagcctattccaagataacctcacccaagtcacactggaccaagctcaccctgctccaggatgatctcacctgagctcactgcatctgcaaggaccccatttccaaacaaggtcacatccagaggtctggggcttagggttaggggttggggttggggttggggttggggttgggggtaggggtcaggagtcagggtcagatttagggtcagggtcagggtcagggtcaggtttagggtcagggtcaggtttagggtcagggtcagggtcagggtgagggtcaggtttagggtcagggtgagggtcaggtttagggtcagggtgagggtcaggtttagggtcagggtgagggtcaggtttagggtcagggtgagggtcaggtttagggtcagggtgagggtgagggtcaggtttagggtgagggtcaggtttagggtcagggtcagggtcagggtgagggtcagggtgagggtcaggtttagggtcagggtgagggtcagggtgagggtcaggtttagggtcagggtgagggtgagggtgagggtgagggtcaggtttagggtgagggtcagggtcaggagtcaacatgtgaaactggggaaatgcagttcactctggataccctgaaactttgttgtcctttgaaaagactcactcttttcttcatactccaccgctctgtcatctgaccacacagcctgcagctccaggggagtacgtcagttattttctcttcctttcctccttttcccatcccacaaaaaaactacgcaaatgccagcaggagatgcagaagaggcccgcctgttttgctaagcccctgcgccctgagtgtcagccctcagatctctgtgctccaggtgaacaccgcgggtcccgcaggtggagggaggcagaggcccctgcaggtgcacaggctccacccacaggagctacacaggagctgcccagggcctctgcagggagagggcgctcccctctctcgtgccagctcccacgtgtgcagcctcggaccctgcagggcaggaacgtcagtcccactggaagggacttccagctacctacaggctctacccacagctccacccagcaactgccgctcaccattggcccttcaccaattacaccacaccagcatcccctcaccagcatccctcacaaatgtcccctcatggtcccaacaccaatgtcccctcaaatgtcccctcatggtcccaacaccaatgtcccctcacaaatgtctcctccctcacggtcctaacatcaatgtcccctcacaaatgtcccctcatggtcctaacaccaatgtcccctcatggtcccaacaccagtgtcccctcacaaatgtccccttcattgtcccaacaccaatgtccccacacaaatgttccctcacggtcctaacaccaatgtcccctcacaatgtcccctcatggtcccaacaccaatgccccctcaccgtcccaacaccaatgtcccctcacaaatgtcccctcaccatccccaacaccaatgtcccctcaccaatgtcccctcccagccttccctcctgagtcccctccccagtctcccctcccagactcccctcccagcctcccctccccagcattccctcccagcctcccctccccagcgttccctcccagcctcccctcccagcctcccctccccagcgttccctcccagcctcccctccccagcctcccctccccagcgttccctcccagcctcccctcccagcattccctcccagcattccctcccagtctcccctccccggcaccccctccctgtcaccccctgccggccggatatgtaggaacctttcatgctgagtgatgatggccctgtacccacacacaccttgggtgttttttctccctgtaggattcttgtcatttgtcttggatgatgacatcttttttcatgaacaagtatgttctattttcagaatgggaaatctctccaataaggcatttgagttttctgcttcactcaaggacacagtaatcttctttttaatatcctgcagtgctgactaacaaatacattcatacatcatctgtcacatgtaatagtccatctagaagtaatttgagagtatagtgatttgctaaattattttttaatggagaacttctctggagacaggaggctggctgggcagggagctgaggcagggaggaaaagtctcccaggagccactggttgaagggtggacgggaactgaggacagggccagtaccgtgctctgtggaactgtccagacctgccgggagctgcacctgggaagcgaggctatccttccagcgtcgaaggtcctgctgtccctggggtttctgtcccatgcacagaaccagggcccctttccctcagacaaggggcctcacagcccagggacctgcactgaaccccaggtcctctgaatacctgtgaccctgcccactgtgggctgcactgggtgtctggggaccctggcgctgaggtctgtctcctcacgctgcaaccccattccctccaaccctggctcccatgggccactgaccatatgtcctgctcctgccccaagacccgcagctcagctctcagccctgcccccaaaaccgccaacacacaacacaggtttggtgccaaaactttactggaggtcacatgggactaggggccttctgtccctgccagcgcctccattcccaggcgatgccccgctgcctgcccacctaccctccgggccccacacgaacaagctgtgtccccaccgaggtcacagctctgccctctggggatgggcgagggaggggccacagagcccggagaggcctcccgcaccgtcactcctgccgggtctccaagcagtccagcaccagtgcagcctgggtcttggcttcctgcaggaggctggaaacacgatggtggatctgatggacacagggaaagaggggtctggtagttccagtcttcagcccagcttgctgggcagcaacctccgacccccactgcccacggccagtcggcaatcaccctgaggctgtgaatccaggcccccacrtggggtccgggcaccacacctgcctcctgctcacctggtccttaaatgcctcgtctgtgatgtccctcaggttgatgagcacgttgaaatatgcgccaaacacrcccatctccarggctttggccgccacctgcaaggaccccagggagcccctacatggatcaaggctgagcaaactgccggaaggagggtctctgcctgacgggctctgggacaggccggacttcgtcctcctcctcacaaggagcccagcgcagcccccgctttcgccccacagagggctaagccccaccactgagcttagaaaacaaaactttctcttatccaagcagggctcagccccacaggaggcctgggagcagtcacactggaggctctccgccactctaggaaccaggaccacagttctagagacagtcatcccctggagggcccccggaggcagcttcaggctaacggcccgcccactgcccagggacacttcccagggactgaggggacacttctctgggaccagatgctgaaaagaggcgtctttcctataaagaacccgaagaccatgaggtcttagggcagctgcagaaagtgctgagcccatgagagagacgctccttctctgggaccctctgcccagctgtggcccgtcagtgtgaggcatctacttccaagagctgccttgtgtgctttctcgtgttttgttgtttttgacccagggtcttgctctgtcaccaaggctggagcgcagtggtgtgatcacggctcactgcagccttgacctcctgtgctcaagcaattctcctgcctcagcctcccaagtagctgggaccacaggcaccaccgtgcctggctcatatgtatctattgtacagccagggtcccactatgttgcccaggctggtctcgacctcctctattcaagtgatcctcccgcctcagcctcccaaagtgctgggaccacaggcgagaaccattgtgcctgggctgacataggtgttttctagaacaagacagtgggggtgatacaaggggtcttgggggagtatacacttatacagtggtcagggtgggctctgcagacacatttgggtctccgtctgtggtgccgccgtgagcgagatcttagaaggcagcggacaccccggccctgttggaggaggccaaagccccgggaactgcccgtgaagtgaggtctccctacctggctcagcccagccaaccaccgtgctctccagcaactcagccccaacagctgcttcctgctttgcggcaggaggcctggggtcccccgggcccccctacctggaggtctgaccggcaggccaggttcccacacygggccagttcctgcagsgccggccacagcgaggccaccgtctccrccagcgtcagcggcacagagactgcccgcctcagaccctcctgtagggccrccgtgcgcctgaaaggagcaagaggagagcctgagcacagcggcacacacaggcaggcagtggacacactgcaccccaacagggctgagcaggctgcagaagcgggcgatgggaagtcattcccaaacacccagcacgcccaggccaaccacgccccgtcacagcacccaggtactcgggatcctggccaccaactccccagacacagaggcccacggtgcggccggccctccaggctcacctgtccttttcctcaggtgtgttcttggggagcctcattgcttcctgccataaagagacagaaccactgggcgagggaccgtagggggagcagccatgccctctgagctcccacaaggggctgtagcaaggagcatgtcccaggcagggaccagttctctgggaaccaagcttctgttgggccagtggtttatagcccttagcatcaggcttggtggaggag

SEQ ID NO: 12410 - DNA, 14893 bp, Homo sapiens
gggaaaatgcaggccctgatcattttgctggtcttcctcttgcctcctgaagccacatctggtgagtctagggtgtaacttcctgtcctgtaagtcctcagcccctattccaaaatcattaacctgggtcagagaagagcctaaaataatgctgcaggatatctttgcatatgttccaaagggagagctatacctagaagagtcatatactttccacagttgatgacagtgtcccagggacaagaagagtagggtggagaaagaatcagaaactggctttggaagtttcccttaacctgctttgctcaaaatgcccccaattcttatccatggcccttctctcatattgaagagggcaggataaggacatgatgaaatgtctaaaggaaatgacaaatcaagctggttaatgattccatgaatgtttaatttataattattcatttgaagaaaaaatttttttcactcttatgtatgtatgttatgattctcaattttaaaaaaattaacatggaccataaccagagagaagccatttttttctgtagccaggtcatacagaagacctgtgctcctgaccagactttagggatgcacttaggtgatggggtatgcccaaaaagtccccttaaaaacacacattgaaggcctgtttgtgtggctgccatttctactgcccactgacccattccctgagcagccagtgccacttccttacttcagtcattaactgatagtgaaatattgatttctccacctttggtaatattaaagatcactaaagggaatgtttgaaattctgaaaaagaacttcaagtttcaggggggaaaaaaggttgggggagaggagtttcctaacagggatcccagttaatacataatcaatatgcaatttattaatacatctctccatgtccactccccctgtatcttgccattcttgacctgcatttccatcctccttaccttccctagaggccaactcattttctttgaaaaacctggcatttcccagaaaaaaaagtgaagggctgggagctgtccgttgtcctgatttgctccctctgcccttgcttccaaatgtggttggaaagaagcactattgaaaaatccctaaacgacccctgcagggttggctctaccctgtagccatggacacatgctgttgataccacctgcctcatgagtctcacataatttgccctttcacactatctaccccatcagccttaccaaaaccatacctgcatcctgggcagcatctgcccttcaagagactaaggaatctccttgcaaccaagaatgactagaccaatgagacaccctttaaggccccagcacaatatagaaatcccacaatatggtaatcccagtaaggagctatcaagccattgcaggaccatctagaatacaactagagtatagttcctttcaatccaggaactatactctaacagcttggctcacaggaaccagaagtgaagatgatgaggatcagggctgagcctgtgagcaccagctccaccactgacaccaaccacagattaaacaagcatcttgtggacccctgggatggaaagaatagttgttgccttatcaacctcccccacagcccacacagaaaagataaaatcatcatggctacagtgttacagaagatgatgacccaaggagtaggcctgcctgagtgaagctgagagtgataatgggagcagtagcatctcagagactacagcagaaaccatccacataaagagctttgcccaaacttatgataaagggcaccctcagagactctccctactttaatattagcccattgcagaaatggtgagtggaaagagaaatcttaggaagaaccccttaaaaaagcaaaatgtttttaggtttgtgctgaagagcctggaaaagaaataaggacacacacgctgagaaatcttcctcctgccccaacactgggaataatctccaaggatctctccatatctcattctcctggatacactgtccactcagaaatattgtgcagagtgcagtaattcaaaagtgagctattgtgttaggagtgaaggcaagagtatcgtaaaataaatcaatttgaaagtaattctcttaaattgctttatagatgtttaatgtaagccagcagctattaaacataaaccttaaattcagaaaaacttggtcattcagaaactatagaaacaggcaggacttattgcgagggcaaacacagagtgagctccagcctgcttcaggaaaatctgccagtgccatgaaggatgtactctgtctgctccactgcactactgctcagtatgagcccatgccatcagctgtccctgacccacaggagttctttagaagagactgcaacaaaagtttctaggtgttttatacctgccaactcgagggttaaaacaagttgcatagaaatgctcaatcaagaaagacacagtcattactcagagaataataaacagcctggcagcacatgaatgaatagaaaaaagatgttacatgcaaagcatgaaataaccaaattccataacagatgttaatctgtaatgtgtttaggagaatttagaggaagtataagatttattctttcatcaaaaaaattatagccaatgaggatatatctatcaattatccatcaagtggtgatatggcagcacaaggtaaaacacaaaggaataaaaccaacgtttattaagaaccaatcatgtggcatttcacattgagcatcatatttaattctgaaaaaaatccttgtactgtatcattcttcatattttatggatgcagtaactaaggctgagaactttaaaatttttcctaagttcagacacatagctaagtggcagaaccaagattcaaactcaccccatctaactgcagagcaaactgcatgccttaaatgtcaaagtgaatactagcacagttaatacaatgttyggaaactcagagaaggaatgatccctctgcattatagttactaaggaatcattgccattatttaaatgccagtgcttctacatcaggcccaaattttctgtcctactaactgtgaatcaagacttgattcaacctctacttgagtatctgccgcaatgagaaatcacttacctccactaaycacacatttattttataacaacagattgttagtaagtcctttcttatacatactcaacagctgcttcccaagatgctgtaggattatgtctagagtcaaactagccagaagcaatgtccaaaatacaccataacactgtgcagcaaaggtcctactaccacttgtttggcccaaacattctaggcagcactggatatctgaatcatcaattatttccacaaaccctgacccctctaccagtcaccctcactagaagaattaattccacatgataatagctccctcatgttactcccttctaagtcaaattgtacacccctttatctgattaacagagtctaagtcacatgacctaaatgcaagagaaactgggaatggaagtttgtggattctaccttagtaaggcaaagttatcattgggaattcctctaatacaggaagggtgttccagagacattaaggagccatataaatggaaaatgtccactacaatccatcacttggttgccccacatcaacattcattcttttgccacacttaaagtttccaagaacaaaaattatcccactgaacataatctttactatcttttatataaaggaaaattagacttgactcagcagaactgaaataacccagtctcaacagttactgcttttaacttcaagtactgtgtctctaggtgatacctgctccaacaatagtttggtcacattttcaatttgatattctctagtctcccaacttgataactgtaccctaaaccataaagttcactaccaacatgctatatataaaataaccaaagggggaagaagaaagagaaaaaggaaatctcttaaaatacacaggtatacatatgacaaagcaaagaaggaaatgtgagcagatagtgcagtcctcgtttctgaaattggtcccctgactggggctatacctattccatttcctcaccctcagccaggcaggtgragcaaaacttaagtcttggtggatctgaatcttgatgctgtggagctgtcttactagccccagactacctgcctctcaatttctaattatatcagtgaaagcaaacagctttgatttgtttaagcctctgattttttggtctaactgatgtaagaccacaagacaagagttctccagctccggattctcttctgttctgttaatggtgaaatgcccagagaagagttgccaactttggcaaataaaaaatacaggattccagttaaattcaaattttagataaacaacaattttttagtattagtgtgtcccattcaatatttggacatacttaactaaaaaatgatttgttgttcatctgaaatacaaatttaactgggcattctgaatattctctggcaacccccgagagagtgaagaaagtggtacaaggacacttaagaagaccagatttgaaaagacattacggatgtgtttaaatgtcttattctagagagagttagagctgtaggtagaacttgggaaattaagttaaaagcaacagaggacctggccaatatatactaaggagtggatcactctggtcacaagcccaacctgagaccaagggcatagtgagatgatttgggaaaggcacttatacactactcatccccgtctttgaactaaatgccttataaatctccaagagaaatgacagtccaccatgtggactgctttctgtaagtccagggaaaataaaagctatgtgcttgaaacccacttctgatattataaggtgtgtgatctttgtcatgttaatgggtctgagtatcaattctacaattgtaaagtgacagtaatggtgtgtccccaggttgttgtggaaagcttgattcttaatgcaacagtaggaaaccccaacctctctggagcaaacacccttctacatctttacttcccctgcacattggcaggactctattcctctatttctctctagtgctagagcagaaagggaccttgatttgatatcaggaaaatctatttctgaaccataagctatgatagctgatttaaaaaattgactatcatgacatgataatgatcataatggtaatacatattgatagggttgccgtgaaagtaataatatatctaagagttgtgacaatatatgatacgcctagactctcagaaaatgctaattccaatcccaattgctctttgcataaagttctgtcctagggtctgttcttttcccacatctaccctccttggatctctcttctgtcaaaaacatgtggttcagaggaggagagagatccaggtcaatgtttttcaaattacaaggaattatcatttaaatggggttgttgctcaagttttgacgtgtagtggaatggagtggagtggagtggaatggaaactaacagaaaacactgcacatggttaagataaagattgtttcctgaaacctttaatttgtgcttacatactcacacatacatatgtgcatgcactgggactctgcaatatgcatttctgactatggaacatagccataaaagtctttgcactgaacgttcagtgggcctttcacaagctgccctaattgggaaagaaaaacatggtccctccatttcctgcccccaactccagaaaagtcaccatagttgagggtacatctgagaagccagcacttgggagttcagggctcaagttcctttctagaaaaacactgggtgattctaggggaacttctgatcagaaacagccaattcagagtgagagaagaaaacgygaccatgcagttcctgtggttaccagccttgcccctctcttgccttctgggagwtataaaacccaagactggaaaggaaaaccagcatttgctcaggcagcctctctgggaagatgctgcttcttcctctccccctgctgctctttctcttgtgctccagagctgaagctggtgagtatcagggttcttccctctgaaatctgcagtatcagctcctgaaacaaagatgtttagtctgaaaatagctgactcctaaacagggttccaagatctctcttcaagagtcccagagggaaatttccacttgggatgtgtgccaccccacccccacccccacccactgccattctctacagcctaggacagcccccaggaacaaggaatttcacctcaattgtagaaaagcccagagcaagtggaaggaaaaggggtatccccaggaaaacagacatgtcctcttaatcttctgagcatcagggctacccattactttgtgactttctcactctgtgaccatgctcaagagctatggagaaatctaaaacaggaacctggacagtgggtcctacacagagacagaggagggtgggccagggcaaggtgggagtgggagaagtctgagatgaaaacatcagaatggagcagaggcaagaatgagatttcacctgggaggttatgggtggggaaagatacgaaatacaggagacaggagagggaagatgggcggaacacagggtgagaatgagattccagggaagcctagctcagctttaacccaatttgtccattcattggagagagtatctatggccgtgttcaaaccctggggtgctctgttccaggggagatcatcgggggcacagaatgcaagccacattcccgcccctacatggcctacctggaaattgtaacttccaacsgtccctcaaaattttgtggtggtttccttataagacggaactttgtgctgacggctgctcrttgtgcaggaaggtgagacaacagggtctatttatctccaaatgggagatgaacaaccagagtagcatccaggaatacacctgcactggggactgaagagggggtcctgggtcttgtcaactttcaggagagggaagacttgggctgaaagactttagtctgtgtttgaatagttccttgagcctcagtcactgtgagctaagctccccttcggaggaaaaggaggtcctgtccaaggtccctcttgttgcagtagcacccctcacccctacccaactcaagacacacggctcacttttcagggccccacccagtctcagggccacttcctctatggccttttcaagaacactggcctctagttctcagggtcctgaacccatcattttatgggaggcagagaacagggtctacatgagacccccactttcccgtttaactgatatctcctgcttcaggggctggccctcatgcagggttccctgaattaggaagtgtgaaccctgtcccctgagtcctccctggcctgttcagtccccagcaattccaggggtcgtagaaattgtgtctgtttcctgagaaagctctttcatgagttaagcctgagccctcaaatgccacaagtggcccatgaaaagggagatgggtagagtccggcgacccagtgacagagtttagtcctcttttctcagaatgagctcacctcagaagaaaccccaagccatcactgtcgctccttttccttccttcttcctcacarcaggtctataacagtcacccttggagcccataacataacagaggaagaagacacatggcagaagcttgaggttataaagcaattccgtcatccaaaatataacacttctactcttcaccacgatatcatgttactaaaggtgacaacacctctcttctccctttccacttcccattctcctaagcttctccttcaggtcctcattgccctgaatttttcttaggacttggctataacatgaagctactcaccctgtccctccctgatcacctccaactgtccagagcccatttcgaggactgacrgtccttcattcccttcacagttgaaggagaaagccagcctgaccctggctgtggggacactccccttcccatcmcaattcaactttgtcccacctgggagaatgtgccgggtggctggctggggaagaacaggtgtgttgaagccgggctcagacactctgcaagaggygaagctgagactcatggatccccaggcctgcagccacttcagagactttgaccacaatcttcagctgtgtgtgggcaatcccaggaagacaaaatctgcatttaaggtgatcctccaactaggtttcctctccaaaactcactgttcagggaccagaatgctcttagaaggagatgggktcagaaggttgtcagtcagtgacagggtgagcatcacaggaattgctgtcctcccgtggtccaagacagcctctgaccatccattccagtctactgcactgggggcatggggtgatrtggagaatgtgratgacggtcccaagaaaggaagaaggggcatcagaactagatgtataagtgaggagctccacctcctgsgtctgactttaggtctcactgtgactccaagctggctggcagacaggagtggaggacttcccgggctcaccttcttctctctctcctccccctacagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcctgagccagcctgaaagggaagctggaactggacctgagcagcaaagtgtgtgccactcattctggtctacccttggtccctcagccacaaycctaagcctccagaagtatcctacaggtcacagaactctcaataaacctcagtgaagacacagcttctagtcgtgagtgtgtgtcccctctctgctgctctcttctccctgcacatagtgacctgattcccagcccaagcacccaaggatttggaaggggtgtgtgtgtgtgtgtgtgtgtgtgtgtgtgtgtgtgtgtatggggggggagggagagagagagagagagagagaaatagagaggaattaatgaagaaaaaaaaatgaggaaaaagaagagattttccctggaaaggcaggatccatatttccagcttaagaaaagacaccaaatccttctttgccttaatcatcaaccctataccaattctgatttatctttagtaatattcagaagcactaagaacattttgaattataagcaagatataagatgtttacagcatccctggcctcttcctactagatgccagaagcaacacccccttctccaccgcaaagttgtgacaaccaaaatgtctccaggcattgctaaatgtccccaggcgagggagggaggaggaaagaaagatcactgtctttcgttgaagaccactggctctctttcgttgaagaccatggtttagatacatgatataaagaaggcagctgatgccacacagggccctcctcatagcccacatcgataagaaaagatcttccctctgtgaagctttcatctgatatgcagagaagactgcctcccactcactcattgttaccaaacagatactgagagcagattagaggagagacagcactacaaggtctgcatgagcaacacccatccacaaatggcttcacccaaaccagcaggaagaccaaaacctagagcttgctcaacacaaacccttgtcatgggagactgactggaggagagaaaacagggcaggaaagggacaggacagccagagcctgaggctggcaacacccatcatttctgagggtgtgctgaacacctttggccaagtgaactattgctgggagtttatctttaagaaagaatcaaagacacacaaaaagattcatgcataaaaattttaatctcagcatttttatttatgttttttactttttataatttattcctatatatttcatcttccaaataatttctgctttgcatttaatatatcaaaggtattaaaaaagtgatttattatacacacacacatatatacatatgaaatttctatcatagtcttagatatcagaaaaattttttaatgcactgtatgacttgattttttttttcagaaacatgaaaccataccaaagtgagaatttttgacttcatttcagctctggtttctagtttcaagtcttctaccagctatatgacttaaagatactacttgatatgttcagttacttcatctgaaaaattgacatgcattttaacctgaaatacaggagctcaatatttttctacaaaaaggacaattgctgtctataaattcaacattcttttcttggttatcttttttttttatcatactttaagtattagggtacatgtgcacaacgtgcaggtttgttacatacgtatacatgtgccatgttggtgtgctgcacccattaactcttcatttaacattaggtatatctcctaatggtatccctccccccmcccaaccccacaacaggccctggtgtgtgatgttccccttcctgtgtccatgtgttctcattgttcaattcccacctatgagtgagaacatgcggtgtttggttttttgtccttatgatagtttgaatctcagcattttcaataacaaaaatctggaatcccagacatggagaaaagcttctatgataaacttgtatgaytgaatattctgaattcatgaaaatttgtgttaaaaacatttagtatggaaaaattcaagaaaattcaatatattcaatataatgtaatgcttttacaaagcaatatgaaaatcttcctatagtagaatctcacttttgtagctatatattttatatatgcacaggaaaaaattggaagtaattacatcaaaataattatgggggttatctctacaggatgggattaatagctattctgattttgtctttatgctggctccaagccccatccatgtattctaactattgaggacgcagcaccactcatggctccaccagtggataagcacatataaccatcttcagaattccattgctcagggttttctgcatgggaacaaagcatccttccatttccaggtcgcrtcactcagcccattcaggaagctaccagagaagctaagccctacaggttccctcaggttagtgagcagtctttcctggcaattggtgtcaatggccaattgcaatctcctgaaaatctccactgccacagctgatcccagagtcctaattgatattttgcatctcacttccaccacccactctaggtgccccccaacaaccatctagcagttcagtaagtctgtgctgtagtctgatggagtgacccagacctctaccccgaggggactgagttgttagttgctttgcatttgttaggtttgggttgttgtaactgcccatttacaatcatcagtgagcacaaaagtatgggggatacttccagcaaatcccgtgggttgcagtcatactcttatcttctcccattgcattgcagcaaccctagcttctcatggtaatcaaggccaattattctagccataaggcaactctttcctttgcctgctggtccactgttatgaggagccccaaacagctgagtgatagtcacaacttccagttcactggagcctttcccacctccactggagaaagcatttacttcctggaaacttagacctctaaactggcagaatttaagtttgcaggaacagtaagatacaaattccacaagtaagtccctgggagtgataactaaagggatcaattctacttctatcccttggttcctggactcatatattctagttatgtggggacactgaaccatagattggtattgattcagcatatgtatcacatcctggaaagcagtgctccaacttccaaccctacagggtgtcatctctgagctggcaccttagctgagctttcaacaggccagctcatcattccactaggttgactgcttctgggtggcatggtatataataagaccaatgagcccatcattttacattctttgccataaaatgagtcctttactctgagctaatgtgtgtgagaagcaggttgatggattgggaaatctgtaagccctcatatggtggtagtggcagaggaatttcaggcagagaaggaaaactcatgtctagagcaagtatcaatggtgataaggatgaatgtccatcccctccaaagcagaggggtcaacctctcactggatggctgcctgatctctccaagagcagtgccatctcaaagactcagcgatagtctctgctgttggcaagttaggtgattaacagtggcaagacccgaattgattttggtgaaagagagtgtccatgttcttggacccattcatggcatctattcaacctccatgaccactctactctgaccatggcccattrttccagcagcgaggtgatcaagaagagaatatggttgacatccacaagccatatcacccctttacctggttgggagtctctgtgagtccatgtggtccagtgctcaggtacagcaacttcttcttagccagcagcactgtgcaagtggagctcttggtctgtggtggcagcagcagtggcagcagtgagcagggatttgtgaccatgagaacagagtgagttgtcaccagagccactccaacctaaaagcaaagcaagcagtcaatgcaagtggaatccagggaagctggagtggtgtataaactggaccaggtgcactggtccttacccagagatgtagttgggactytccataaacaagctcacctttgttctgctgataattagatcattctgagcaaaggtatattgtcaacagtggacctaattatgtatgtaaatgtcatctattagagtgagtaaaggagggggttgaggaggtaacaccaatgtggatgagaaaataaaaactacccacctgaaggccagaaacaagtgaatctgaacagtgcaaggaatggattttagtagacattgttgatgcccttcccaggacctcttaagcaggtgatgcacccattccccagctgttgtgagtgatagccactaaccaatatccatggccatgagctaacatgtatcctttccctgcgccacttctctccacacaaaatagatgcccaaattgatttttgacaaggctgccaaggacacacaatagggcaaggacagtctattcaatagatgatgttgggaaaactggatgttcacatgcaaaagaatgaaattagacccttgtctcacaccatatacaaaaatcaactcaaaatggactaaagacttaaatataaaacctgaaattctaaaactactagaagaaaacataggtgaaaactccatgacattgctctgggcaatgaattgttggatattatcccaaaaacacaggcaacaaagcaaaaatagacaaataggattgcatctaactaaaagtcttctgcacaaccaaggaaacaatcaacagagtgaagaaacaatcaatagaatgggagaaaatatttgcaaatcacacatctaataaggrkttaatattcaaaacaaataaagaagtcaattcaatagcaagaaagcaaataacccaattttaaaatgggcaaagaacctaatagacctctctcaaaaaatacaaatagccaataggtatatgaaaaaatgctcaacatcactgatcaccatggaaatgcaaattaaacaacaatgagatatcacctattagaatggcaattatcaaaaaataaaagataactgatagtgaagatgtagagaagagaacacttgtacactgttgatggcaatgtaaattagtatagttggtggcaatgtaaattatgaaaaaagtatggagctttacccaaaaattaaaaatacaattgccatatgatcaagcaatcccactactggatatatatttaaaggaactgaaatcagtatgtcaaagagatatctgcactcccatgtttattcgtaataactaagatatggaatcaacctaggtgtccatcactggatgaatggataaagaacacatacatacacacacacacacacacacacacaaacacacacagagtggaatactattatccatccttaaaaagaagaaatgttgtcatttgcaacaacatggatgagccaggaggacattatgctaagtgaaataaaccaggcacacaaagagaaatactgcatgatctcggtcatatactcttaaaagccaaactcatagaaataagtagaatggtggttaccagagcctggggtaagggagaggtacaggaggagatgaccttcctggttctgaagtccttctactgctttcacaatcatcctactccaaaggcgcaaacatcaaggggcctccaacrgctccctccctgcttgcctcagagcttgggaatcccaactccaaatctagttataagtacaatatagtgcgaattgaagaaaaaagaatattcaaaaatgtacacatactttgattgcaacagtatggaaaactatatattttagggaaaagcggaaagaatccttcaaaaatagaggtaattttctcataattgtaacttaaagaatggcttttttatttatttattctaattttttattctccttaaaattgtttttgttttcacaaatcacaaaaaaaatgaagaaacacaaaaatgcaggagggctttctcaaacattttcttagatgctcagcaaatggtcttattttctgtttttcccatacagagcacattccccaggaagcagggaaaccacaggacatggtacccggtcgcctggggcagaagatagggagtgaggaggacatcctcaggatcatccagagcctgagctgggaggaactacct

SEQ ID NO: 12411 - DNA, 15311 bp, Homo sapiens
aagcatcgttcagcaacagcctcaatctttcaggcttagaaatctgagacaagataacattaaaaaagtctagttttgcaatcatatattggaagttctggcaaatgattcagcatagagaatacaaagagaataccacaatcagtcaccctgccacagttccactggtaaaatgctctgagaggccccgtaggtttctacaatacttgatttccctttggcagactttgaattgctggccggaatgatccagatcttctgctgttttcaggtatgtttctcatattgtttttgagtttctaatcagaaacagaaaaaccagaaagcagagtgtgtccacaagtagatgtcataccacgtctggggaacagagaggggatataacataagaatgcttaagcatgaatttgtttccaaacacaataacttattattatacttgccctgaactttgagatagagagaaaaagagaaagacccaccaactttgcaatcatatgctaaaggttctagcgaatgattctgcagcattctttttatctacactaaaccaaaccctttgccatatcccatgcagacatggtaaaaaaaaaaaaatgcacagcatgagactgtaaacaagatacttaagagagagtccatcactccagaacattagtatgtgaacttcagactctgtggaaacaagatgctttgggaaagggcagtggccttggtgggcaaagatcctgggaatgtaaaaacccccaggttatggggatgtggggtggatcttgagaatgacccaaggtcacattgaaggtgacatcacagcccagaacattgatgcctttcaacttgctccaacccggaagtgcagtccatgccaatttacttttctgagtctgtattgtcacacttgctcccggtttggtggaggtgggcgcactgttctcactcaaacctacttctactcccccttcttctgtaggcctcttttcatccacaccagacatttacccactccagagtcttactggattgtccccaacccaacatccagacttgttcttctccatccttttttcatttgtgatggtggctgggcaatgataagaataggcaataagggaaaattaaaggttgttctagtagatactcaaactccagaaaaataatagatgtatgtctgtcctagaaacacttttctcttcccatctctgccctcttcccaatccttactaccacagaagcaaaatggaagtaccacattctccactctaatatgttacctaagttcttctttgctgacagattttttatctcaaattatttttgattttatgtacatatcccaggaattctgactagcatcctatcctaataggaatacagagataacttttaactgagacaagaatttcttctctacaggtcaagtgtggtggctcatacctgtaatcccagtactttaagaggccaaagtgtgtagatcacttgaggccaggagttcaagaccagtctgggcaacatggtgaaatcctgcctccactaaaagtacaaaaattcgttgggcatggtggtacacacctgtaatcccagctactccggaggctgaggcacgagaatcacttgagcccagggagcggaggttgcagtgagccaagatcggaccaatgcactccagcctgggtgacagagcaagatgccgtctcaaaaaacaaaacaaaacaaaaaaacagattttcttctctacaacatagctgagtctcatggtcaaatgaaatctagggccaacttctggctccttatgcctgtaagttctgactttgccatgacttaagagaatgatcaagctcagggaaatcaggtcacaacatcagaatcaaatgtcatgtatgagtgtgggaatgtcatgtcattgtgctgttctcatttacctgtaaggattggccttggccacttcgaaaagggactagctgtggttcagtgaaaggctaatacccaagagtatttcccttcatgggcaaggcatgacattcttctacagattaagaacagcagggaaataaggaataaaagggaagagcgtgtgtaatatgaataaacttttccatcaccatatggtagccactgaggtacctctctcttctaacagaatcagaatctaacatcagagatatagacaaaagacttttattcttcagcacctccttaatttttctccccaagtccctgaaaaatataggagatggtgaagtttgtagaagacttatattactaaaattagaaataaaagtggagacattactaccaaccttagagaaattaaaaggactataaaaagaatactatctacatttgtacaccaacaaattaggtagtctagatgaaatggacaaattactagaaacacagaaactaccaaaacagactcaagaagaaatagaaaatccaaccagatgctcacttcatcactgctattcaatattgcactggaattcctaaacagagcaattaggtaagaaaatgaaagaaaaggtatccaattatgaaggaagaagtaaaactatttctatttgcagatgacatgactgtatacaaagaaaatcccaaataatccacacaaaaactagtagagttaataagcaaattcaacaaatttcagggtacaaaatcagttgtgtttctatacacaaacccacaatgaacaataaaaaaaggaaactaagaaaacaatttcctttataataacatcccaaagaataaaatacatgggactaaatttaaccaaggaagtgaaagaattgtacactaaaaaccacaaataattgctgattaaatggaaagatgtcccatgttcacggatagggatacttaatattgttaaatggcaatacttcccaaagcaatctatagattcaatgcaatctctgtcaaaatttcaaatggtcttctttgctgaaatggaaaagccaatcctaaaattcatatgtaattccataggatccaaaaaagcaaaaccaatattgaaatagaaaaacaaagttggagtacttacacttctcaatttcaaaacttacaagctacagtaattaaaacagcatggcaaaggcataaggatagacatatggatcaatggaatagattcagagtccagaaataaacwcaacatttatggccatttgatttttgataaggattgtcaagggggtcttgaacattcagtggggaaagaataatatcttcaacaagtggtgctggaacaattggatagccatgtgcaaaatactctagtagactcctaccttatgtcacatacaataattaatttaaaataaatcaatcctaaatataagggccaaaaccataaaactcttagaagaaaacaggcgtaatcttcatggtttctgatttgtcaatggattcttaaatttgacaccaaaagcacaagcaacaaaagataaaattgatacatttgaatgcataaaatttttttaatttgcacatgaaatgacaatatcaagaaaatgaaaagacaatctgcagaatgggagaaaatatttacaagccacatatctgataagggctgagtatccagaatatataacaaactcttccagctcaacaatgaaaacaaaaacaacgcaattttaagaatgggcaaaggacttgaatcaacatttctccaaagaagatatgcgaataaccagcaaacacatgaagtgatgctcaacatcattactcataaaggaaatgtgaatcaaaaccatatgacatactactttacacccattaggatgaagataataattttaaaataacaagtgtcagcaaggatgcagagaaataggaactttcctatgttgctgataagcaatgcaaaagggtacaaccactgtggaaaacagtttggtggttccttaaaaaattaaaaataggattattgtataactcagaaattccaaaagtatatatatttggtatatatccaaaagaactgaaaacatattgttcatgcagaaatttgtacacaaatgcttattattgctgcattagctacaatagccaaaagatgaaaacaacccaaatgtccattgacagatgaacaaataacttgtggtataaacatacaatgggaatattatttttccattaaaaagaacgaatactggcatgtgctacagcttgtatgaatctcagaaacattattacaagtgaatgtagccagccacaacaggtcatgtattgtgtgattccgtttatatgaaatatccagaggtggtggttgcagattttgaatgtgctaaatgtcactgaattgaatactttaaaatggttaattgtatgttatgtgaattttacctcaattttttaaatgggtcataaacttatgtttagcataatccccttttaattttaaaaaatgcagatattacatgagaaaaaatgtgctagagcatatttcaagacattaaagatggttatcagtgaatgatgagaaattaggtaatgtttattattttcgctttgctaaaattatttaaaaattacttgcatattaaattttttaatgcctaggaaagaaagactatagttgtattgactaagatttctacgagcatggggaaaatgcttaatttgtagggttaatcaaggataaaataaattgcattgtatgtacaatgtgatcccaagtatttaaaacacactgcttatggtaacagtcagtctgtgggagacaggttaaaaagtgatattttcccttcctactttccaaattttcttaacaaacatatattatgactataatcagaaaaaattatttttaaaacgtctactatggggcaagctaggttcaaaaaatagaagtttgataaatgtagttggcttgctattgacaaggaagacgtttacactggaattctatattttgagatataccattcctcatagaaaaatttcctcacagaaaatataaaggtggaaacaaatcacaagaatcgaaccatgtagagagacttagttgtcttttaacagaattgggcacgggctgttcagaaacaacaatctttcacatccattataatgatagcattagtgtagtttgtttagcaaatgtttactgcgagcctgttatgtgctgagcctgctatgtaagaagtgtggctctctggacaggagacagaatactaaacaacacaactactgatctttggctgcctggcatgcttcctcacttcatatggtatcagcaatttagcaccacaaacgtcctttagagaaccagccctttctcattcttggttctagtggcttgagtagactgaccccagcctacccaaagtggatttgactcctagcaattcattaatctagcccaataaaatgtcaagtacaggacttttattgaaagcattcagaaaagaggtggactctcacactaaacatttgtaactaaataagggatgttagaaattctctagaaaggaagctatgataataaatgggttgctagatgggtctagtagatggtggccatgctttgttactgccttgtgtattgtgctaccatagccctccccaaactgtactctggctcctggcatttccgtctcttcaaccagatggtcagctctctaagtgaaggagacacatctccaacatgcttggttctagcacaacagaagggctcaaacacatacctgctaaagaaactatcctgatggatttagcagcatggccatgaggcattggcggttctatcactgggaactcaggtttctggtgctccagtacctctactggctgataccacatcctacaattcacttcataggcttgggttcctgctctgggctgaataggtggtccactctgagtcatcagctgtgggtgatgatgtggtcactgcatgattctcacacaagcacccagaggacgtcatcaggcagaggcagtgggggtgggcagcatttacagaaaatctgtgatgagacaccacaaaaccagaggggaacatgaagtcactgagcctgctccacctctttcctctcccaagagctaaaagagagyaaggrggaaacaacagcagctccaaccagggcagccttcctgagaagatgcaaccaatcctgcttctgctggccttcctcctgctgcccagggcagatgcaggtgagtgaccgtctccaccctcgggggcccaaccccatcccacaggtctcctgccctttctccacattcctgatccatctatctaccaggaatgttctgaactccagctcccattctaccaagaccccccaagtgtgatgctggataagctatcagcaggaatggcagagcagcaggccattctcaagaagagccagtgggtactatcccttccccagagcccacctttgtcacctggagagtaggactttcctagaagtaaatggcagaggatgggaaactagaaaagagaaatattaaattattctagagtaggcctggcttctgtttctgggataagacaggtgcttctctcactgtctacttaggagagaaacccagagctcagctgacagcagaattggtacaatcactgtcctcagaacactgttaatgtgtttgctcagtcccattctccaactctgcttttcttccctggcctttggtggctcccctctttccaaggatgaggcactacggcaggccccagcttccctgctttctagaattccaccagcactgctctaccagccctcatccagaggctaactggagccagtccatcatgcagccatgaacatttactgggcacccactacatgtcaggctctaggaaacaggatatgacagtatctagatccctccacttacaccctggccattagaaagcagcactatcctagacaccacaggactcataagggtcttggaaactcacctgaaacaaagcaaagtcaggagaggaatgatcaggagcctctgggatttcactgtccctaagacaggtatgctcgccttcaactacatatggaagaaagatttacagaccaaagtctgctgttcttccctttttcagagcaggaaattgaagccccttcctccaggccactcccaactccaggctatcccaggctcccaaatgcccaggagttctggagccactaagcaggtgcccacccagcagattccatgggtgcccacaagcagacagacttttccttcaggggagatcatcgggggacatgaggccaagccccactcccgcccctacatggcttatcttatgatctgggatcagaagtctctgaagaggtgcggtggcttcctgatacragacgacttcgtgctgacagctgctcactgttggggaaggtgaggagcagaaaacagcccacaccctcctggaaacactccacagagacccctgccttcttcccaaggagctccctgggctcctgtgaacacacatgccaggaggtctccttagagggtgagaaaagggcagttaagtttgtggagagaggggaaggttggttccagaggtgctgctgaagtaagaaacagcagagtgaccaagcctgccatatttagaactgggggcatactttggcataagaatacaaactgaagcaattccacctgtgtttctagggggaaccgaaccctgagaaacctggtgcaattaccagaattccaattcctggggaccgactgtccccttaatttcccctcagctgcagccctgccccagctgtcacctgctcttcactgtctctgggctgtatacmctgtgactccacccccatcctcactctgctctctgtgcagctccataaatgtcaccttgggggcccacaatatcaargaacaggagccgacccagcagtttatccctgtgaaaagasccatcccccatccagcctataatcctaagaacttctccaaygacatcatgctactgcaggtgaggcacactcctgccactcttgctcttcttggtccagttggttccactccccctggaatgccggcccttccctcctttccatcctggcctcttggttagttcctatgcctcagaggagagggaagattgygcagccccatcactgtgtcggggcccagaagttcgttggctgacctggactttcttgcctcttccccaccagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgygaatctgacttacgccattattacgacagtaccattgagttgtgcgtgggggacccagagattaaaaagacttcctttaaggtaagactatgcacctgcctggattggctcttgggagaaagatgtttggggaatatctgagacctggagactcaagtagtgggggactccttcacccactagactgtgatatttctctctggaaagagaaraggggactagactgagctggggagaaattagggcctctgcaaacttaccargaggcttatggtggatggtgcttctttggaaggatgaatttgcaacactccacccactccaggtcacagatattaggaaactgtgcccactgggggtgcagtaattataaccaggtgtgtcttcagaggctggtacccaacgtggttaatgggctggtcctccatggtggacatcagccctccttgcccacttctgggtccttaaacagccaacggtcccacatacctccgatctcaggayctgggggacatgayggaggctggsccctgggatgaggtgaagcagtaacaatgtccagggccagagcttggcagctgggggccrccagcggcctgccctgccctctggtctcccacatgtaggctgtgcaagttggccttttctaaaagggggcttgagatggaagagagggcaggacccggaggagcatcagctcagtccttccactctctattcacagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgcyactaactacaggaagcaaactaagcccccgctgtratgaaacaccttctctggagccaagtccagatttacactgggagaggtgccagcaactgaataaatacctcttagctgagtggaaaagctggtttcttgtttattcattgaccctcattctcaggcaccacatctgtgctatgcaggccaatgacacaattttgctgttttctgctttctcctctcccctcaccccttgccacctccccaaacccccacatgaagctgatactcagctccttcctatccacaccagtttctccagggcctgcccttctgccaaggctgaagctgagcaccatcaggagacaacatggaccactttggtcctggggctttgggtaaacttcttacctccttctccagtgttacatgacagagaaaaaagggataataccatgggacctaactcctcatcccccactggggctcctcattctcccctgggcttagtttctctaccctcctctgagctcaaggctcagctcgtcctccagcctcttggctgccccttctcttcatccctgctgagtgttctcagaatccaccaactcttgtcctctccagaccacactgatctgatctggcccctccctcatatctacccacctaagatacccagagacccatgtggttccataagggccttgccactgagacgccagcccatctcatgccctggcagagaggggcctcagaaaaaccaggcctgtgtggcaaccaggtaagacccatggaggacaaggctggcacggtctctctccaacccttggctccatctctcccctaggtagggccagctcaacccctcccatccagcccagtgtcctcccatacactcaaggttcactgcccacctgggcagtcagcaggctgagcccctttaaacctgttcctcttggtcactgctggcctctaggctaagattccctgctagccacctgggctacatcagccctttgagttcaaaaggactcctttctgcagaaggactagaaagcacaatcttttctatcaatcaacaaacaaatactcattgagcacttactatgtaccaggcatagaggatagtaagagaacacaataacagactctatcatctgaacccaagtgaaactgacaatgttgagaattttcatccaaattgtttcactcactttctgtccttcagattagttcacaagagcgagatgtatatggaaatccatgggattaaagtatttgtatcttatttttatttctggtttttctgaggcccctccctgccagggcatgaggtgggctggcatctcagtggcaaggcccttatggaaccacgtgggtctctgggtatcgtaggttggaagatatgagaaagaggccagatattcacacagtttgtataagtattgtcacgtgcgaccccagaacagcaatgtatgggatttgaaaacaactttaatcatttactttctagacatgaagttgtcaaactgttcaatggagcgtcatcttcacctagggggaagagtagcagggcaggaagaagacaactagggcaggcttattttcatttgtttaaaaagtagcaaggatgaatgtcattataaagattcaaattgtaggaaaaacacccatttgattggaccactcagaagcataatccctgtcattatacaggctcctgcctgtacagaatgaaactagaatcaggaaggctcacgcaggctggaaaaatggaacaatgcctcgaatgtttaggccactgattactgctacattcatagtttccagaactacctggacttgtgaatgttaggaagttcttggcttggaggccaccgatagagtatatgacatattgttgaataagggttgcccagtgttaagctcaccctgccaaacactcccagcaaccacctctccaaggtcttgccactaatatggagtactgcctgggagttgaacataagtactagctctagattaatgcttccctgtctcaaatatacacagctacactcttgtggcatggagtaaaatctccctctaggatcatgtaactgtcaaagttgcgccctttctcatctcagtgtgcacaaagcatgctgcaacacaatcctttttttttttttttttttttgagacagagtttcactcttatcggccaggctggggtgcaatggtgcaatctcagctcactgcaacctctgccccctgggttcaagcgattctcctgcctcagcctcctgagtagctgggattacaggtgtgcgccatcacacccgactaatttttgtatttttagtagagacagggttttaacatgttggccaggctgttcttgaacttctgacctcaagtgatccacctcgacctcccaaagtgctgagattacaggtgtgagccaccacacccggccgcaactcaatctcttaataatcttgggcacttttataaaataagtgggtgtcacacagcttctgatttggagctggaaaaaaaatccctgcacctaagacatactaatgacttggttccttcattggaaaaggaaaacacaggcagcaaaacaaaataatagtattttttaaagttgcctggtcacattcataatcagtttaggtatgatacttactttggggaaatggttctgtggtttaaaacaggcttgaaaatcattgttgtaggactttatccacttctgagcaagaagaaagaaacaaagtttcaggaaagggtagtgactgactgaaaatatcacagaagttaggacagagcctgaacagagcccatgccccctgacaaccaggccagaaagtagctttaaaagtcttctaatgctcaccccaagatgactttctggaatctccagacaagaattaagtttatgctcagacgcctccctggaaagaaagactttgggcttctccagcagctatttagtgagaagtattcaaagcacttccctttggtaagctgaaatctgtccacaggtgcatttgggtggactcagaggcaggtaagtactttaaacatgctgactgcttcaaatctccttggtctgtggaagtttcccccccaacccctaccatatgaagaaataatccttcccttgcttaaaatctctctagtgtccctactgactctaggaaaggaaatgcctcagcccactgagatctactcccaccatccctcttttcctccagggccacaggaagaatcaggtcccagcacagtcaggaagagaactgccaagtgggctcatggaggagatagaccccaaagaaagcaaaatcttgctaagttgtttctgggaatatgtattggtgtgactgccttcccagcccaccaccatgcttctcccagtaccactctttgtgaacttacacagcttatagggtttacttcttatcttggtaacccacacaacattgcttttgaccaactaacatatgtcaccatggcagcaatgtgtttatggaccataacacttagaagtagctgacctgagagaattgcagaatagcgtactgaagactgaaaataatgacagctgagaaacagctaccggcaagattgggatgctgtgctacaggatgtagcatatgcttttttttttttttttttttttttgagatggagtctcgctctgtcgcccaggctggagtgcagtggcgcaatctcgactcaccgcaagctccgccttccgggttcacaccattctcctgccttggcgtcctgagtagctgggactataggcgcccatcaccacacctagctaatttttttttttttgtatttttagtagaaacggggtttcactgtgttaaccaggatggtctcaatctcctgaccttgtaatccacccgcctcggcctcccaaggtgctgggaggatgtagcatatgcttttaagcaataataaatatacaatgttggttctttcatagctagaatacattgttttggaaacagggaatgtttccaaacattccttgcccctctgattaggagttacaccataatcttgagctttactggtctagaggtctcaattcctgagaaagaagtcaacagtcagataagtaggttactttagtagctgggtgattaatcctgattgccatgggaagatgggattcactgagatacctcctaatatttccatgaccattagtgaaggtcattggaggactactgtagcccaataagataagactactaagaccctttaaaaggaaattttgaggcactacaacagataaagaatcataccagataggcttcttgagataaagtcttctgcacagcttctcagagatggtataacacccacccgcataatgacttcccagcctccttggccaagagcccttccaacctctactcagatacctccttagagagagatcctgaggtcatcagactcacatgccatgacagctgagctgagatctgcctacctgtgaccatcactatttacaagacgagacagtggaaaacttgcatttggatacaagtgtgtactgagggatcccattctccttgatgtactaatttttctttaaaagtgataataatagctcccatttagaatttttaaataacacaacaaatgtaaagtaactaatgtgtcctctggatcatggtaagtaatgaataaatttaactccctttaccttctccctttgctattttttccatgctaggatttatacatttttaaaaaactaaatctgctatcaaatgacagctttaaatttactttttaaaatttgttattgtatatatttatggggtataaagtgatgttatgatatatatatacacaatgtacactgattaaatcaagccaattaacattttatcatctcaaatacttaacattttttgtagtgagaacatttgaaatttacttttagcaatttcaaaacatacattattattattaactatagtcaccatgatgtaccatagatctttaaaaacttattcttcctgcctaactgaaactttgtactctttgactaacatcttttcattcccccacttcccagcctctggtaatcaccattacacactctgcttctatgagttcaattgctttagactccacgtaataaatgagatcatgcagcatttggctttctgtgcctggcttatcttgcttagcatggtgtcttacaggttcatccatgttgcaacaaataacagaatctcattctttgttaaggctgaatactattccattgggtatatataccacattttccttatccattaatccactgatggacccttaggttgttgattccatatattggctattgtaaatagtgcagcaatgaacatgagagtgcaactatctcttcaatgtactgatttcgaatccttcggatctatctcagaagtgagattgcaggatcatataattctacttttagtcttttgaggagctccatacagctttccatatggccatactaattacattctcatcaacagtgtacaatggtttccttttctccacatcctcaccaacatttataattttttgtctttttgataatagccattctgacaggtgtaaagtgatagctcattgcagttttaatttgcattttttgatgattagtaatgttgagaattttttcatatatctcttggccagttgcatgtcttctttggaaaaatgtctattcagttcctttgcccattttttaattgggatttttggtttcttgctattgagttgtttgaattccttatatattttggatataaatccctaattagatttaaggatcacaaatactttctccaaacaaagcctccagctttattctttttactcaagagtgccttggctattagaatttttttacatatttggctgtccttgggcagcctccatgaggtggcagtcacaaagccatatctccttgtatgtgctgctagaaaattcttgagggttggttcctaacagactcacagggttgcattgccatattaaatttacacaaactattcattttcaaacttttagactcagaaaatttcatcaaaacatcaaggtcagagacataagttaggctggacttacatgag

SEQ ID NO: 12412 - DNA, 19079 bp, Homo sapiens
ataaaatactttacagacaagcaaatgctgagagattttgtcaccaccaggcctgccctaaaagagctcctgaaggaagcgctaaacatggaaaggaacaaccggttccagccactgcaaaaacatgccaaaatgtaaagaccatcaagtctaggaggaaactgcatcaactaacgagcaaaataaccagctaacatcataatgacaggaccaaattcacacataacaatatcaactttaaatgtaaatgggctaaatgctccaattaaaagacacagactggcaaattggataaagagtcaagacccatcagtgtgctgtattcaggaaacccatcttacatgcagagacacacataggctcaaaacaaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatataaatgcacccaatacaggagcacccagatcataaagcaagtcttgagtgacctacaaagagacttagactcccacacaataataatgggagactttaacaccccactgtcaacattagacagatcaacgagacagaaagttaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagcactcctcagcaaatgtaaaagaacagaaattataacaaactgtctctcagaccacagtgcaaccaaactagaactcaggattaagaaactcactcaaaaccgctcaactacatggaaactgaacaacctgctcctgaatgactactgggtacataatgaaatgaaggcagaaataaagatgttctttgaaaccaacgagaacaaagacacgacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttttaaaagatcaacaaaattgatagaccgctagcaagactaataaagaagaaaagagagaagaatcaaatagacgcaataaaaaatgataaaggggatatcaccactgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaatgacaggctctgaaattgtggcaacgatcaatagcttaccagtcaaaaaaagtccaggaccagatgcattcacagccgaattctaccagaggtacaaggaggagctggcaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaacagaatccagcagcacatcaaaaagcttatccaccatgatcaagtgggcttcatccctgggatgcaaggttggttcaacattcgcaaatcaataaatgtaacccagcatataaacagaaccaaagacaaaaaccaaatgattatctcaatagatgcagaaacagcctctaacaaaattcaacaacacttcatgctaaaaactctcaataaattaggtattcatgggacgtatctcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaatgaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaacatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaacgccagaggcatcatgctacctgacttcaaactatactacaaggctacagtaaccaaagcagcatggtactggtaccaaaacagagatatagatcaatggaacagaacagagccctcagaaataatgccacatatgtacaaccatctgatctttgacaaacctgacaaaaacaagcaatggggaaaggattccctatttaataaatggtactgggaaaactggctagccatatgtagaaagctgaaactggatcccttccttacaccttatacaaaaattaattcaagatggattaaagacttacatgttagacctaaaaccataaaaaccctagaagaaaacctaggcaataccattctggacataggcatgggcaaagacttcatgtctaaaacaccaaaagcaatggcaacaaaagccaaaattgacaaatgggatctaattaaactaaagagcttctccacagcaaaagaaactaccatcagagtgaacacgcaacctacaaaatgggagaaaattttcacaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagttaccatctcacaccagttagaatggcaatcattaaaaagtcaggaaacgaggtgctggagaggatgtggagaaataggaacacttttacacttttggtgggactgtaaactagttcaacattgtggaagtcagtgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaacgatagactggattaagaaaacatggcacatatacaccatggaatactatccagccataaaaaatgatgagttcatgtcctttgtagggacatggatgaaactggaaaccatcattctcagcaaactatcgcaaggacaaaaaaccaaacaccgcatgttctcactcataggtgggaactgaacaatgagaacacatggacacaggaaggggaacatcacactccagggactgttgtggggtggggggaggggggagggatagcattaggagatatacctagtgttaaatgaggagttaatgggtgcagcacaccaacatggcacatgtatacatatgtaacaaacctgcacattgtgcacatataccctgaaacttaaagtgtaataataataaaatttaaaaaaaagaaagtaatgcaaaaactgcaaaaaaaaaaaagaaaaagaaaagaaaatgggcataacacctacttcctaaagttgttgtgaagcttaaattggaataaattagctaacatacgtaaacacttagatattgcctggcatatgataggtgctcaataaatgttaatcttatacctcaggtgaatttgtgactggccttttgctttcttgggaggagagacacaggcattataaatttcacctgtccatgtggtttgtactcttcctttcttctgtttagcaaaatgcccttttaaaaagtcccaaccttgcttcagttgaactgatgggcaaatgtgatttcccacacctgagctaggggatctaggctctcagactgccctgagagctgtgctgcagaggcctggccagaaccctcagagcagctccggactccttcctctgtcactcctccacattcaactagaatcctatgtctcccgagttgaccctgttgcaaatctgtgccccttttcatttgcatgggccctgccgaaattcagaagcttagttcttcccatgactataggggcctcgggcaggtctcttgctctgtcaaggtcaaaacccctactttcctaaattcaaccattgattctccatcttcatcttacttgatcagccacacttgacatagttgatcacttctccctttaaacatcttcacatggcttctgggaccttttgttttcctcctacctccctggccactccttttcagactcctttgctggtttgctctcatttttccctaacctttacatgttgatatgccagagcacctcaaacccttagacctcatctctgctactcgtgctcccatggtgatctcatctagtctctggtttcaaacacagagtgatcactcctgtacttgctgtttcccttttcctggagttctctctgcctcctgcaggtaggaagtgattcgagataagagagggagagaactcttctggccaggatagagggtgattctgagaaggcttcaaggaagaagtgagcatttgagcacggctacttgaggaaggctaggccatggacattagggtgcaggcaggagcagagcaaacatgcttgtaaaaggaacagcaattattctgttttatatttatatcagcccatggtggcccccacagcagagtggcttgatctctcacctccttcaggtctttgtttaaagattaacttctccatgaggccttctatgaacataacctttaaaaacataaatccccttcctactgggactcccccagttcccaccctgagaccccctatctctcttctcgattttatttctctccataggatgtgtatcaccacctgacttactagctatttactatatattagtttatttcttccccattagaatgtaaacttcctgagggcagggattttgtctgttgagttcagttctgtatccccagcacctaaaacagtgcctgtccataacaggcatgttaaacattgttggacagatgaatgagtgaatgaaaaatggtagtacctttcctcctccagtccatcctacacaaagaggcaagattaatttccctaaatgcatgagcattaggaagtgggagggattggaggaggaaattataataaggaatccataaattacttaagcccataaaacaaaggtaggaaacattcaagataagagacctcttctggccaggatagaggttggttctgagaaggcttcaaggaataggcagacatttcagcaaggctgctgaggaaggataggctgtggaaattaggatgcaggtaggaggatcacagagcaaacactccaaggtgggaaatgcaagtgtgtgtagaaggaacagcaagtattgttgggttgggctggcttatgaagttgtgacgggctgagggagagacaggactggaaaagcacgttggggtcaggttgcagaggtccttgactgacagagaggggagcttggtctgtggggaatcttctgctctgtgtggtcagaggctggtctgactctccggccttgccccagtcttcctatccttcatccagccccggctggctcggtaaaaacggcgcgaatctcgctctccctgggtaactagggtccccactgcctggctagtggtgcttttcgcgtcttcactggcaccattaatgaatgaagtctggctcccacccgcggggaagggaggagcctcaacctcgggtcctttgctctcctgcascactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtmgggtataaagcccctcccgctcacagtttccctagtcctcgaaggctcggaagcccgtcaccatgtcgtgcgagtcgtctmtggttctcgggtactgggatattcgtggggtgagtgccgtctcaacggtagagccgctcggtcaaagagactgacgcggagagggcgggtctctgggtccgcgatctccagcaggagcagctctacgcgggagccttttcgagctgccgagccacggatgtcgacccctgcccagcctctgggatcgcgggccctgtggggaggggcggaggagaccacgccggagccgggcctaggggccgcttaaccaccgccccggcaggacgcagggactcggcagccccgggccggggaacgttagcgggcgggggttgggaatgggtgggagctgcgcagtcgctgaaccgctgtcttccccagctggcgcacgccatccgcctgctcctggagttcacggatacctcttatgaggagaaacggtacacgtgcggggaaggtaatgccgctccgcgtgcccgtgcagccaagctggccctccacctgccctggtcttcttacgcccagagggtggtggcgtcgcgccaaggccgggtgggacgtttgccccaatctgggtgaatagagacacatcctttatctggaactgggggttctctttttaacatagcccaaacccgtcttaatgcttaaccaaatagggctcagaggctcaatggttatgcttttggggcctgggaatttgaggtattgggaccaagtcatttctttagatcttttgctcttgtcaggtggggtattaaggaggttgggtcccacttaattccgtctcttacagctcctgactatgatcgaagccaatggctggatgtgaaattcaagctagacctggactttcctaatgtaagtggctttagtagaggtggcgggcagaagggaaagccttcaagtatatccatccttgcctctctcctgcctggtacagaaggatgcaaaataggggatcttaaccyggatagaataaatagaattcaggggtccttgaactggatggatatgtattttcattcccattaaccactagcaaaagttatttccttttattgtgaagagagacaataagtgacattggttattagccatgtctgtcactttgtcactagtagaaatcaggtattttcttttttgtgtgtttcttgttcttttgttttgagacagtgtctcactctgtcgctcaggctggagtgcagtggcgcaatcacagctcactgcagcctcaacctcccaggctcaagcagtcctcccacctcagcctcccaaggagctgggactacaggcacacaccactatgcccagctaatttttgtatttttgtaagagacggggttttgccatgttacccaggctgatcctgaacttctgggctcaaacagtcctcccacctcggccttccaaagtgttgggattacaggcatgagccactgtgcccagcctgaaatcaggtagtttcatattctataacatgcgttgcagatattttaagtgatatttatatacatgtaagtaaatatatacatataatgttatttactttgagattatgttagtcattacatctgcttgctatttaatgcactaataggcacatgttactcttatttgaatttttaaaaatattttttgattgtgtaaattatctattttgcttcatgcatttaacaactttattctgagaaaaggtccatggcatgcacatacactcacacatacacacaccaatttaagaacccctgtctagaatcttgtggacccagttgctaccttctacttattttcttttttctcctaacacagcatcttctcactcttgttcactgccctgcaagtgttcttttcccctggagagagaggtagggaatcaagagagaggcaggttgttcatttgtcctgtccttttcctttcagctgccctacctcctggatgggaagaacaagatcacccagagcaatgccatcttgcgctacatcgctcgcaagcacaacatgtgtgagtggggtagggctggtgagggaccccaggctggtagtttgtctgagagtggatgatgccaagggtgatttgttgtcatttggcctacaggtggtgagactgaagaagaaaagattcgagtggacatcatagagaaccaagtaatggatttccgcacacaactgataaggctctgttacagctctgaccacgtgagtttccttagcacacatctgctgaatggmgtatcagaaaaaggggtatttaggaacccaagggttatctctgttccattctgctgctgctaccttcccaccaatccagattgttagaataagaaacagaacttatattttttggtttgttttgtcatgtaattctggtgctggtgcctcttctttctaaactcctctttccccaccctgccatcctcaagtgaaggcaatgagaacccacctagagaaggggctactaagtgtccatcactggcctgtgccctgattaactacaaagatgatcaccactattctcattctgttttttcctctcaggaaaaactgaagcctcagtacttggaagagctacctggacaactgaaacaattctccatgtttctggggaaattctcatggtttgccggggaaaaggtaggaagaagggaaaagaagaggatacttctctatctctgcaggctactactcctcagacctaagcatcttattgcttttcttctagctcacctttgtggattttctcacctatgatatcttggatcagaaccgtatatttgaccccaagtgcctggatgagttcccraacctgaaggctttcatgtgycgttttgaggtgacgtttcctgcacctttctcttataaaaacactcacaggctcccctgggacctgcaggatcccatagtggaggattcttccccggcttttgcctaatgggatcaatggttggacacctctagacctttaagtcttgggaagagcctaacttctataccttgraggcactgtctacaaaaaaatggaggaggtagacgcaggcaacacgtgaatgttgctgttctggtatgcatctgttggactgggttggggtckttataagatttggtgtattttcctttcaggctttggagaaaatcgctgcctacttacagtctgatcagttctgcaagatgcccatcaacaacaagatggcccagtggggcaacaagcctrtatgctgagcaggaggcagacttgcagagcttgttttktttcatcctgtccgtaaggggtcagcgctcttgctttgctcttttcaatgaatagcacttmtgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaatgtaagaatttttgtgaccacggggtaggagaagtttctttaaagacgtaaaaagaaaaaaccataggctgctctgcctgtggagtarccattctttattcttttactttttaaaataataacaatcacaaaggaaagatttrccaattgaataggatcaaattctacaacttttcctaaggcacccacaaataaatgacaagtgagacaaaaagcactagtataaagattatataaagacctataaatcattaagacaactgagtttttaaaaatggacaaaatccatgaacaatttataaaatagaaatatagccaaaaatgtctaaaagatgtttatgatgtaaggaattatcaattacaacagtgagaaaccatatttccttctatccgatgagtaaaaagtttctaaagtgttggcaaggcttaggaaagtgatatgcatttcctgctggtcaagttgtaaattagtatagctactttggaggacaattgtaaaatttaaatcatatcctatgacccagcaattccatgctataaaaactcatccatggccgggcttggtggctcacgcctgtaatcccagcactttgggaggctgaggtgggcagatcacgaggtcaagagatcgagaccatcctggccaacatgatgaaaccccgtttctactaaaaatacaaaaattagctgggcatggtggcatgtgcctatagtcccagctactcaggaggctgaggcaggagaattgcttgaacctgggaggcagaggttgcagtgagccgagatcacgccactgcactccagcctggctacagggcgagactctgtctcaaaaaaaaaaaaaaaaaaaaaaaaaaaacattcaaagagacatatactaagatgttcactgtggcattgtctgtaatgacaaataagtggaaaccgtgtaaatacctgtcaatactatggagtaccatgtggcaacggaagaatgagactgaactgtgtgaactaacatgcaaagatccccaaaacaggccaggtgtggttgctcacagctgtaataacaacaccttcagaggctgaggtgagaggatcagttgaggccaggagtttaagaccagcctgggcaacatagtgagacccctgtctcccaaaaattttttttaattagctgtgcgcarttgctcatgcatagtcccagctacccaggaggctgaggtgggaggatcacttgagcccaggaatttgaagctgcagtgagctgtgttcttgccactgcactccaatctgggtgactgagcaagaccctgtctcttaaaaaaataaaaaagatctccaagcatagagaagagtctggagggaaacaccaaactcataacagtcttactgcaggcaagtgggataaaggcccagactccatggtggaagttaaagggcatttccaagttaaggctaagacttgcttttctaactaagagaatgtgctcatgcattgcttgtgtagtagaaactagtttttagaaaagaaagcaaacttaagaaacactgactcctgtggagatgacttggcaccactctcctttcacagagcagagtctgaatagtcttcagagataggcctgtgggccagattgccatcccctatggaccagaagccaaggatctctctagtgatggtcagagggcccaaatggcagggatacccagtgatgtcaggaggaatagtrcagacagaaggtgctaagcagacaattcaactgccatgttttgccaccccctgtgagcagggattaggtgttcaggccagtatcttgggcatgggggagcctttggccagaagaggtataaagctcagaagtttttcagtctgataactattgatataatttccatagtgtgagggagcggtatgctctacccttgtgtatttaaggcaggacagagaaattgaggatgcccctggggctagatcgatgatatgaccagaaatcaaaaagggaatgcattatttattgctgtgtaacactgttaagagaggaggtagttaagggatggataggcacatagagagggaaggtctcaggagaagggatagaaaggaactatgttcacaagaacaacggcaagacagtgcctatactgcctctacagttaataggaaaaacggaagaagttacccttaagctaggatgttgctcagaagtgaccatcccaactttggtgcgggcacaataaatcagcctaaatgtccctaatttaacccagctcrttataatgtcattaaacatgacattagcattgtggttttagcacccccatgggttttgcttaggcactcatgggtaataaccaagatggagtccctttggcaaaacttaggcatgcacagctgtagtaccccaagaagaaaatgttacttctctcatctgggcaaaacccacagaagacttcccagcttctgccacataaaagacacagaacacagacgccttactggcaacctgctttcaagacccctgtctttgctgagagctttcctttttcccaataaattctactctgccctactcactctccatgtccatgtgcctaatttttcgtggtcatgggacaatagcctgaaccttgccatactccaggggcaaaagaagacttctacactattcccacaaatttagcagctaaaacaatacatgtttatggtctcaaagttttgtggattaggagtctgggcacagctgaactgggtcctctgctcagggtttcatctgaaaactgccatcagtgtgtcatccagagctctgatctcatccccaggctcagtgggagaaggatctgcctccaagtctgtgtaattgttgatagcgtcagttctttgttccctgtgggacagaggccctccatttctcattggctgtcggctagagccaccttcagttccttgcaaaagggatctcctcaacacggccacccatttcaccaaagctagtaaaggagtctgctggaagaaggaacactacagtcctatgtaatctgatcacagcagtgacatcccatcacctgttcttattctattagaagcaagtcaccggccccacccacactcaagggcatgagtaccaggaggtaggatcatgggggccatcttagagtctgttcaccacaagagaagaaggaaggaaacaggagattggtcctgcagtcctatgagaaaaaaatcctgggaaagacagatgacaggagaaagcagcaaggtagggaatgagcagtttgcaagggagaagtttaaaaagcccaggtctgcaggtgaaatgtatttcacatgaattccagatggacagatcacataggcaaatcacgtttcaattttttttaattattatgtttgttagtgaaaatccactcaacagttatgcaaaacctggaccttactggcccagaaagcagggaaggccactgagaggaacagatcctttccacaagagaggtggatccccagttctcaatcagctcccagctctaactctaatataggccaagaaaagaatgccgtaacaacggctgccttcaggcaagtggcagatgcaggggggtggctggggacacatccaaggcacagaggcacaatagtgatggctttatacaagtaccatcagtaagggcttaaaagaaaacttgaaacaggtgcattagatttggtggagcagttccccaaaagtatcagggaaattcatttgtattcattgttgaaggttgagcaactgggcgtttctagttcagaaagaaatagcttatgtgattaaatgaaagtttgttatagagttgtttcactgttaccagggaaaggagagagggacagggataggcatggacacagatctgcctttaaagccagtttaagaagcacttatgaaaacacctggactgtgtatagagattgcacattccttatccttcagctgcaggacaggtggagcaaatgaaccacgcagaaaaagaggacttagggagttcagatggatggtgggggaagggaatgaaataaaattcagtgggtaatctttctaatgtgtaaatttgttcatgtcactcccctgcttaaaggcgtttagtggcttctaaaacctcaggaaaaaaaactgtcttctcaggcttaccttcacagcctcacctctgctccctttccagtgacatccttggcatgtgccctcctcctgctgccctggagcacggggtccagcctttctgaatttccaagggagcagcactgtgtggtgctcaggagcatggactccggagccgggccgtctgggttcagatcctggctttgcccctggtaaatggtggcctcctgtgctcagtgtcttctttgataaatgaaccctccctcacaaggttgttatgagaagggaggagaccacccctcatattgtcttatgcccaatttctgcctcaaagaaaaagtaggagttaaagaaaagacagaaatgaaatcagtagttagcctggcactgcattccaggcctggtagttaaagatcaacccctgacctaactggttctgttatctatagattccagacattgtatggaaaagcactgtgaaaatccctgtcctgttttgttccattctgattaccagtgcatgcagcccccagtcacatatcccctgcttgctcaatcgatcatgaccctctcacacggacccccttagaatcataaacccttaaaagggataggaattgctcactcagggagctcggtttttggagatgtgagtccgccgatgctcccagctgaataaagccctttccttccacaactcggtgcctgaggggttcttgtctgtggctcgtcctgctacaatgagaatgaagtcaatatttctagagcacttgggccaggcgtggtagctcacacctgtaatcccagcactttgggaggtggaggcaggtggatcacttgaggtcaggggttcaagtccagcctggtcaacatggcaaaaccccatctctactaaaaatacaaaaattagctaggcatggtgatgcatgcctgtaatcccagctactcgggaggttgagacaagggaatcacttgaatctgggaggcagagattgctgtgagctgagatcacaccactgcactccagcctaggtgacaccgtgagactctgtcccaaaaaaaaaaaattttagagcacttgaaacagatcagtgttacataaatttataaatactaattgccaaaaagcaccacattcacttttatattttcacactttaatacatgctgtcccctctgcctcttgcttttcccccaactcccttagccttcaaatcagatttgaagtcacatctgataatccctgtggtgatggtcaccaaagatttctgattgttttcccattgggaaaacttcatgacactctttaacttaaatgtggtctcctgagttgtttggccaattaaacacaagtagaaattacacacattttccaggcagaagttttaaaagccagtgagtaagtcactgtatctgaccaccacagttgtctagactcagagcaggtgccaagttaaagcctccgtcggcctaggtctctaaaagactacgaatagcagggcccctgttgatcacatccgacatgaagggtaagtaagaaataagcgtgtattaagccactaggatttggtttatcctgactgacatttctctacctcccacaggctaatttaaatgcacatattttaaatttttgttcccacagggtacaatgctttcctcgatcaggacttaacacacaactccagttgttcatttagatgttagtctttgctgctaaattataagttgcctgagagcagagactatgtcttatgcaaaattttatatttagtgcttgcacagagcctgacacaaagtaggcactcacaactgtgcactgattcctgtcatttactgagaattggaagaaaaaaagaagagtttgcttgataggtaaatgcctaatgccctcaaggaactttaaaaaattcctctttgttttgactgagagacagaacccagaaaaacagaatgccctgtcttaaaacagagagagttcaggtagaagtacctggagtcagaactgaagttcgtattcagggaggtctcagaggatcagcaaggcactgaggctggagagtaggttatatgagtttgtgaaaggaaaatatcttgagcccccaaaatcagtaagctaaaaagaaaattcaaactggaaactgctcaggacaaacctacctcccattctattcaaagccatccctctgctcattgaaatagatgcatattctgattgcctcctttggaaaggcctatcagaaattcaaaagaaggaaaccatctgtctctcacttacctgtgacctggaagcccaaccccctcccccctgctttgagttgtccccacctttctggatggaaccaatgtaccacttacatrtattgattgacgtctcgtgtctccctaaaatgtataaaactaagccgtgccccaaccacctggggcacatgtcatcagggcttcctgaggctatgtcacagacacacgccctcaaccttggcaaaatagactttctaaattaactgagacctgtctcagattttctgggtttacattttggtaaccatgaagggattctgggtgaagatgcccctgacctttgacaaatgtcctattggtgcttggtaccagcatgagctaactttacggctcaaaccaacaggacaatttgctgaggtctgagagcaccccctgcagagaatccctgatttccaaaaatttggttgagatctaaaatttattttcctgtacaactcctcttttctttggaattttacttgcttccaacaaggaaggcaagttttcctgcttccatgatgatggaaggcaggaaactccttaatggagtttgagctagcttctaacagggaagatgagtcttttttttcctgcttctagaattgtagagagcagtctacagcctgagacacaccactaggtaagaaactggtctgggattctgtctggcaaattatttttaaatgactaaagttagcattaacaaccagctggtgttaatttctgcttacacttagagcattcagaaatcatttaatttgtgtgatcattgttagttttgcttaagtattttgttgtttgtttctgtcttgttgggttttgtgtgtgtgtgtgtttcggtcctttccttaccagatttgaccaactccaaaccctatacctcatgagtgtggaatcttccactctgaagaaataagagcaccttgctcccctgagcctttaggggcattctcaggtgactgagaatcacgtgagggtgtctgggaggaacgctccctagacctgcagcggctttaaataggttttcccctcaggagaacattcttagggcctaatctcagccagcaggtgcaatataaggagctggctccgcccgcaccttgagcccctggcacactgtgccaggtagctgcaacacaggtggaccaaactggttcagggtgtaacggccctgaaaagctaggtctgcaagcagcacattttgggtccaacacacatcctgacttggtcaaatccgaaggggaactctaaattatgggtaacaagccactgaagtggctaaaatacccacacacacaaaaaaaggtggtatgggccaggcgtgatggctcacacctgtaatctcagcactttgggaagccaaggcaggcagatcacgaggtcaagagatcaagaccatcctggccaacatggtaagaccccgtctcttctaaaaatacaaaaattacctgggtatggtggcacacgcctgtagtcctagctactcaggagcctgaggcaggagaattgcttgaatctgggaggcagaggtcgcagtaagccgtgatcatgccactgcactccagtctggtgacagagcaagactccatctcaaaaagaaaaaaaaaaaggtggtatggtggggggagaaaaatggccagcaaaaggaaacaaaaaaagaggaaagagaaaaggaaacaaaaaaagaggaaagattttttattttgactattaaagggactttataatgtaacaaggccacctttttgccagccagaccaaattgaaagcattggctggccccccacactgcagttcaatagctaaggttctgccttctttttttctactatgacacgtttggttcctaaatcaagcccttgctggtttgatacttggtacttctgaaatagcagcaatttgtcttagctgaaatatagtaatgagatttaaaaatatttttttaaaaaggagctcaatggttaaatgtcagcttaattaaaagctatcatccaagatatgtgtgtgtgcataagtgcgtattcgtatttaaaaggcctttttgtttttgtttttctcttctagaaccttgtatttttttgagcaaaagttttttttcttctgagttgactgaattctgttttcacctgattttttaactaaaatatttattgcaacagaggc

SEQ ID NO: 12413 - DNA, 38449 bp, Homo sapiens
  misc_feature (1)...(38449): n = A,T,C or G, or insertion/deletion polymorphism (see Tables 1-2)
caaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctggggtgctagtgtcagcagaacctgatggggaagtgaggtctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggtagggagggtgggataggcagcggcattagatcrgaggaatgagatggacagacctgggctgtgggctaggagggcagtcagctggcctagggtagcccgggctggtgtcagggtaaggagaggaagggagggatgagggctgattaatttttttcaccccacaggaggaaaagctttcrgactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgatttttttcctgggtttgggaaggagagacaggtcttgagggaaaggtggcaaggatttggccatatgaacaatccatcaacaacgctatagtgtgtccactacagcagatggtttcacgcaccaagggggattccagctgtgtaagacagccttaacctcaaagaatgcaggcaggacaaaaacacatgtccaaacaaggtactcaggcccatgacagatttcatgaagagcaaggaataccatgaaccaacattctccaccactataagctttgtcactttgacaaatcactcagcctctgtgaggcttttttctaaaaatggggataaagtgacctatgctattgtgcctgacatatcataagccctcaataatgtttaaaacttgaatgagccggggccgatggcttatgcctgtaatcccagcactttgggaggatggggtgggcagatcacctgaggtcaggagttcgagaccagcctgacgaacatgaagaaaccccgtctctactaaaaatacaaaattagcctggtgtggtggcgcatgcctgtaatcccagctacttgggaagctgaggcaggagaatctcttgaacccaggaggtggaggttgtggtgatccgagatcgcatcattgcactccagcctgggcaactaaaaagcgaactccgtctcaaaaaaaaaaaaaccgaacatacaaacaaacaaaaaacacttgaatgggtagatgaatgaaagaactggtgctattaaataaagcaaagaatttacagctgggcgtggtggctcacgcctgtaatcccagcacttcaggaggccgaagcgggcagattacctgaaatcaggagttggagaccagcctggccaacatggtgaaaccccatctctactaaaatacaaaaaattagctgggcatggtggcaggtgcctgtaatcccagctactcgggagactgaggcaggagaatcgcttgaacccgggaggtggaggttgcggtgagccgagatcacgccatggcactccagcctgggtgacaagagtgagactctgtctcaaaaaaaaaaaaaaaaaaaaaaaaagactggaaggagaaactcattggagacaatgactatggacatcccttttaagaattttgctgcaaagggtaacaaaacggtatgtgtggtagccggccggggagaagggagaagagaatcattttggaagtttgaaaacagaagtcatcttaaatcttactgagcctctgactaaaattctcatctgatttctgcaaacttttctgccttcacttttcataatgaataagccgcctcctttatttagccatatcagcctaggcacaggcccccaaactcatgcctccactaatctgttctctgcacctgagatgtacaccttcttctgaaacttgggtaagttctaactcgttcttcatatctatttatttatatatttttgacagatatctactccgatcattcttcatatcatttttttttttttttcctgagatggagtctcatgttggccaggctggtctccaactcctgacctcaggtgacccacccaccttggcctctcaaagtgctgggattacaggcgtgagccactgctcccgctcccggccctttttttcttctttttcttttttttttttttttgagacgtagtctcactctgtcgctaggctggagtgcagtggcgtgatctcagctcactgcaacctccgtctcccaggttcaagcgattctcctgcctcagcctcccaagtagctgagactacaggcacgcgccaccagtccagctaatttttgtatttttagtagagacggggttttgccatgttggccaggatggtctccatttcttgaccttgtgatctgcccgcctcagcctcccaaagtgccaggactacaggcataagccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgatccgcccgcctgagcctcccaaagtgctgggattacaggcgtgagccaccgcgcccatccttctttttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtagaaatggggtttcatcatgttggccaggctggtcttgaactcctgatctcgtgatccacctgcctaggcctcccaaagtgctgggattacaggcgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaaggagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatwtaataactggaaggccccgcccctctggtgcatttccccgctccaaccacctcctcaaactcacggcaaagggatgcgagagctggaactcttaccaggcctgcggaaactcagccctccggcagctaatcccgcccgccagcccccgtcctctctctctttctccctagctgaaggcgccacgggccgtgtgtcgttgccttccacttttggcgtcccaacgtctctccgctcccatctttctactaacgtccgacgcacgctccgcctctttctcccacattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtakaaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccagktgagtctgggtgaaccgtkcsctgacgcccttttccggcgcgggagaggtggtggcggtggcggtggcggcggcggcggcgktggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctkktcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgragrtggctctggccttggccctctgttttctggcccatggttacagggtgctaaggtggctycataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaagktgtctgggggaaaggagggaacatggcatttgagctatgagggagctaagtagatcatggttgcttragaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagytctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacaygtaagaattggaggaaaataaakgtggatttgggaaactttgaggccagcttgcttcttgcaggctcatgatcaaccaatctcacataaaagtattgaatgttacatatctcagccttcttgatagggatttcatagattttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtrtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcgggaaagttgccattgcccggcgtatgcsacctccagccaaccttccaagcctgaaagccgagaacaaaggcaatgaccccaatgtctcactagtgccaaaagwcggaacaggatgggcaagcaaacaggagcagtccgaccccaagaggtagacagaggcttgggggacctagagtgatgggtattttaacttgaacttcagggagcattggggcttggtttagtccagccacgtctgagccrgagacgaagaggtccctttcttacctrttgcaggttccttgttaaatgactaaggaatggtactaaactttagctttttgtcttggagagagagcatgaaaaaatagacaacagcctacaaaggatgacaaaattawtttgtccttrtatttgtaaatggtagcaatgggcatgatttcagtcctgagtctccaccagttggagaagtcagggaggcatctcaggtgtgaataaccttcccattctgtcccctcagttccgatgcctcaaccgctcagccgcyggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacacttccccagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtagsggggtgagtttgaaggcgggaaacctgatggtctggtacctgtcagagccttccactttttttttttttgagacggagtctcattctgtcacccaggctggagtgcagtggygcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcycgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtggkcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagargggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaawttttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaaragtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggwgctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccrggaactggggcccccctggggactacccagtgagtgtctccaataagggattgagagggtcagctgtgggaaattggtgtcagctgagtaattgaagcggttgtgatatagaggaaggggggtgctaaaaatgggctgtgtgaagtgccaggctgcagaacatcctgggaagcttttaaatatctttggtaataggggagtctgggtaagaagtgagaaactgggatgctaatgaggaaagaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgtygtaaaagagatgrtagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactrtcagtgatagtgttctatcatttgtatatctgaaggagggaaggttttgtctggaatcttaggttgtagyctaataccatttcttggcagagtactgtagctcacgcctataatcccaacacttagggaggcttggggtggaggatcgcttgagcctagggagtttgagaccagcctgggcaacaaagcaagaccctgtcggccaggcatggtggctcacacttgtaatcccagcactctgggaggccgaggcgggcagaacatgaggtcaggagttcaagatcagcctggccaacatagtgaaacccgtctctactaaaaatacaaaaattagccaagtgtggtggcwtgtgcttgtagycccagctgcttgggaggctgaggtagtagaaycsctttaacccgggaggcagagattyctgtgagccaagaccatgccattgcactccagcctgggtgacagagcaagactctgtctcaaaaaaaaatcctgtctcacaagaaatacataaataaaaatgaaaactatttcctatrggcyaagactgaagaaagtactgttgttctaatggtttcatagaaagttaatgccaccaccataggctcatgagaggccatgaagtgctttaatgggtcttaaatgggaggggcttcartagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgyctttcctcctttcctaggagcagctcctgaagcagcagcagcagcaccagtggcagcagcatcaacagggctctgcccctcctaccccagtgcccccatcaccaccacagcctgtgaccctgggggctgtgccagctccamaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgaytctggtaygataggttttgcccatcatagtgatgagggaagggcatatgcttrgcactgctgagatagctctgttgcaaaaatgggcttagttaagaaataagcagtggttggccaggcattgtggctcacgcctgtaatcccagcacttagggaggccgaggtgggcagatcarctgagttcaggagttcgagaccaccatggctaacgtggtraaaccccatttctactaaaaatacaaaaaagtagccggcgtggtggcgctcgcctgtagtcccagctactcgggagactgaggcaggagaaacgcttgaacccaggaggtkgaggttgtagwgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcraggggagatgctttttgggctggagggcttgtgacatgaataggattatttttctttttctttggtttcttcaggcctagttccccgagagcgttcagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcagttcgagactagcctcggcaactggatgccrtctctgccaaaacaaacagaaaaatagtaaaagagagtctgcatcataataaagtgttcttttcccacctagttctggttttcctgagatacttatttccattctttctgtctktctcttcaggagcgagactcctccagtacctcccccaccaccctatctggccagttatccaggctttcctgagaatggrrcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagsccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggygccggcagcggggctcagaaacaggcagcgagacccatgagagtgatctggctccttcagacaaggaggctcccacacccaaggagggaacactcacccaggtccctctcgctcccccaccaccaggagccccaccttcaccagcsccagcccgcttcactgcccggggtsggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccrctcctgsacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggcaaggctggcarcagtggcagcagcagtggaggagscrgtgggggtcctggaggaaggaccgggccaggacgaggcgacaagaggagctggccctctcccaagaaccgaaggtgggtaggaacaaacaaatttattgtggtttaaaaattggaggagggggrraaagcctgagggaaagataagtttgggtgkagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtaygcataggaayccttagaaggactcaaaaacacctggactttaatagggaagagrataggttgtaagcagaagttgggaaacataacttgtgggaaaaartaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcntccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctagggrrcctgcygctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtggrtgggactcctcgggactctgccggggttagtccctttccccctaaacgtcgggagcrgcctcccagaaaaccagagctgctacaggaggtaagggatgggtttgagattgtgcttcactgcactcttactcgtgaaawttcttctgggttatgttttctctgttytctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctggkttgagtctggagctgttytctcacttggctgtcccctttctgcagtttgtatgtgtgcatcagtcaggtattggggtgctytctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcrtacagaccgagscacagagcctggccccattcggccatcccatcgacctggtcccccagtccagtttggcactagtgrcaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctartggtaggagacagcttgaaagcagagaaggagctaacagcatcagtcactgagrtaagtgggagtaagagtttggtggaaaggcccaagatttctggggaagattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtrtttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcarttacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctacccccsggcccagcccctccctcagcactgctctctgggktagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggmtttctcccttcaggggctcctgcccagcaggtatattgtatcktcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcayggactcccccaactggaaggtgaaacggaatagggatgtggactttccaagtgcttccttactttggaaccagggtctggatcctaggcttgccttagacgcccttcttcccttaggtcctyctctggcctcaattcccgtctsaaggccacgccttccacctacagtggagtcttccgcacccagcgcgtcgacctttaccagcaggtgaaggagaaacccttgtggccccaactctaaattygagttgccacytgatttcctgtccttccrtctcatcgctgacctctcactgtgactcactstttaacacatgcctgtcccctaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagcatggtgctgagtgatctgtagtttcagtcagggaaatattcattacttattccagtgagctgttgaaactaaaaacatgaccatcgtattggatctttaaatttttgtgagtctggaatttgggctgagctcagctggataaatctgcttttttgtgccagtgagcgaggtcaactggttatcagtctgcagctgacacctgggctggtcccaatatggcttcctttgcatatctagggccttggtgggacatctgtaacattactgggttatcaaccagtgtcttcacatggactctccagcaggcctgttaaatgtccgtgagctcatgttccaagaggtctagctggaattttctaagcttatgccatgcttagttgatagagcactaaactagccaaggtaggggatgggggggtttagaagggacttcaactgcatctcaaagggactagcaaagaatttgcagccatgggacttcagttctttatgatgaactaaggggaaatctctgttaaggcctcaatgttggagcacacttaaggggctctttgaattggatagaccaattccagcattgtcaaactaagtgggatttcacatggtaacgctgcatgctagttatgctaaagactatacttaggtctgcagctgctcagaaactttttttgatgggtaatttgagagctctatgctagtgtgcacctggaatatgctcccaactcaaaatacaggttttttatttatatataaagtgctttcgcacaaaaaatacaaacarcaggctgggcgcggtygcccacgcctgtaattccagcactttgggaggccaaggcgggtggatcacaaggtcaggagttcgagaccagcctggccaatatggtgaaaccctgtctctactaaaaatacaaaaattagccgggcgtggtggcggacgcctgtagtcccagctactcaggaggctgaggcatgagtgagaatcacttgaacccgggaggtggaggttgtagtgagccgagctcgagatcgggccactgcactccagcctgggagacagcaatactctgtctcaaaaaaaaaaaaaaacaaacatcaaaactggcttgtacaatttagcgtgctgagtagaacacaacagtgttccaaggaagtattaatttwaaaaagttcacacaagattaagggacacactacctaatggagacaatgtagagagaaagcagccagaaaaatccgacttttatttcttaaatactgtgaaggaagaggggggaaacggtcccctgatgaggaagggccatagagcaaagagctaaggatcatcagcaaaggcccgctggscattggggaagcgctggggactgtagttggggtcttcctgyagtcgtttttgtatatcagaccggagctaaagagaaaaagyaagcaggttggagaaasgctggccaagtcccyatgatcccagcaagcacacaaggccatccctcagaagctaacatttccccccccaagcacrctgtcaaatagcccggggtggcactgtcaagccttcccagatgccaaaggggaaaacaaatggtagcaccaggctgaccagttcatcgctgaagggatccagggaagagggaccctagcccaacccctcccactagaccatccctattctgcttcaaggtggcacctgctgcctgtagctctcctgaacctctggtgcctccaggtcccggctcaggctctcggggctcgtcaggggccgagctccggctgccttagctgcccggctcacagcctctgagagaagcagctgggggccctcaccctgcatcgtctgggggacagggggttgggagggaaaagaggatcaacgtcagatccagtgccaccatccggctcaccctttccatgagtcaaccactccactgagtctccatgctagtggagagaggggaaattaagagtccaggatgtggtttttacagcagaaatgccttcctaattctctttggcactagccaaaactaaagtgaatgtgcttgaacgtgctcttcaaaacgaaaggcagaaggggtcaagccatccgggattcagagctaggtaatccacaagaggaaacccaccttaaaggaaaatgggatctaagcacatggggattaggcagctgagcaactaatacaggactgctagcaaacagactaaggtcaagtcctgtatggttatgcaacaaccaagagcaagtctgaatcccagaaaaagtttcctcattaaacgaggggaggggagactgaataacaagagctcccaccatctctacatagtttgattccaggcatgacggggaaacctggayagagagagaggcttagggaagaggaaaaccaaccttgcgtctcttggcaggcataccactgaggtaggcatcactcagagggggctgcggtttcaccttccgctggctctgaatgtcctgctggataatagggacccattcctggggaggaaaagagaaaatagtaatgtccttgactttcagctgccatgacccactggattacttcctgacacttactggggggactgcagctgcccaaggttctgtctcagctgaagctccatcctgttcatcccgggagcccccctcaggagcaggaggtggacctcgggacatggcctcttctgctgttgttccaggggctggggaagcattctcccgctgggtgtcagatggcgggaagagccaggcttcagaatttttagcctccaaacctttctcccccagccctccactccacattatctggcccctcaacctccccctctctagagtacctgaggctcaggggaagctctttctgctccctgaacttccattggctcctcaggaagyggctgtgaaattaaagaacaccatacttcctctcagatctctccagttctctcaagtaccctgaccccatcgcccaacaggtcccttacctgggggggatcaccaaccctgcgaacgtatctgagaatggcatcagggcctacaggcatgtgctccagtaccacctgaagcctcagtcccatcatagtggtcagccagctcaccaaggagggattcaccccacgagacatacgacgctgagggacagaaagcagatttagaacacaaaaccctcaaccacctttagaaatagattagatccaggttacagaatgtcagtttagaaaagaaaaatgaaaactgcagagaatggaaacctcaggaaacaaaaggctaaggatctggggctaggtggtgcttacaattcggccattgataacagcagcaagctccatctgctgtccccccaagcagtgcaggtttagggccaggcattcaaacaggccttggttacacaactccagcaaccgggccccaaatccactatctgtgggcaaaatacaaggagggaatgctggcacgtggcagccctgcacatgcaacaggccccmcttgcccccgcctggccagcccctgacctgtgcaatgcagcacatgcgcagcaatgctattaaactgctcttggagaaattccaggtttgtccggatgatgtccacacctggctgaacctgcaccaaggactgagagacaagataacacaaagatcccaaaatcaagaatcataagactgggagtggaggaggcagctgcctygaccagacccaggagaggaaaggaatagagaagggttactcacaaaactctcccgcacatactcttctagccccgtgatcaatgtgtgggttgccatctgtggaggaaacagaacaggtttagttcaaagcctcagtcctcccaagacttccacctcgaccccaacaagtccagggcttgtgtgggggcaattggagctttacctggcagagaagcagtcagaaataaggaataaaatgtgcaaaagaggagagttctggggcccctggccttcatttacccggatgttactgggtgtgggctcctgaccacccaggtagtgctggtggaagaaggatcgcagctggggctggagccgttgtagtggctggaaatgcccatggagaagcatcactacgtccaccatagagaagttctggcacagaagagaaagcaaggccccaaagaatcctgggggacaagggcagatgttagcaatggcctttaccacctggcctgcccacccacaaccagatcatcaacctcatcccaccttggcaayacccctaaaccaaggccatctacattcctctggctgccccttcctggagcaagccaaagcatcctttttgctcaccaagggccccatcagctccaggctcaaagatgttgctggatccactgaggcgttgtatgaaggcagcaatactttcactgctgccagcccgagcccccagggagcccagcagggagctgagcacaccctgcaccactgaggtaaaaaactccggtgacaggctctcaagacccaggcctccaggactccctgcgccaccagaaggggagcctggtgggggcatggtctgctgctctggggcaggtggtgggggtggaggaggtgggggtggtggaggggctgtctgtgttgcctggcaaataaagaacaaagaacagaaagtgaggtgagaatgaagacacacggaaataatacggcatcaagagggcacaaaccaacgggtctgggaagatggggagttacattctgatcttcactgcttaaagcagaagtatggtaggtatttaacagagtcaggcagcacaacttacctacctcttcctctgaacaggytgtcagaaagcagtgacactaattactatactttctttttctaaacctcattttcttcatctttaaaatgaaaggttcagagtcaatgaattccyagggccccttcccctaacatgtcactaggggctcttacccagtggttatrtaatggcaagaaggtaccactgcctggctgggccgggggacaggaagatgaggtgaatggcaagccagccactcacctgcaagaagtcagtcatgccttggagaaaggcagggacaccaggcatcgccacagtgatggtgggagaagccacaccagrccctccagcccctggccctgcaggccctagcaggttccccagaagctgagagaactgaagatcagccatggagggttgaggggtgggtggaggctgggcaggccccccaggagcggggccagctgtggtagctgtgttggtggtgccagcactggcagaagcagtggcaggggctggcggtggagccatacctggggtcccctgagctgtaagaaaccaaaaaaagaaagctgggctgagcatggtggctcttggctgtaatcctagcaactttgggaggccaaggcatgagaactgcttgagcccaggagtctaggccacatagcaagaccccatctctaccagaaaaaaaaaaagacaattactagccaggagctagtactgctagctactcaggaggctgaggtgggagaactgtttgagcccaggagttcaaggttacagtgagctttaactcactggattgcaccaytgcactccagtctgggtgacagagcaagactctgtaacttaaaaaaaaaagaaaaaagctggccgggcacgatggctcaagcctgtaatcccagcacyttgggaggccaaggtgggtggatcacaaggtcaagagttcgagaccatcctggccaacatggtgaaacccccttctctactaaaaacataaaaaattagctgggcgtggtggcgtgcacctgtagtcccagctactcaggaggctgaggcaggagaatcacttgaacccgggaggcagaggttgcagtgagccaagattgtacactgcactccagcctagcaacagagtgagactccatctcaaaaaaaaaaaaaaaaaaaaaaaaaaaagctgaaacctgaagacacaagacactacagcagccccattccaggaaagcaggaaccaagaaaatatggaaagaactggaaagtgccagtgagcagactaggaaaggagtttaaactctgagtggggaagaatgaaaactcacccacaaggactggctgcataagaagctgccccacaaggccgctcaccatctgggccaacgaggcattggtacccagaccrgcgccctgctggatagagagcaagggagaayttcagacctgcccttccatgcaccaccacaggagtctctccctagactgttacgcactagaamtccccgacccttgctcaccagtgtcccagagactgggggccctccaggatgggaaggccgagcctgtggaggagtgggccgggcaatcaccacccgggttggagctgttgggaagcctggcacctgctgtcctgtgggtggcagaagagacagaccgaagagggctgagggccaggcccttgccagccagctgccaccatggactgtgccctacctcccaagcctccccttccaggtcattacctgcggccgcggaggcaacagctgccaccatggcctgatgagtgatctggtgggcgacggcgtgcatgaactcagggggcagggagggcagctggatgagggtggagcctggggggcgggtctgatgtaaccttgaacctggaccccttcaacccacccacwcagcccttccctttctctacccagagctcagcctgccctgatgccctcactcttacccagggtttggccatgaccagggggtcccagggggccagtgggagcactcggaacaccaccaggctgtgtgccagaatctgggcagggagacagagacagtggccctgaggtaggtagggccaaggcctaactatatccttctgagatcaggcatacttcaggcccataatcccccaatcagaaagcctgcctttccctccatctaaacagggagaggtactcccttcaccacacaaacacacctccaaagacaaaccaacccccacaccccccacatctgtctacttaagcttctgctctggtccccaggctaccaccaccagcatgtgcctctcccttccccaccctgttccctcacacctcagcatgaacctccctcatcatgctgatcctgctcttctcgccagcaactattctcaccttgaatgttcatgtgcatcatgaccacgggttccacactctggtgggaaatccggatgaccctygggtggctggtggctggcgggggagctggacctggcgggggagccccctcagctgaggactcgacattggtagaagacggagccacggatgaggcctgcccaggaccagggggaggtgcctctgcattgggagttggggggggccgagtcccatttcctgtcatggtcacagtggttcccacattgatctgaaaaagacagatggacaggcagatgtgagaaaaatacaagagcctaaccaagaaaacctcatgataaacctctaaagtatctccagccttcatcaccatgtttccagtctcctcctttcctaacctccttcaggcccagtagctaccctgggtcactctatcaacacccctcactctccctcaggccagactccccctaacccacctgtatgggaatggctgcctgctggagcaccatgggggtggtgtagtgagacataggccggaccacatgcaggtgtcgtgggggcgtgcaggccagattgcagcgcaggtcagacagtgcaacaaaggtgttgcccagcagtcgcaggctctcccctaccaagttgatcaaccgctgatcctcctcccggccctcgtgctgcgcacaaccagccaaacacaaaaaggcagaaaatatcaagctggagtccatctcactaataaaagcaataatgcctactgagaataccatgtcctccaaaactttcagttatatccttggaagtttacatgtagaccaaatctttgcaaataaattatatcttattcacataaggaacatcctattaaaacactactatgaatcagtaagtcatcatatactgatctcctgtactttacattttctaaattcattcaggggcacaaggggtacgatacgaggacagtgcttacagcaaagattatcaccttctctgtaagggaggacaaaatcacttacaggtttagagagaaaytgttttgttgcaatgtgtgtttttttgttttgttttgttttttgagacagtctcgctctgtcacccaggctagagtgcagtagtgcaatctcggctcactgcaaccccctcctcccgagttctagcgattctcctgcctcagcctcctgagtagctgggattacaggtgtgcaccactacatccagctaatgtttatattttcagtagagatggggttgcaccatgttggccaggctggtctcaaactcccgatctcagatgatccgcccaccttggcctcccaaagtgctgggattacaggcgtgagccactgcacctggccctgttgcaatgtttttccagggagggaaagagttatctgyatttcagcctgttctgttttgggagtactggggctgaggagaaagggcagggccatcaaagggctcacattgttattgtagtccgtggtggcagcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccagagccctggcccaatccttctctggaccagcagagcttctattctcttcaacctccgcctcccaggttcaaacgattctcctgcctctgcctcccaagtagctgggattaagttgcctgccaccacacccggctaatttttgttttttttttttttttttttttttgagacagagtctcgctctatcacccaggctggagtgcagtggtgcgacctcagctcactgcaagctccgtctcctgggttcacaccattctcctgactcagcctcccgagtagctgggactacaggtgcccgccaccatgcccagctaattttttgtatttttagtagagacggggtttcatcatgttagccaggatagtctcgatctcttgacctcatgatccacccgcctcggcctcccaaagtgctgggattacaggcgtgagccactgtgcccggcctgtattttttagtagagacagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccatagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccaggagtgagctccgggttctgggctggggcacgctcctccacttcttctgcctccatgggctcccggggaggtgcttcactttcaactggttctgaygtttgagagctcaaggctactggctccggggtcacagccggtggctgcgggggcggctgactgtgctgcggttggggccctcctcgacactgaaggtaggggagagtcaggataccaaaggcagggtaagactgctgcagaggattactctacaggagactgaacagagaaagtatcctaactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaagaaattctcttgcctcagccttctaagtagccaggcctacaggcgcgtgccaccacacccaactaatttttgtacttgtagtagagacagggtttcaccatgttggccaggctggattggaactcctgaccacacgttatccccctgccatggcgacccaaagtgctgggattacaggcaggagccaccacacccggccacagcatctgtaatatttgtaaataaatttctaacaaagagtagagattgtggtttcctttcctccacaagttggtttcccagcctccacaagttaagagagtagaatcctttaattgaaaagagatgccatgagactaagtctgaaacaaactccccagataccaggcaccaagaggattggcagaaatgagagagcctcacaaagatactttttctgcccaaaagaatgaatactgcagagaagactagattatgaaggccaaaccctgtggatgtggccagtgaagccctaactcccaggctgagagaaaagggagagggagggtggagagagaccctagccagccttgcccacttacctccatccgggatagtaaggtctgtatatccctgatcatgtgctgagccatcaccagccgtacccggggctcactctacaatgagagaaggtttatcagggtaggttrcagatgaagccatgagttctaccacctactaaatcaggtcccagccatctctcagccaggtccaccccacctcccagcctccttctcccagatccccttccctgaccctcggaggcccctcaatacctgaatcggggcctgttccatgttgatgtgaacatccacagcagagccgtcactctggggaaagggtaagggaagttgttctgggagaagccaacactaaggcctccacacctccaattcattccctggagccctacctccttttctccttaaagactgagaccaatagcacaccacagggccccctgaacccaatctaaagatggaagcatctatcttattaattccctggtgctaccacaaccaaagctacccacaaaagccctcccctgtggaacataagcttacaggaagattgaaggttccaaccatgacatagctgttggcattccggtcatgaacagaggccccaggcccccgagtaccagggggggatcccccaccatgagtggctgaggcagaccccgtcccagaagatgccccagaagggaggtgagtctgaggaggagcccgttccaccaggtggataacctttcccccaacatctgcagaaaaatagacacacaccaaaacatagtatgaacaggtaaacccatggcctcagttcatccctccagacagtagccccaacctctgaactgcctccccagcccccttactgtattcctgaagcttcttatcatcttgcagaactcgtccctggtaaatgagccgttgtttttcagatgggatgctgacagaggcagcaatgtgctccttaaactcttttacattcatctgaaaagaagaggcatgcacaggaatggaaagaatggaggaaagaggaagaacaaagacagacaaccgagttgtggaggtgaggggtaaaaaccaccacagaatcactacccgtttgtcttgaccgtgagatcattactgtgcaaacccttaaactaaagtaacagctgtcaaaatacagacaataaatttggcttggcgcggtggctcacacctgtaatcccagcactttgggaggccaaggcaggcagatcacattaggtcaggagttcgagaccagcctggccaacatggtaaaaccccttttttaccaaaaatacaaaaaaataagccaggcatggtggtcgcctgtaatcccagctactagggaggctgaagcaagagaatcacttgaattcgggaggcggaggttgcagtgagccgagatcgcatcactacactctagcctgggtgacagagagggactccatctcaaaaaattaaataaataaacttaatgaagctcaggttatagatccaggaaaaataacacggatgaaaaacaaaaaaaaaacacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttaatgaagaaagactaagaagataagaaagcaaaaaaggtcccagcacagtggctcacacctgtaatcccagcactttgggaggccgaggcaggtggatcacctgaggtcaggagttcaagaccagcctggccaacacggtaaaaccctgtctctactaaaaatacaaaaattagccgggcgtggtagtaggcgtcgtctgtaatcccagatactcaggaggctgaggcaggaaaattgcttgaacccaggaggcagaggttgcagtgagctgagattgcgccccagccctccatcctgggcaacaagagcaaaactccatctcaaaaaaaaaaaaaaaagcaaaaagagaaatatttttcctaactacaaactgactcttgggaagtaccagagtatttatatacatctaatcacaagtctatatatggctttcttatatccaggtaatatcacattttagaaaaccatggaccaccccacatgcaatttgtctccaagtattacaggagtaaagacacagatagctatgtccaaggctttaagctcaagagactcaagctatgccataaaaattagtaatttcactcaacagtctatcaaggacctatctccattatgggttctgatttctaccctttaaaaacacagcatagacctgaccaatgtctatcagtaagacacacttgcttagggttcctgtgctgtttcccttcccaaaggccagagccatgcctgtccctttgggttggggtccacccatgatgatgacacacagattcttccttcctctgtatttccctctgcattaagttctatccatgtggaggacagaacaaaatcagcctcactcacaaaacatcagaaaacgttctactggaatacraacaaagggatcaataaaaagaaaatctgaggccaggtgcggtggctcatgcctgtaataccagcactttgggaggccgaggagggcacatcacctgaggtaaggagttcgagaccagcctgaccaacatggtgaaaccccgtctctactaaaaatacaaaaatcagctgggtatagtggcacacgcctataatcccagctactcaggaggctgagataggaaaatcgcttgaacccaagaggtggaagtttcagtgagtcgagatcgcgccactgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaactagtgaggtgtctcacctgggcccccacaataaaggtacgagtttgagagtccaaggtcttcaccaacacctccaagctgtcaggctcctccacagcggtactggtactatcattaggctccatggccgacaggtctctaaagaagaacgaaggaaggaaggcccgctgttgcccagaccagagtgtacccgaaagactccctagcattaatccctgccccaatacctaaaaagtttctcctgcacacacacacattcacacctgtccccatcccccttctgattccggggcacagggagagaaacacaaagggcaggagatcgacggcttagggagctggaggacgagaggtgggaggggctccacgacgccaatcacaataagcagggagccagtcagattaggaaggaagcacgagaccagagactagtgtcatcaccggtcacggcaggacaagcgccccagaggtcggaaaatcctgggacaacgcgaaagcggtggtcgccccacactctgcggagaaagtggtttcgcgcacgcgcgccacgcccatcgaaccctcctaactcactatagacccgaaacggcactcacggggcgacagacctgctagctgactgcccgcgtctactgccttcccacggtgttccagcagaacggcacaactaacccacagccaaacacacacacacacacacacacacacacacacacacacacacmcaccaccccgcggctccgcccccgacttccccacggaccgtcacttccggtctcccccaaacctgccaccgacggccacttccgtttccccgatagtatttggggatctcgaagcgatacttccggctccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaagcatcgccccaccccctcccccctctggcggcgttcacgtctgtgcgcgcgcttgagcgctagaagattgaggtggctaccgtaaatgcctgaaaaacagtcaccagctgggactctaccactgcctcgagaggggctatggacggtcgtatggaccttggactttggagatgggggattatgccacattcatctatgtttaaatcttggcaggctgataatttcaggcggcactgtcctagccagctaaaactcttctccaccctattgccctcgctgcgccctttcttctgtgcctccggaagttactctttcagtaggcgtttgggggcggcactggtcaattttgttctcggttgcttggttgggctagatttcggttctgccgggtgggcgttttaagggctgtgggcgtcacattcgtcggtgtgtggccaaggggacatgacacgttttaggaaaagt

SEQ ID NO: 12414 - DNA, 25930 bp, Homo sapiens
gaaagaggatgttgaagaaagaaaggtgctgggtggtcaaaagtgcctggggcaaaagtcagctctggcctgtgtcttggtggttctgggtcagataaaatgagagaaaaaattcctggccccttccttgtgaattcatttctgctggcctaataatgcccattgcattatctttttttttaaagtaattaggtaaaacacacacacacacacacacacacacacacacaaagagaaggttgaagatatagattgacttgaaattaggaaaccacaattggttccctttcctgagagaggaaaaaaccttcacagatgtagaaaaagcactctccccagacacacacacatccttcaatcttacctctctcatttcccttctaacttatctaaatcactggctgtgtacaaatttgccattttgcagggtgatcagctttgaggaaaggtaggtgctaataagaataatatggagggcaaaatgttttcattttgcctctgccaaaaacatatttacattaaggaggtatgatgagcatggattaagtgcatagcgaatgatgctctagaaacggcataaaccaactggcaacaaactgagcctctgtactaaaaatattgcttctccaagctagacaactttcagtcttctctctctgaaacatgctacagacgcttgcaccaaattgcccagatcaataatttagaggaatgtcagagkataggggaaatgtgtgttacaggaaagctccgtgctgctggggcaagtaggaagctgggagctgggggctatagagcttaacttgcagctcctcaccctaggttcctgctctggaaaagatggggaggtggccttagagcttagggagcaaagatggggttcaactctggagaaaggggtggctttggaaatgccaagaggagaaggtaaaactgccactctaggcaaatgcacacaatgtttttctatctctcaagatactttatctttctagtcaaggaagagaggggaaggtgtttgcttcagccccaggaagagggatctccaggctgtcatggttgctgggaaagatgagggagggaaagggggcagagtacggaggcaccaggtcagaaagacaggagagaattcagacaggaccaaaacagccagaaaaaataggataaagaaggtagaaaaaaaaaaaaaacaaaacaaaacatgagaagttaaagcctgggaaatagatacaagacaagaaagagaaatagaaaccaagaacaagattgatgaaaggaggagaagagaaagtagaaggaaaaagaataagaaagattccagacacgcattcaaataatcctaaatggggatgagcagaaagacaaggagaccaaaagaaaaggggggggggtggggaggagaaagaaaggaatggaaaaagaaacaaaaggtgaatgtcctgccctgtctgtctggtccaaccaagaagctagtgtctgccctggagggaggaaaggtgggggagtccagcctgtctccaagggactgacaggcagcttctggaccagagaggaactaagctctcaaagcaagctttggggaggaggaagggatgggggtgcatggtgagtggagactcctggaggaagagcaagcctccactgggttcagcactgccagggggagagtcagggttcagggtagcatagcagtgctaatgtatgtaccccagagggtagggggtgctagggcaatttgcaggaggaccacaaacagtaaactagagagctacttccctgggatccgtgataagaaaatcacttcctcaggtgggagaattgagcccgaaagagaatgggagcccttggggggcaggcacctggtcagtttcaaagctcgtcaatatcaaaagaggctgggatcctgagatcaaatgggctggggcactgggcagaaacgaggagccattgccaaactgccaggatgaccagaacgcccctcccccaggaaaagttcatatatgaacccacccctgtatgaaacttcttaattaggtctcatacccccggtgaatcttggatgcccttctgtcaacagaattcccaatttagtgacacctcggactgaaaagagctctgcggcaaacgggggtgaaagtttaagagggaataagcatataatactcccttgccagacctcacacatgctgaagggaatatttacagcaaactggccaaagcaaacgaccccgcctacccaccatccttttaccctcctccccgccctttttgtaaactccagataaacaccatttgatcacaaaagggtcggtttrtcccctttatagtttgaggcaggcagtgcggcagggaaaagtggcgtgggctaagcttccgtctcgggcaaggccagcttctttgctggcaccgtggcctgggctaaggacagttgatttggttttgtttcccccgacccccaccccgaccccacccccacaaaggaacattattttcagggtcctccccccacccagctttaacactcgcctacttgcacccgcactactttaaatgctgcgggcattgcagatagagaggtttttcagttaatttacttttttaattctagagctacaattaagtgaaaactctttttgcgaaaaggtggaggaatatttcagagacgccagaaattatctgggtcttttctgacccggaatctgccctctttctcccttctcctccccttaagtcacccttttctgggactctgttgaagggcaggctctttcaacgtctctagtctgtcttttgttgagtgtgagaccgaaggaaagaggatcgaggggtctgcagagagaaaaagaccgcagatagccggcagctggcgcctaatgccggggtccggggagcgctggcctcgtgggttctcctggaggccaggcccagcacaagccttcggaacacgctggccaatgtttaacccgaatgcagtggccaccaggccgcttttgtttgttcgcaaattaatcacccagcgcatggccggcgccagagtgggtttatcacccaccgggaggggggcgcgccggrcacgcagagacaaagaggagttcgcaccttcccgcttttgatcccagaattacggcggcctccctscctaatacgagcctcctggggccgagtctgggaggtcagtcataattggcggaagtttgcagaccattagcaagatgtcgacattttcgattcgaaccccgcaaactttcctctcgttctctgcttcgcgcgctggaggttggtgtgggagaggagatgggggtcagaagtagcgatctggggtgatcacagggttaagttagagctatgggcaaaaaataggcaattgagggaggaggacagtgtgaggggcagaactccctctcagtccacccgcggagccaaaaacaaatctagacatttttaagtaaaatccgcaagctcccctcccatttccaaagctgacagctggccagaatgcagaggaatgtctctctgctgtgcgtgggacgcttgggggcaccgagtgggtgaggaggaggtcggtcacagtgtggttgtagaactactttgcttccaccccaagtagtggggcagagattggcctgcgagggcaggcaggcaaaaccagatcgctgggatttggggccgctcttgaaagagcagcgaaggggccccaggccccggaggcgagcagtctgggggagggggtgcactttttttttctatttctttcttttcttttcttttccttttttttggggcgggggtccccagagactcatgaaaccctgcagtgacttccgtgttctgtgtaaggcgggaaatggcctggcctttcgcacccttcaggtggggaggaggggatgcgggagggggtgttatgagccaacactctggggcaccaccacctcgtaattttccctctctcctttctctattttaaccactggcagagacagagaggacgccagagaaagacagactgaaagggaaagaaaggggcgagatggcgagccagacggagttcgcagaaccacactattctctctggtgacttcagrgaattctcracgctggcgccaagctctcttaaccatgtgcgtcaaaaatgcgaggctggagaagcctgtcgcctcaaaagatcctcccctatctcagcgtggttggcccacaagagcacttcattttcacccttcccttggtgccacgttggggtttcggggttgctgggggttgcgsgggtgcacaaggcaaaatgcgagagaggcctgtgctggcctacagagacacacacatccaaagccctgagtctcttaaacccctaagcccccagatcagccctttctccgttccctttccatcgaagaagctttcatctcaggaaagataaaagaacattgttttcaagatttccctccatctaagcaaggatggtccaagacattggcccccagaatcaagaactgtgggcttaggcgaatcctctgaccccgaccgggcgctgcggtaacagagttggtaattcggcgattggtaagatccggtcgtttccctcccgtccgcctaagaggaggcccccaccctacccgtactaaaaacagtcaactcgcctctgaggtgggggcgtttcacggtttgttttacaaattcaccctccctccccgacttctggccagattaagtccccggggtggagaaagaactgaggcaccgagagataagtgcgatgcctagagaagataccaggctggcgcgcctcccccaacccaatcgcccaccccttaccctgtgctgtgcacccagccgggcctcgaggtgagggcagcggcttggaggggacaggctcagaacccagtctctcgctgtgctcgctttgtccagatcctccattctcttctctacacccacacccacatccaggtggaatatgggggcccgcatgcaaatgaaagacgagatccaaaagggctggtaaatgcatttcataaaaatcccaaatccatcttccccaggagctcaggcagggccagccgcgcaggctgtgtacgtgtttgtgtgtacgtgtttttcggtgtgtgtttcagtcccagtgtgttggcgcgtgttcgagtacagatacaccgggggtgtttgggtacccgcacatggctgcgggtggggcgcagtggagaggaagcccacacatgcgtgtgctgagatatggccgcatccttgtgctcccccagcccagacgcaggggagaccagcaccgagacacccgagctcgggagcccttcagcggcggccgggcggagcttggctccacgtggggctggagagcacgcaagcctggagtctcggcgctcgcttctcggctgccgccggcttttgtagaaccgagtggccggatggcagctcgcggggaggctcggccacccgcccggctcgcccggggcggggagaagaaggagagctggagagagaaccggccgcggcggtcggagaggcgagcggagtgcaagagaggcgagcgcccctgcccggcgcccgggcgcgctctccgccttccccgcccggctcgcctgctcgctggctccctccctctctccctcccccttcctccttggccctgcctcctccctcgatccccggctggatgactgaggcatttcagacgtgggctgaaccagagcgagcgagcgagctcaggggctgcagcgatctctcgataagccacctagaggcgactctgtgcgcgcgcgctccccagtggctcccgcccgccctcygatcatgttgacatattcacaggacaggcagtagtacmgatgcggcgctgcgacgttacagtttcsgacaccttctttttataactcagctctatcccccagcactcgacctgtgaaaaccacgcctatgcagcaacacaattggtccgaaagcgtcaaagagccaatcaagaggcctccggctccccgcagcccacarcgcagcccgaccttctagagccgccgagcagacgcccggtgaattctagaggcggcggagggtggcgaggagctctcgctttctctcgctccctccctctccgactccgtctctctctctctctctctctctytctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacckaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcractatgtttgctgatttttcgccttgccctctttaaaagcggcctcccattcyccaaaagacacttyccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggtaagcagtgggggcctcctcccctaagctgttggagagttttttcctccctttatttctctgctcccagaacagtcggttggtcggttattacggcttggacgaaaagttagttcccctagaaatgtatgcacagacttccaggccctgccccggtggcaggaaatttcagcttacctgggcatctgcatgggtcttgcatttggtctgcatcctgggttccctcccgaacagacagaatttttcagtggagcacagacatccctgcagggagcaggaaagaaaaaaaaaaaaggcactctactgcaagaaactcactcttcaaaccctcctggaacatccttatttctttgttgatgttgtgttgtctgttttattttgttctcagagagaaaaacttaaagccctttccttttgtgtgggtattgggaggcctgacaccattccccggccctttctgccctccagtctagcctctgggtctaaaggggcctgctgctgccctggtcagagagaaatcgaagggcattttggtttgtttgcccacactacttcacgtgtctgtaacccaagggcgagttcagcaggcaattttgcataatttaagattatgtttgcagacttaaggagccagtgaggagacacacaccttttttttaatgtgtgaatattatcaaccatattttacataatgtttaaaggtccttgcctgaycaaaacctgcctggaagagaagatcctgtaatagtcatttaaaatcactgattttttttttgtaatagcattgaagcctgtaaaggcataaagttgatacaaaaataaaatccccttcatgatatcttaagcgttctgtctccttccaagctaaatgaggccaaagtttggcataaaatcctcctcaaactcacaagacatttagtcagttttccagcaaagtgcttccttgcttccttttaagtcaagactacagaatgccaacccttctgtgaaattaacagcaatgtggtggcacagtcttgcggttttggactggcctaagaagtgggggaatgtgttagcagctccacgggcagatcggttatcaggcccrggagtgcaccgaagtctgcaaaattcgttctgggaactcactgaagtccagtttcacttcgcccacagcgggattgctattctgcagcagggaggggtgcaacttgacgttcatttccttgataagtttaacattttctcatcaatgggtggtggaaaattctagtcttaactgaccgcgctttacaaaaatcttaccccaacctgtttagayctagatacccacagaaaaagacatgggcaagaatttgctctcaggagggcaatctgtaaagtcaagcaaggacaaaaaaaatattgaagaaattgttagacaatgtagagaattgcagtgccacaatgcatttgttttgaaccttgggacgtctaaatatggcgaaactgagaatatttaatacgttagttgtggaagaaaacgattttgcaaccagttgcctcactctgaaacatgtaagcttatcagtcacaatataaagtcttagacttggtttcaatattatgtgatacataggaaatcaaacccaagattaygggtggtttatctttctttttcttttctattctttcgttttataggcgaatgtttcctccatttaaagtgagatgttctgggctggataaaaaagccaaatmcattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaaytgaaactcaccaacaacatttcagacaaacatggatttgtaagtttcattgctctcttcagtaaaattttctcctccttcactcagtcaaaggcagtgcttcccatttcatgagtttcagcccagacttctcctttgcttctccctaagcatagcaaacttgtcctcgtctggaaaaaggattcggggtgtttctctccaaataatggaaggcctggcgttctaaaagaaatggggcaagaaaacttaccggcttgtgttctatagcaattccagctctttggtagattcctgacctgagagtgaagttaaaaaccattttttaagagctaaaatcaatttcaaggctatgtattcctaaaggatttgttttgttttaaaatatcatacttctgttttgaaaccagtgatattattttctcaggagagtttacgtttcggagccttgactctgttggttaaatggtgtgaatacatttttaaaaactcgttcttttactaaaaaaagaattgggcttaggtgggagtccggcttaccctaaatgaggcttagatcttcagaaaaaaatggtttgtgtgttgggagtgtatatatggattcagtgacagtgcttagaaacttagaaaactttcattgcttgtagatatcaggcaaaggaccttttgcgccttttcctacccctccccaacatttcaataaaataaacagcgtgataagcaaggagtaagcagaaagattaggcccaggaagacgcgaatggcgcggaaatatcttcagcgggcaggaattgcatttgaagcccttgatttgattaaggcataaatattcctctctagagttcagcctttcagggctttaagtggattgggctcgtcaattagtgggcgcttaaagtactgaatcattttgtaaattaaaatgcatgtttttctctatcttttaagactttggccttcccaagtgatcacgctacgtggcaggggaattatagttttggtactcaggtaggctagggttcaaggtatgaatgatccttagatggtgagggtggggggggccctttggcaactgaggagcaatttggattctccagaagataacatctgtggagcgaaacktacccagggggtactccaaggaggtgggctcggtacaagcgtggtaccctgcggtggggaagatttcagcctggcaggggtcctaagatcccgtttgttctgctaaatccttgttttatgtatgtctcctcttccctgcccctgcagactatattgaactccatgcacaaataccagccccggttccacattgtaagagccaatgacatcttgaaactcccttatagtacatttcggacatacttgttccccgaaactgaattcatygctgtgactgcataccagaatgataaggtaaactcaaggggctttcctttttaatggtgatattttgccttccccttaaaagctgctttaagtcaggatgagaaagttacaagagagtggagacgagagtcttgagttgtcttttgtgatttgtggagcatttggggggaaaggacartgacacctcgaggagacagaaaaacaccttgactaggtaggaacaatgctgagcaaaaaaacgccatactaattttgccacagagaaactcctagaactgctgtcattgatgccacccactcctccccmmctcttgggctttgtcctgtctgttttaaggttcatcttcttccccttggggaagaaggatcaagaagtcacattcaaaaggaaccagctaaaaatttaaggcaaaagccatttgggatcctgggaggagaatcctagtagagaccagcttttctcccctagccagaaatcctgagtagctggtctggtttttattaccttttatgctgctgtgttatgatgtgtgtgtgtgtgtgcatgtgtgtgcatgcatgcgtgtggttggaaaaacctaccctgatcacagggtcatattaatcgagttgtctgaggcttttgagttggggtggccaaagtcaccacttcatttgaattccccccctcccccaggcctgaatctggaggttagaaggatccccaaaagggaaagcacctgatatctagagctatggtggcctgaaggtcatgggcacagaaaaagtgacccttactgctgattcaccagttcccagattggctgttagcagttatggggtgggaggagggactgaagacccctgctctgcaatcctggacttcaaagagagtccattttacctgacaacacacttcattttgaactcactgtcattgtcactgtccttgggtcctctgtggacttcatgatggggatgttccagctaaatttctttagtgtgwataccaaaacatgatcttctctccctgtgaaacctgaagtcttcaatagagcaatttattccaagaacatgaatccaaccaagggtccccctttccacctctgagtaactctgtgtatataacttcttcttcccaccaaggggaagggatttgaaagattacacactatagcatttttctcaaagtgcaaaatgcatgtgccctctagacccagaatcctgtgaaatgaagttgttaatgtaataataaaatgtagcatttttgatcagacaaaaaggccatgggccttctccacctaatggccatggcagagcatataaatgaaaacagatgtttccagtggtcattcagtactgtaactgtcaatattgtaatttcctcaaaccaccccccaggcaaagaaaaaaaaaattaaactcactcccgcactcactcccgcacaagggtagtgaaaccccataaatcatttattggattcatggaaaaggagtgtgtgtgtgtgtgtgtgtgtgtgtgtgtgtgtgtgaagggagtatgctataatttatgattaattgcactgtataaaaatcaaaatgaaagcataattttaagatctacaggttttccctcttgatgactttgacaacacttccatgtctaaacccaaactgttggctgcccaaagaaaagaatttctttgaataatttcatccccaaatccctggtttggcctcatataggagatacaagccctgccacagtttccttattatctcctttccctggcatatctatatgacttctgttggcagtcacatctctagacttgttgagttgggaaaaacaccctcaaaacattctagaaaatgagaacaatgtctctgtcttgcttgtgtctcttccaatagataacccagttawaaatagacaacaacccttttgcaaaaggtttccgggacactggaaatggccgaagagaaaaaaggtgagttgaaacaattatttattagatagtttagaaaaatccctttttttaggatccaactctgaagtgttagaagtgagatgcaggcacttatcctaagagcgggtggaaatcattcactttccccactgctacatgcttgccgctatcagtatacccaggacaagtacttttcctacctccttacctttaaggaaattaactaggctacaccatacttatctctggaagagaagcatcagggataatagattatacagggatgcctattaattcctaattaatttaagttcatcctaggcaggtcccagaaagaaccatgccattgagaaaatacttgggaatttttgcaatcctgtcttccaaataccatcagacagagctggggacttcggaaagatgtatggctctctccctccttcgtggggacatgtatcattttgcattacgtagacagctggagagtatatgaaagagggtctcccctcccccaccccctttcaaagaatttctaaaatccagaaaatcacccccaaatttttaacctatccccttggggcgggcattaaaaaataattgctaacagctaaatatatttttattccaattaatttgttagtaaaacgattacagtaaagtgcagcatgaaataaccacttcctcccaatcttagccaccatccaaaatttgggtatgctggggacagacagcgttgtgtttgcaggattggacacccggttctccctatataaggctggcagtccagctgtctctgactagatccagcctcttctcctgcttttaaataaaatttcacagcccaagcaaatgccttttcctaatgaaaccycatcttgaataaatgcaactgaagcctccttcctttctccctaaccctctgccacactcttcagcccagttagagggtcaaggacaaagcttgggtctatgtggctgccctggggcaagcagatttcagtgaattagcgttgtccctgggcagcaggcagggtgtgaggtatgtgtgtgccgctttggaaagggtaagggaaacaaagaggggaaatgtatgttacattctgtaacctgggtgtgggcttctgccacagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaaggtaaaccatgtcacctttgtgatcactggactccagtccctcgtggcctggaagagttgaagggggatggggcaccaaccarggcacttgccctttaaaagctagaagccttctaaacatccttaaacagaagccagagttcaaaaagggctatcaggtgtgtctccccttccccgctaaggcagtagaaggagagcacagaggcctttctcccagatccttatttggctggtggggaggggaggtgggtgtctgtttgcatactacctcttggcaagcagctttgaaaacttgcttgaagcgcttctctcttttctctctgtctctgtttctttctcctcccattctctccaaccaacagaggctccaactgctgacttttcactgtctttgaactctaggttacaatgtgttggactgggtgggggggaagcaagggactctgccacctggaaccgagaaggtggcctagaaaacatccagctataaagcaacaattgacctgggagaggaggtggagcactggggatctgcggtgggggtagagctgggggaggtgggtgaggagtggacaagatggctcaaatcccccctcagttacctgtgtttaaagagcaagcagtatttatttggaaagacacacacacacacacacacacacactctcaacgggaagaaacctgttttttagtgaaataaaatgcaagtcctttatgtcttcaatccatttaagctttaaacataaaataggatccctttttcttttcttctggtggaacacccacagagggtgtggtaaaagcgaaaaaagaatctatgatcgtccccgggctgtgagccatctgtccgacactcatctctctctgcagggactggggcaaatacaaacggttcaactgagtactggtgttgaaggacaggtgtccgttctgccattatcaattcagatgtcagggttcttgccaaacaaatccttccagagtaattcacaaatttgtggaaggtgctgctctctgtcrttcactgattttttgatagtaattagaatatgttccagctgtgagttttaatgttactttttacttttaaaaagttaatttgcaatcgaatggggaratgcatgtgaaatctgccactgtaggaactcaaaaaaagaagtaaaattcattaaaataagaagagctactgattaggggattgtccatctaagggaaagtttaaactctgggtaaatactttaaattcataatcgcttattgaattttccagcaatgttgttgggcacgattatccccattttgcagatgacaacactgaggtgcagagaggctaaggggctttccccgggattacacagccactaagccacgagctgggattccaacttgggaactggagttccgttggctcatactggagataacgcccttctgccttggttttttccttcgcctgtggtagatttatgtcccagcgagggtgagagcgacgccgaggccgagagcaaagaggagcayggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtckcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcaggtatggatccttcttcctgcctccaccagtctttccacctttcgtccagtttccctgtcctttgccagcagaccctcacccgatccctttggcctagtagctgtaataatttttactgagccattaccgggttcaaggcttagctcatggagttattatgacttcattctccccattcaccccaaaaatctttaaaatttttccgaagttaaaggctgtttccagcagagtagataggtagtaacaaagataacagctggacacagcacttactttcaggcattcttctaagtgcttgctctgtattgactcatttgacctaacccttcaggggtactattatcacctccactttacagatgaaggcgaagacgcccagagatgttgagtgacttgtccaaggtcacacagcgggtacatggtggagctgagactcaaccccaggctatctgactccagggcctctttgagggtttctgattttagcttcagagctgacatgtctcttaagtgtctcatagccaacccttccccaggaatgggactctaggcctggggaggggaagtgactacttcctgagtaggagttcagtcttgattcctccagcctttcctcccagttcgaagctcttctccccacccccaaccccargcaggccagcctattcctcgaagggttaatggtttgtgcacacgtgggaaatgtcagaggacagggataagcagggactggggcaggcctggaggcctgtgtgtggctcagacagctgtgctggggggaggtctcaggcggctggaaacaccctgaactcgatgaaaaggttctatgaggttttgcatgctgttgccttttgttttgtctgagcacattcgtctggtctcccttccctgcgccaagaaaccagattggcctccccactccagggaggagggagctgaggaaaggcttggcttctggcatttctcaattcctcccatctcctctgctggcttctccgggagaccctgtcctaggtgggcaggtggttggtacaccaaggactacctgaacagacaaaaccttaagggcacctcaaggcatgatgcagagaactggcccaggccagggtgcctgcatcttaaatgctgcttctgccaattcccagcttagtgcactcctgaactcctgcggcctacctcggcttctcacctggaacaccagtgaatcatgctggacgatttctttgtctctgtttataacaaatgccctttttccctcccccagccccagtttccttttgcttaagatcttcactgtctgttttttttgttttgttttgttttgtttggagaaacttctaggattggggtgggaggatgggggttggggaagaagaaagatttaaaaaattattcctamtaatttatgtcctccggcttccccttggttacctctgtggggtaaactgaatctgtatccccatttaacaggtgcaaggagatttcctgggggctgcacacactgtgtgcagcatattgcaggctttcactcatttaatatctacaaagtcctcaataagtatatgaattacttatgatttccctgttttttcttcctataaggaagctgaggcacaagttaatcaaagtctcttggcctagggtgacacagctaagatttgtacctagagatttctgagtgttgacttctctcctgcccccacctatctccccccccmaaaaaaaamacacaacaacaacaacaacagaacataccagggattcatggcttgcccaatgttggagggggagaagagaggagagggatgagataagctcctcccacccggctgactcgctgtgtgtctcttttctcaccccagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaargaggcggccaccagcgaactgcagagcatccagcggttggttagcggcttggaagccaagccggacaggtcccgcagcgygtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcsggacaagtgaacacattaacatgattctgtttgtgcagattaaaaactttatagggacttgcattatcggttctcaataaattactgagcagctttgtttggggagggaagtccctaccatccttgtttagtctatattaagaaaatstgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccargggagggrgggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaacyttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggrggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgrgttctttggttttctgtatttttccccctctctttaaaacatcactgaaatttcaataaatttttattgaaatgtctttgggccttgtgttaaatgttttttctttgggaacctttcctgaagatggacagtcaggggagggtttagtatcttcttgttctgagtttacccccttcccttcgcctttaaataattaagaccgcccccagcgaaccaaaatgagatgtcactcaagttacaaagctaaaaacaaaagtcccttacttgagcgaagggagccacttcaatctgaaattacttttcctttaaattagggagcaaagcagggagacggaaaggggcctgatgagaatacagaaagaagggtaatttcagatacttttaagttttaatggaaaaagactgatgtgctccctaagtcaggttttcccacccgaatccgaccaaaagtaagctcggcaagtacgaatgtttttcgttttaagctcgccctcagttttgacatcaatctggcgaatccaagtcgaaaataccttcttgcaccagtgtgtttggctcggggaaaaggccagcagaatgccccagcagtccgagcgggcttggctaggcagcaaccctccaggttgtagaagtggacaagacgcaacgcctttccactcggcaaccccccacacagcctgcagtccctggtgcctcaaattgaacccggctggcccaaggcgcccctacgaggccccatccatcccgagttgtgcgtgcaaagcgcggccagctccgcgaaaacttagctgtgtcacgcgagggaggagggaaattatccccgaaaggggaaaggtaattccagggtgcacatttcaccccctccacggcaaaagtcacccaggaggctgacatcctcccctagtctccccttcaaacccgtctccaggctgttcggggagttgccttttgaagttcaatttatctttgaaacattcaataaaaaatgatgaggcactgtcagtcttttggtctcccgacccccagcctcgcctccgaggtgtgtgtctgttggggggcgggggcggcacgggaaggttcgagggttagtccttagcccttttcttgccctgggggccatgacgtgaagacccagctggagcctgcctggcggctgcctccctccccaccccccacccgccaccccctggagcccgccagcccggccccaagtccctgtcaccttcaggcctcttgaatgaccggagaggaggacgccccctcccttccctcatcctgtacttggaagggatcgaggtcgagaccttttggagagcggggcaaagccccttccatctctggccaggcacgtggggacccctacagcctcctctgcgatgtctccgggggtgggagggaagacagacaaccagagtatgttggtgcggagtcgcggggggggggagggtcggggtgcgctgcgggggtggcagggcctgagctgagacgggccctggggacctttgaggctggggctcccccgaggactgggagatttccagggcgcgctccttctgcgcagcggctacagcctgaagggggcagctctggatccagcgacaacgcgcggtgtccgcgcctctgagaaggtggtagttggctggttgcgctctcccgaattggggaaaaaagaactcagcctccaaaagggaagaaatgctttgcttttctcttctttctcagtccaaatttgcttacctcctcccttctctccccccgcccccgatttggggaccctgctcagacgtgtgtccagcctctcttactggcgttcctctttttttttttttttttttttaatctcctgtgtatctcatttgtatattgkgatgttaatgagtaactcctgtagcgctgatgggcggggggtggaggggatgaacggctcgcagtctctctggattttgctgcctattactcacctggcgccggtcgcaatctcgccgcaggctttatggtggctgcggccgccccagaggccactcagggcaggcgccttcgccttttttctgggcttcgagtgccacctatctgtctcgtctacgaatgcgtccaggtcgccgcagctggctcggcaccccagcgcctcccgggttccggaacttgggcgcttcgccttcgccccttctcatccccaccactcccagccccactmccctcctcctccgtccccagccccattctcagcctcggaagaagctgccttcccctctttcctggatatcactttcactcccgtttgtgcctcagatgagaaaaacagccctgccctcctctgggtttccaaagaatgttagaaaattcagtgcgggaaccctggctcgtaattctctggacaagttccttgctgcttgtagaaatctctagacccttgttctggaccccgcctggcgggggataacctgaattcgcgatgggtcgatagagaaaggatacctccttccccaacatacacacctcaaattctgccctggggacaacttgccagtaccaggatgctctcttttttactccacaactttggaagtttttgttttttaacctggccgcgtctacaaggacaaaggccatgactcgcgggagcagcagtccctacgagggtcagctaccgcagcctgcagggcccagcaccttcgtgacttgtagatttaaggtgacaaatgcgggtgccggtcagaggcctccaacccctgcctgtcgggaaggtcggctccagtcctggctgcgccctggagtctgagacccgcggaggggaggggatggggtcgccttttgctgtgctttgagccgcgggtgaaggcgtccgggttcctgctgacctcccggcgctaattgcaggggccgaagggcgcgctcgggcagaggcaggggtcacgaccttgcggctccctcctcccgaggtcccggcaacctgaaggagccgggtgtgtgcaagagggcgtgtgtgtgtgcgcgctcgcgcgattagggcctctctctagatctgcgctgttctgggacccactctttctttgtggggacagttcctgacgtgtaggcccttaaaaaaatttccatccaagaaggaaaacccagattctgacctttcccctaagccagcagacagacagccgccttcaggccgctacgagaggcttgcaacgcttcacgacagcgcgctttctgcctcgctggtttccaatgtgacctcacggcaaccagccaagaaagtggctgtcggggtgcagctgcgaggccgccagcggcgacctgggttcttctgtaggtagcccagtatagactcctatctaagggtagctcttgggtgtctgcattctggggccaggagctgcaggtgttagaaggatatgtgtatgtttgcgtgtagctgtgcgtgctccatctgtagctgtctcttccaatttgggtttagaagttcytgcgcaagacagttccggatgtagatgcatttggttgttttataatcaagatgcgtataatcaagaagtatatgttgcagatgtcggagttcaaagtacacgaaacaagaataatataaatacttggcatacaagggacacgtgcacaagccaggcactcggtgaagcaccccataaaagtgacccccgttagccttcacagttaaccccataaacgatatatgatctttatctctgttttacaagagaggaaactgaggcatagaccattaaatcacttacccaagatcctctggggaaattatggagccaggattcaaaccgaagtgggctccaggatccactgtaattccctttcctaattcagctgaaggtgtacgtacctgcggcgcatatgtcccggatttacagaaatctgaggggatgttccggattttggagtgtgccgcaggcttttttttttttttttttttttttttttttaatacgagaacgttcaaatttctttgtgcatctgtcgtgctatgtaaaaggacagcttttatttcagcatccccctccccggccaaccctcttgtgtgtcctgggacacccgtcccagctaagaccgcggttttggggcctttgttccccggtagaggaagagagaggctgaatgggggacgcaatactctatttaaaaatgcctgcggcggggcactgaagctgatcgcgttctggtcccgatctgaaccgcgagggaaaccgcgggggagaggaaattccaacagcgctggcgtacgccggggcccgcagggcgaccaccaagctgacgccggggtttccctctcccgcggggtctggaaccaagactggggctttgggtgtctgaggctttctctgctggcctcagatcctcccccgcgtccctagcatttgctatgttctgtctacccaggcgccaaggccgagcgcagtccggggactgcaggtggagacgccgcaggcagagagatcttcgctctttctgggttcaaccctgcccagcttccaggaacctatgacattttagttttttccgccctctcacttccaacgttttggccccagctagaagcccaggggttcagctggtggaaagaaggattctacagagaagccggcgaaggggtgctgagggtgcagccccgcgaaggaaaagcgctgcctggttacccggcagtgcggcccaggttcccgcagcctggacaactgcaggccccacggccctagagagccagagcttgggtctggctgcacactgggtaggggtggaaataactggcttgagtagggaatagcgcctgcccccaaaacgtaaggcgcttctgtcccgcggctggggtgaattctgacggcctttgggtcccgggtctccccaaagcagtgaatgagactcaggcgcagcctctggaatcggggggcggggggcgcaaaagagaggagggttttgtgggggtgggacccaaccagttggaatctgtacggctactgtccgggcggtccggctcttcccctcaccatccccgacccccaccatcgcccccccacccccccgccccaattccagcgctcccagtcagcctgtctctttgagcttttgaaatgcgatccccgcgccacttcggtttcccgctaatgacccgggctctggtttcgggttggggaattgcacccggaggacagactcgcctccccaggcccgcacagccaactctcgcctaggtcctcttcgcgcccgcgcggcgggcccaggaaggtgcaccctttgcctcccaaatgtccccaaagcgtcaagaacaccgcaggcacagaacccacagtcgggcgcgaacttttttcctaacgcttttgcgcattgtccaccccagtcccgaacgcgggcatcgttgacaaaactttttttttttttatgccgggaccgggcgcccttcactcgcgcagaagcgccagctgtctccggtcgttaccttagtcaccctcaacctccaaccctcccaacccaggcatacagccgcagtgggagcctgttagaagcaccagcgctgaatatgtatctgccaaatggcgcacscaccaccccaaccgacacccggcttcccccccgcccaccccgcccccagggcacccactcctccagagccggcacccttgagctaattggggattagkcccagggctaggacttctaacaggaagagagggctcaggacttcccgtgaatctcctgaaatcatacgcaagtttgttattgtgcagaggcgcacatttctcgacgggatcctacaatttatctccgattctcagaagtgtgtgagcccaaataaattaagaccccccccatcactctctgggaacaatacgaaatgagaggattggggaacatttcaggtggtccctaacgattctagtcttggctaagtagaatttaactttagaagatttctctctgtgtctctcagggaaggacgctatttccttgcttatcttaaatagtctccagaccccaaggcctcgggcattgtataatttgttgagtaattaatgatattaacttatcaacccaatggttatgaacaatcattatcgccctccaatgaattc

SEQ ID NO: 12415 - DNA, 134184 bp, Homo sapiens
  misc_feature (1)...(134184): n = A,T,C or G, or insertion/deletion polymorphism (see Tables 1-2)
cacgcctgtagtcccagcactttgggaagctgaagggggtggatcacgaggtcaggtgtttaagatcagcctggccaagatggtgaaaccccgactctactaaaaactacaaaaattagctgggcacggtggcaggtgcccagctattcaggaggctgaggcaggagaactgcttgaacctgggcagcagagattgcagtgagccaagatcgcgccactgcactccagcctgggygacacagtgagactccatctcaaaaaaaaaaaaaaaaattaccctttctttctaagagtaatcagttgatcctgtcagggtcaacaacttattaaggaaattctgagttcccatgacaaaaacatgttatctacatataaaagattatttatctctattctttatagtgggatacagttcgcatttggttagtggaataataagatttttgagatttgaagttctctcttttcttcatgggaaaattttgggtaggggtgaggttggtctttgctactcatttttggaaatacttccttttttattgtacttgtatattgttataaataaaattctggtttaaatattatgaattatggatgtgtccttttgtctctcttttaaaactagtatcatgatataaagatagtttgcattggatgcatgggtaaaaacaggggaacccttatacactgctggtaggaatgtaaacaagtacagtcattatggagaacagtattgaagttcttcagagaactacaaatagaactatcatatgatctggcaatcccactactggatatatattcaaagaaaggaaatcagtacaccaaagatacatctgttccctaagtttactgcaacattactcacaacagctaagatatggaatctacctacctgtccatcaacagatgaatgaataaagaaaatgtggtatacacagacagtcacacacaatggaatactattcaatcattaaaaagaatgaaattctgtcattcatagcaacatggatgagcctagaggacattatgttaagtgaaataagccaggaacagaaagacaaataccacatgttctcactcatatgtggaagctaaaaaagttaatcttgtagaagtagagagcagaatagtggttactagaggctgggaaaggtagttgggatgggggatagatgcagattggttaaaatatataaaattacagctagttaggagaaataaattctagtgttccatatagcactataggctgactgtagttaaaaataatttattatatatttttaaatagctagaggagaggctattgaatgttcttaacacaaagaaatgatgactgggcactatggctcacacccataatcccagccctttgggaggccaaggcaggaggatcgcttgagcccagaagttcaagaccagcctgggcaacaaggtaagaccacatctttactaaaattaaaaaaaaattagttgggcatggtggcccatgcctgcggtcccagctactcgggaggctgaggagggaggattgcttgagccctggagttggaggctgcagtgagccgtgtttgcgccactgcactccagggtgggtgacttaaaaaaaaagatagatgtttgaggtgacatacatgcaaatcaccctcatttgatgaatatacactgtacgtatcaaaacatcattatgtactccataaatatgtatgattattattagaaaagtaaatcttttttcaaaacaaaggagttttggcaattctgttaaaaaaaaaaagaattgggtgcatggggctgggtgggaaggaagggttttacctcatacaagaggaatcctgtctttacctgagctcgccacgaaagataccttatcttgttttgcttggatttgtaccaaggacctaggcaggatctataaacctaacacaaagcatcatgtgtagtcattgtaactttgaagagggatattgtcattctcttccagtatcacattaatttttacctaattttaaattcttatttgataacctaaaaaccctggaaatgtgagaacgctcttcccttatcctctttcctatcatgacgttgacataacagaaaaggaaacagcattggtcagggagccagaaagagcaggttcctggcctgactttcctcctacttgtctacagaggttacttaatctctttgagccttaatttcttcagctctgcataggtgataacattctttgcttcagtgtaattttgaaaagtgtaacatagaatgtaaatataggctaacattgtcaatcattattaataattattatgtttaggttgcatttctaaatataaaaagataaagcatatagtatagtgatgcttaggcttgggaagaatacaaggaaatgaggtcagaaagaataaggactggaaaaataaacgcattggtaattataaaaatataaaaaatgacaaagttgcaatggaaaggtcaatgcaaacttttaaattatttttctaattatatcacacattctaaatcctgctgtagtagacatccgttgttttttctgccttataacctgccctcttctggtaacagcaagctttcctttcaattgcttttcccacattccatggttttctgttgggctgccaaacaccacacacatggtattctatttacctagctttgggggtatgccaggtgaccaaagccaagccaatcaacatccttccttgaaattatttatatagattatgaagggagaaatctcttttctctggagtttcacattttttttctttaattggagctctcttgcccatacaataaacaataaacaattacatttcctcatcctgcctttgttgctgcatagagacactgatgattgggcactaagatcatcttttgagggacctgaataaagttttccccatccgttcacatttttcttctaagtaccatgtctggtagataatgaaactcccctccccctccccctcccccctccatccctcctttttctctctgtctttcagataatagaattcctctctctttctttctttcttttctttttttttttgagacaggttctcactctgtcgcccaggctggatggagtacagtggcgcaatctcgctcattgcaacctctgcctcctgggttcaggcaattctcctgcctcagcctcccgagtagctgggattacaggcatggacacaacgccgggatgatttttttcctttgagacagagtcttgctctgtcgcccaggctagagtgcagtggcgcgatcttggctcactgcaacctccgcctccctggttcaaggattctcctgcctcagctgcccaagtagctgggattacaggcacgcgccaccacgcctagctaatttttttatttttttagtagagttggggtttcaccatgttggctaggctggtctagaactctttacttcaagtaatccacccgcctcggccttccaaagtgctgggattacaggcgtgagccaacgaccccagccggcccggctaatttttgtaattttagtagtgtcagggtttcaccatattggttaggctggtctcgaactcctggcctcaagtaatcccctgcctsggcttcccaaagtgctggaattacaggcgtgagccaccgcgcccggctgataatgaaatgtctaagcacttaagaacgtgcattcaaaagactggagttttttgaaaaacagggtaacctgcagtaaaagaaattcttacacactttcactttttttctttaaatactgtctagtagactgtggcatctctaggtggctaaaataatttgtcgataacatcaaacatctggttagtgttcaaatttctcaaattgtcttaaaaattttgttttaaccgttgatttgtttgaatcaagatccaaataacggagcaaaatttttatcatcaagcccactggctggttacactttacctcttttcaaaatagatgtttgtcactgtgacacatttccataagcaagagaattgagagattaattcaaggtctctttatgtgctttacaaatatcagataagctctggtaattaagttacggaaaattcgcataagtaatatcttgatgttagtcttggacattaggactcaaaaggcagcaatgacaaacccatttatgttgatttcacagcctttgggggtctccttgtctttattttgattgttggaaatagagacccacgctttggccactatataacaaagtactaaaaatgtataataaygcaaattcactaatatgtttattaaaatataaacaagtttattacaaatctgtagctttattcacaactaacatccttatttttgtcctatatgcccacgtttgtcctcaagtacaacgaaggactgagagagcatataatcccctctaggtgtaaatgaacgtatttatttcgcttcaactcatgtatgaaaggattaaaaaattattagtccccacaacttaattctcccaaagagaaggtgccaagaatgaggcacctttagccatgcataatctccacccatctcatcaaataaacggaacagtgatgaacataacttgctaagtaagctcagccgtgtaacaagaccctagattcccctcccttcttcatcctaccagaacattatccttaaggttttcctaatcagcagtctgcgtctaactaaccctaactatccagagtcacctaacatatacttatttccttgtttcagattcccattacgcctatcttaatgggacaactgggtccgaaattatgcatgtgtttttttgttttgtttttgcggtgtacttattatccgcactttatcattaaattcctgaaaagctagaacaaaacaaatccgtgtcattcactatgtgcatcctctctgcttggggacgccaagggtttcaagctgctgcctccctgccctggtctctgcttgccgtatccagcactgggtaagcgcccaggttctgctccgggactaaaactcatgatcttctggctcaggttctgtgaactgagtcattctggcactgagaatattccgtgactcagcaggcccgaaaaggaggatgtcagaatccacataatttcgagtcttttaaaggcaagccgaggaacacaaacaacacagtggaagaatttcgcagtgggtcgtgcgtacccaagggaaaaattcattccattcccagccttttcacttccttccttgccccggtaaaacgactggttacactttaaatcagcggcaggaaatcgcttcacgaaactcatctggctgctgcgaccaggcccttctgattctccagggaccgtgtcggccccatgaacgccccgggacctctgttcgggaggggctggagcggggccccgggcagcagcgggcgctcccggttcggacccacacctggccgggcggggaccctcttgccgcagcccaaattggcgcgaggccccagggacgaccccgagcgacctcctgacccggcatcgcccctctaaggcgccctcccccgactcctcccgcaatccggagtctcccaggccgcgccagcaaggaccccagcgactcccgcgcggggagcgggtctgcgaggccgcccttccctcccggcatgcaccacccagccgccctcccctcccctcctctcctctcccctcccctcctctcccctcctctcccctcccctcccccaaccccctcccccggctccccgcccacctcgcgcgcccctccccccgggtcgcgcgccgcgggcccgagcgcgagacgccgctgctcccgcccccgccgcctcctggagtcgccggggcggacgcgcagtccatggggcgcggtgggccggggagttgccccaggggccgcgggagttgctgagaggagacagggttgggctttctcctcgcccagaccccaccccaccctgccgaccccaccccctgctccttcctccccgggggcgcgcactcgggcacgcgctcggaagtcgggggtcggcgcggagtgcaggctgctcccggggtaggtgagggaagcgcggaggcggsgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcaggccgccgcggcgggctgtgcccaggcagccatggacgagtgcacggacgagggcgggcggccgcagcgctgcatgcccgagttcgtcaamgccgcyttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggtaagcggtgacagccccgtcccctgctactgctcgccagcagcccagctcccggaccggctccgtcccagtggccggcctcacgggcgcagacggccgcgtgtttgctctctgttccccggcatgggccacacagaaactcctttctccaacttcttaaatagatacygcttttaacatcccgtgagggccaggatgttccgcacgagtctctctgctttcctgttctttctgacttaacgggattctggctctctgattattctgcatttcggctgttaggattgtgatttcccccttttttttctgaagcgttaatcagaaactcccatccccacttttctctttgctagcaaggtcatcacagcgcattcttggatcggaaacaagaaggtccgccttaaacactttcgcctttaaaatgtttagatgtccttccagggctgagggtgattgctctgttgagttaagggggaatttgrggggagcaaatgccttcgctgcctatattgcctatgtgtaattaaaacataaattcacttttgaagttattgttctttatagctgctcagccttaattaagaaccacaaagcgatttgactgctaatcctggtgcagaatgaacaaaaggaagtgcactcactgtaattgctgggcatagccttgtccctgggtaaaaaggctctcctytactgtcttcccttttgctttcattcaaagcaactgtagaaacacgtgtaagtgatgtttcagaaatcaggaaagggatgtgtagaaaacttcatggcagggcagtggattgaggatggacatrtgtatctggaagcaccaaaaataatgttcgrtctagctaaggttttcttcatcattgagataygtaaataggcagaaagtttcattattgtgtttaacagaggaatctatgtgtgagaaacacgtttgacttaacacttcactccccattgccttggaaggcttgattattaccagtagctggtactaatgaacttccagagagaacagactgccycaagccattcttctgtcaagggagggtaattttgtraggctaatatcacttaggggtgttggaaaggaacatgttgtaggcaaatggttcttttgatcatgattttgctgctctccggtacactaaactttatgtaagtatcaggattccagagaaagaattggacttaacaaaaagtactttgaaaagtgggattaaattattgtgtgtggaataagtgttagaaaagcagaattatttaacatcttatttgcagttgagtcattaaacaaatgaaacattttgaaaataatttcataaaatgatactatgaggtatctgtttttcagggattgaagaagtaaagtgcactgagttcagttttttaaaggtgcctttctgaagacatagctagtgaccgaggatttcctaagatctgtgagattgctctttattttctcctgttatattttttaagttggccaaaattatttttgaaatgtgtatctaagtatttctgtttaacttttgacttgttaaagtttctgtgttcaagtttgaatactcttgaagtcttatttttttcattttcagattttaaaattttcaaagaaaaggcgttgcctgatgtctgaaatctcagatgcctgaaattcaattgacaattactgaacaacagtctcttatttacataaaggtggggttgtcaatcttggctctcagaattttctcttgtaggcactgtgtagctaaaggttatttaaggtgatttcagaggtagatagattactcagtgattactaccctgttgcaaagataatgcggtagagtaacccagtatcagttacgttagattgctcccactgggaggcagatatgttaactttgggtcatggttgattaaaaggtcaaaagagatcttagagtttacctctaacatcactttttactatraaatgttttatgcttggacttggttttgctgaaattttcctcaacttttggtaatattcttgctaaatgaaattcataaaactatgagtttaaaacttgtaagttaaaagttaaagtattttcttacaagcattgtgattaactgtaaaaatatgtactttaaacytctagtttaaactaacttgactaggatacttgacttgttcttggatcagaaatgacatcctggaagaaatcatgcatagtggaggaggtgggaagggggaaaggtttgtgtgtagtgaggttgaggtttctctttctgtcctccccccccctttaatgacaaggttatatgtatacatgtatgtttcgatcaacaatttatgacaagtaggcaaggtgtcatgtgtcactgtgtgttttgatgtttagcatattcactccccaactccagttactccatgggctgtagctaactaattatttcccatgaattaaagtaccgtgactgttttgtgcatctattaaatctccctcccagttcaaatttcacatacccttaaacaagtgatgcatattgtgctttgctattacagagcatgtgaagctagaaatgagtagtgtgaaagaactaggtctagccaccacttttctagcctttcttttgatgttgaactttaaatacagtaaactttaaaataagcagtcaaatcatacataagaaatgtaagtagttatgtaagtgttttggcactgacttttttaaattatgaaaatgaaacatgacattgtaaattcaaacagtaagtgtaatgacaagtgagtttctttatcacyagctgctaagctccatgccctagagaccacccttcacaatttcttacattaatatgaccctctagaaatttttcatgcatacacatgtgtatataaaattataggatcattttaactgatactttttgggaggctgaggcgtattttaacagatggcaaatacaaatctgattattgtgccygtatcatyacttgctgtacaaaagccaggaaaatcagtgttgattctgaaaacagcsctctcttaagcaccatacacagtcatccagggtgcagggtgcagtgcatcctyggataaaaagagttaaagttgctatgggaaccagaattgcactttctgcttgttgtggggagaaatctccaccagccayttttctaagaagaagtcttttttgtttcaccttcaacttctggatggattattcagttgctgttaaaaagtttgggttttatgtcttataagttatagtaagtttttatcagtaccagtggggtagtagttgatactaagattgtagctaaggatttgccttttatcaaacagccccattaattaatttgataatcattgtggatggaaacttggcagacaggatcctaatcttgagaaaggtagcttttcctctttctaaaaacaattagattaaggaaaagagtgcttataaaaccaacccaatcaaagtttatgaaactcctaaaattaacactgaaaccagattagtttccaagctcctcataaactgtaggaaccaatagtgattaaatgaagcttttraatctgcatctgcatatcttttttgtgtgtttaagttagaataattgatatataaggctattgccttttattctctttggtcctctgctgagtgtgtatgtatttaacatggaacaaatggcaatttttccccccaggaaaacctttgcaaggtgggttctgactatgtcagggaatagctcactgtggtgacttcactgtggtatttgtgcaccctgaggggacactattttagtttgtctcacaaaggcctgatttacattttgcaggtttcaacttgagaagttaaggagctcttccttaatggccagcagttgttgaacacagttttataaagttgctgttggctgctttcctgttctacagttcactgctttttctccaaattccttctccattctaagggcattcaaaaaagaatttacacattaggggagaagttggagctataaggcattcctccccccccccacctcttccatttgtcattkgtcacatttgtgggaggaatcaagttttgactatttcagttctaaataattttagaaaattgggtgtgccttttgctatgcactccttcctcctgtgcatacattctcatgttattgccggatattctgcaaacattttaaaaaatactcttgaaatacataccactgtacctgatagaaagatgtagaagattgagggtcctatcttcagaagattatactttgttaggaatttacacactcataatggcattacaataataaatcaagggtgtctatataatattttacagtttataaggcctccagtttatcactgatgagatttctcacaacgcaaggaaggcaaagatgcctaaggttgtgatttgcctaaagtcatgtgggagataggtctttgactacctagttgattgcattcgttcttgcagcttgcagcttcyctaacgagtctctcgaaagaaagtctactttattctaagccacttttaaaatttcatgtataccctggttcagagataccagactcctttggttttccttgttttttcttctgcatacttctttttatttatgttcctagattcctctcttttcatgctgttcacgcttcgtggatgaactcgtgtttgtctcaaggctttatttgcaatttcatttgtaaatttgtaaattctaaagttgtatttctagtcagctctttttccagatctaaaatcttgttggttatggtcaatttgggatgtccagagaccatattcaaaactaaattcactccttgttgtctcacccaactcaaagctcttttggtattccctatctcagtgaactacactgctgtctaacactgagtttctcaaccgatgttgcccacgtctctcctgaaagaaccatgcttgacaggcttcatgagtaaagactactctggtgaacagataggatccactgctgtgtggtcggtcggttctgggtagctataacttcacccgtttctttcccaccaatcgttactataatctgtccaagactctactcttaccttctatatccagacactaygtgtcttgaatgcttatctttctctccgtcctctttgtctctgccttactgtaagttccttactgtaagttcccattgcatttcacctggattgttgccacagcctccwaataaactggtgggctttctgcctccagttttgccctttatatttgggcagccatcctttggactgagtgatgattctaaaatgcaaatctgatcatacaattttgcagctaaaaattctgcagtggttcctcaaggttttatgataaagtccaaactccttggcgtggtgtacagggtacttaggatctggacctttttgttgcttcacgtgttcacagggctgttctttggtttggaacacttctcccaggtgttaggactccttccccagtttctctctctctcccctttctgccccactccctggcttggattaagtctcccactgacgccaccctgtaggtatttatcacagtccctatcacataggattatctgtttctttacttgtctgtttctacctttaaaccatgaagtttttgaaggacgagtcaggggtttagtaatcttttagttcagttaaagatgactaatattggttaattgcttgttatgtattagcaacaatgcaaattcctggatgtgtagtgattcatgggacattgccctgacctcattcttagatgaggtgtagatgcagagacccatgtctctcgatttgggggtaggcaaatgatggccttcttagccaagtccagtccagtcctkcctatttttgtatgggctgtgaactaagaatggtttgtacatttttaattggttagaaaaaatcagaagaataatattttgtgacatgtgaaaatttcatgaaattcaaattttagttacccataaagttttgttggagcacagtttagcccatgtaacaaagcattgtctgtggctgtttttgcacaataagggcagagttgagtaatagcgacagactccatatgtcccagcccacaaaggctgaagtatttactatctggctctcatagcacaggtttgttgacctctgttctagagcagtactttcatgttatatagtaagtcctaagtgagagatgcaagcacagagaggattcacttcactgactgtttgggtggaggctggaggcattctgtctccagtgacacttgtctggcatagtgttcataaaaatatatgtacagtgagtgaataaatgaatgcctgaattataaaactcccagaacattgaacattaacttaaattcttcaaagcaaaacttttgagcttgtgtttattttttatcagtgccatctctccattttataagatatatgtcactgtaatagctaatattaaatgtagtatgtggttttatttctgtaaattttttaaaaaagtactaaggtatggaactggtatggaattggaaaggcctatgactgtccttttttgggtaaaaattagactgttatgtgacttgaaggcagcctagataaatcttaggcgaaaactcatgaattctcacatgtgaatatgtatttctgaaatgttaatttgtatttttttcctttaaaaatggacataagcaaattttatttaaagtatatatattctgtagtttcagctacttgggaggctgaggcagagggatcattcgakctaagaagtttgaggctgtagtacaccataattgcgcctgttgaatacccactacaccccagcctggacgacgtagaccctatctcaaaaattaaataaataaaatrtatatattcacatgtacattgttgaaatagattcttaaagggaattattaagcagctgaggggaaaggttacaatgaaatatttgcttgttgtatatagcatccttttaagtttagtgaagtcatcatgagtagatttagaagataggcatactgtttctttaggatagtgaaaggactgtaaatgtagagtacggtatagcccagtgtattccacattaaagtggttaggccgatgagcagtaaccacatattcatctaaagttaataggcagcagcaacagttgcttcttttttttctttttttttggagacgagtttcgctcttgtcgcccaggctggagtgcagtggcacgatcttggctcactgcaacctctgcctcctgggttcaagctattcttctgcctcagcctcccgagtagctgggattacagacatgtgccaccacacccagctaattttgtatttttagtagagacagggttttaccatgttggtcaggctggttttgaactcccgacctcaggtgatctgcccgtcgtggctgcccaaagtgctgggattacaggcatgagccaccacacccggccctgcttctttacttgttcatttttcctactggactttattgacagctgtaccactgttctgtttgggttttagggaaaggtgttaaagtttagagcagagctgtttgtttatttttactgctgaaaatttctgagaaggtttttaaaaatatgggattaatgtttcttcaagttgtcagcttgaaagtgtaaaatttcaagatgattttgtgcagatcctattactttgccttggttgcttgctataagacttgtttaagatagaacttgccctgtggagaagaatagagtagaataaaataatttaaaaataagaaaaaaaaagattaaagaaaaaaaaacacatatgtaaaagggccctgctggaatttgcaagcatctcctttcttgtgatataaagttaggtgtttgctcatttgggtctaaaattgacagcttgctaatggggttaccagaaaacccatttatagaaacattcctgagattttagagtactgcaccagactagggtggcactaattaagtatgtctgcttttctatgtgtgtgctcttctaggggccagcccgaaatamgtgggcccagtcagcctggtacagctacatattcatgaaataaaataaagcagacttctctctttcttagacaatggcaccctcagatctcttgtgggagaagaatcttatggtaaggctgggaaatgaataaggggatttaccttatttcttttgaactttaggagttacatttcctcagttcccttcttttactctttgtttccatctgtgtgtggccgcttcctcttatattgagggcaacattagattcttttatttttagatttttgttattttatctttttgttttgaaagttggaggagataktaattcaaaatcagtcttcttcacattgcttgcttttttttttatttttaaagagacaaagtctcactctgttgcctaagctggaagtgcagcggtgcagtcagagctcactgcagccttgacctcctaggctcaagtgatcctcttgccttggcctcccacagtgctgggattataggcatgagtcaccatgcctggcctcttttttttctttttttgaatttggtacgtggccttatatagagttaaggactcagtaaattttgtttcatgatgataaatcacagtactgtgtatatatgaaagtttctgctaaccagaatgattgtttgtggcagtgactatacaggtacctgtctgttttcagagacatggttaatgaccagtctcttttttttcccatcttctttagagttctgattttgtgttctattcttgagctgggtggagctcaagaataaattttacatatgtaaaatttcagagctatgcatttaatatttgtatacttcattatatgtaaattattccttgaataaaaaaatgaattaagaaactttcagccaattgtagtacactataatatagttgattttgtttgtttttcatatgatttttggcttaggagagaacacaatgtgaggcttcatcatctaaaatatatttctcttagtgtctttctcctctgtaccagaagttgctggcattaatagacattaacagatatttgttgagtgatcaaatcagtgaactggctggttttaattgagttatgagcccattttcattgaagtacctgcagagccctctcatacaatcaagcttggtagacgcctcaggcagtggagcatgggaaacctsgggaagagctgtcctctgttctcacctcactttaagcaggtagtggttttggttgatgcttcatcgtttgatgtggtaaaatggtaagtctgtgggttttgctgcaggtttagagaattctttaagaatgtctttgtgtggcatatgctttggtcacaatatctggtgcttaggtaacttgctatttaatttccatggtgaaatgtaaatgttccacatatcacttaaataatgggaagaccccatcttcattcatttaaacatggtctaggtaatggctttctcttattgagccttttagaaataaaaagtctgaagtttgaatcatgtggctttcttggagaaacttttatttttttttgagacagagtctcactctgttgcccaggctagagtgcagtggcgtgatcttggctcactgcaacctccacctcccaggttcaagcgattctcctgtctcagcctcccgagtagctgggattacaggcacacacaccaccatgccctgctaggttttttgtattttttttagtagagatckggtttcaccatgttggccaggctggtctcgaactcctgacctcaggtgatgcaccctccttggcctcccaaagtgctgggattacagtcgtgagccactgtgcctggctggagaaacttataaagctatgaaatatttccagtgatctgaaaagatctacccacttaaaatgagatgagcttattgcattttgattctaattagtggacaaaggacttatgtaaataagactgctggggagaaaatggttcactcagacattatagtatgggatgtgtgagttatgatagatgttgaagatactttttatatcctaaagatagatttattcgtaatgtatttgagatcagacaaaaacattgacctgtaggcaaaataattcagttgaaacttttttctgagatggagtctyactctgttgcccaggctggagtgcagtggcatgatctaagctcactgcaacctccgcctcccgggttcaagtgattctcctgcctcagcctcctgagtagctgggactctacaggtgcatgacaccatgcccagctaatttttgtatttttagtagagtcggggttttaccatgttgatcaggcttgtctcgaactcctgacctcgtgatctgccygcctcggcctcccaaagtgctgggattacaggcgtgagccaccgcgcccagcccagttgaaactttttaaattgttaggagaatacctacagagcattttgaagagtagggattgaagtcagcccggaaaagcttcccggatcttgaagaaaagtaatagacatgagtgtagggtgtttccaggaaggttgagttgtttgaataaagatctaaaagtagttagataatggtgaaggtattatttgccattcatggagcaatgaggacgtgccagatggattctgaggagaacttgaaagctgggtgacaaaagaaactaaattaccttttgtcaagtgcctcctggttacctctttgaattcttcagtcttgagaactattgttagccccggggaagaataatatgactagtgacttttctgaggttgcgtaggttgaaatccagacctgctgtggtacatagattatgtttttgccactctgccattttaggtcagacctgctgtaagtgatagtgaattctagaaagacctcaaattgaggagtaaaatgagagtgctaaggaactaagcattgtttctctgatagaccactgctttaggatctctggatttcgactgcttctgttaaaagggctttacacttaagaacagaggattttttttttaattaaaaaaatatrtatgttttagacagggtcttgctctgtcatccaggttggggtgcagtggcacgatcctatttcattgcagcctcaaacacctgggctcaaacaaacctcccacctcagcctcctgagtagctaggactacaggcatatgccaccatgcctagctaatttaatttttttgtagagatggggtctctctgtgttgtccagactggacccgaactyctggcctcgagcaatcctcctgccttggcctcccaaagtgctggggttacaggtgtaagccaccatgcccagctgaggattgttttcagtggaagaattttaggttttgggcatatgtactagttgtatgatatttagctgttaatgcttctagaaatttctaaggaatttattgaatttgagaatgaggtcctggattttgtcagtgtctgttgatagaaaaaatatgctctacctgtgaaaagaaaatttctacacgttctgaatttattatgccaagcggaaaagttaggccctggagactgagtcacataacatggctgtttttcttctctggtgtgtgactgttgcttagggacctttgtgttgagatgttacctgtaaccagataccctattctttattcaaacctagactaaatgcagctggaggtagagacccctgtgattgttactgctttacaatggagtgttaagcaacccccttagagtataatagtaaccaatcaaatcttgtatctctatgttagccttatgcagaaaatgttgtaatcctgttccactcccctatttttcctatataaatgattctcacctttcccaatgctggggagtgctgaccaccattcttcagtgtccatgtttcctggaaaactaccctcacactttgtgcttgaatgaattcttttttttttttttttttttaagacagcgtcttgctctatctcccaggctggagtacaatggcgcaatcttggctcactgcaacttccgcctcccggcttcaagtgattcttctgcctcagcctcccgagtagctgggattacaggcacttgccactgtgcccagctgatttttggattttttagtagagatggggtttcgccatgttagccaggctgggctcaaactcctgactaggtgagccatctgccttggcctcccaaagtgctgggattactggcgtgagccaccacgccagtctttttttttttttttttttttttgagacaagagtttcgctctgtcacccaggctggagtgcaatggcgtgatctcggcacactgctacctctgcctcctgggttcaagcgattctcctgcctcagcctcccaagtagctgcgattacaggcatgtgccaccacacccagctaatttttgtatttttagtagagatgggagttcaccatgttggccaggctccgacctcaagtgatccgcccgcctcggcttcccaaagtgctgagattacagacgtgagccactgcgcacagctgaatgaattcttttaactggatcctctgtaaaaaacacattacgcttatttgtgaagaacaaaggattgttttctttttttgttttgttttgttttgttttttagatggtgtttcactcttgtcgcccaggctggagtgcagtggcacgatcttggctcactgcaacctctacctcctgggttcaagcaattcttctgtctcagcctcctgagtagctggaattacaggcacccaccaccacgcccggctaatttttgtatttttagtagagatggggttttgccatgttggtcaggctggcstcgaactcctgacctcaggtgatccatctgccttggcctcccaaagtgctgggattacaggcgtgagccaccgcacctggccccaaaggattgttttcagtggaagacttgtaggttttgggtacttgaactagttgcatgatattcagttgttaatggttctaggaatttctaaggaatttattgaatttcaggatgaggtcctggattttgtcagtgtctgacaggaaaagtgtaccctacctcatttcctgagggatgatcagtggcttcatttatacagggaatgccaccatcttatctcctttctgccttatccatgacttctttctggttgttgagaattgctgagttagttcacttgcttactttatctgacattattaaagataaggctgcctggtctgtcttcacattctagttctttccttctctgctccaagtaaattctaacccttacatggtatgttttgttgttaaagtttgctaactgaataggtctaacccaccttttgttaattgatgaatagctagctactgtagtcccaggagctttctttgtcagtattaacattattcaggttcagaagtgatactattcactttgatgtctgtgtatgtgaatttgcaaatctgtaagtctctctttacctcttcctctctctctttctgcctccctccttttctctttagtttccccagagtgttgccgagctaaggttcaatcagaggactcttagataccttaattttttttggctttatttttgaagaaagggatcrtcgttcccattaggacatgtatttacaatgtgttttcttttgcttgcccaccacactctaccactacttctagaacttaaaattctaggattgtttttttctccctcatgccctatcccctttttaaaaaaagtcaaaactcttattatagtagaacttcacaggtttgaagttggctgattaaatatactaagtattactgaatcactgccctgccttttctgctttctttacagacctgtttagtatacattgtatgtattttttttttttttttgagacagagtcttgctctgttgcccaggctggagtgcagtggtgtgatctcagctcactgcaacctccgcctcccaggttcaagcaattgtcctgccttagcctcctgagtagctgggactacacgcgtgggccaccatgcctggctaatttttgtatttttaataaagatggggttctaccatgttggccaggctggtctcgaactcctgacctcaggtgagtcacccacctaaagtcctggggttacaggygtgagccactgctcctggyccacagatgatttttaaatgcccttgctcagtttcctttcttacagggagagtgggtggcaccctgtgctacaccggagggctgagtgttgggcttaaaatgtcctcagtgtcctcccttctctctgctgttttttgttttgttttgtttttggtcagttggtaaactataaatgcataaatgttttctcaggacttttccatcaactttcttcagagagaatgaagggataatgatttccaagaaaagagttttgcagtttttagaaagagggtagtgacagcatgatgaaatgagctgaacagctttttttgagttttcactggcagggactgggaagtgatattttcctgccctggcatcacgaatcccaattagaggcaggaatctgctgcccacatgttctcaaaatcctcgaccattttattatcaaaaactgtaaggaataaataatttgacagtgtaaaatggttagatcaagatttggagtttaatagactcttagttttctggaatgtccacagagacatccgtggactctgaaaaatatttggctaactagaataataaaatcataaaattttggagttgaaaatttaagctataaaaaaaaaagaaaaaaagttttagggataggtcctggtttaatttatttaatctcttaccaaataatttaaggtaggcgtagttgccttgggtgagcagttttacctgtagactcgtgcatctgtgctaccattcttcagtggttcccatccatcatacccctattatgatggtgctggtgacatcatctgttttgatgccactaagtttaaagaattttttctaaaaaaattctggatcatgatctgatagagctgagcatgccggaattttcattgaaattgtgttcttttggaggtgggaataaacaagggactaaggataaagattgtggtggggtcgggggagggttagaaaccaaaagagcaattgtgtacttgaattgctttggtcatgtgattgccccttcttgggtaaagggtcgtgatcagtggccttcagtgtcttggattaactttcggagcagtccatacatagttttgaatttgtggtattttagataagttcatgggatagaaagtctattggagactataaattcttagaattctacaaattatgagcatttgtgggaacatctgtaatgcagctgtaataaaatttgtttattatcaggattgctttagaggctcttgctgggttgtttattattgttttcagcatttttgccatacgccctgaaatagcatcaactcctgggtagacttcaggatcattcagttttgtaggcattctaatcaggtttgggttttaaacatatgtccactttagagcttttatgtcctggcacagacgtcaatggtgaatccagaccatttcaagatggacactgattctggaattaacatacttcccagatgtttgtagtacagatttgttttctgtgctgtctttcatgtgttctgctgtgtctgtctctatctgtgctttcctctgtttttacttttagaacccctggggaaaggtaggtatctgctttttgrattgggaaatagaataggtattaaatttttggtaaaaacctttgagtgggtattgacatttctgtgagaggagaggctgctttgttccctcgagggagactgttggtgagggtggtgttggaggtgagactctgaatgtaactagaytcggacttcttcacatctctagtggttttcaattatgaaatgggcaactgatgctctgagtcagcagccttttaaccatgmctgactgaagagaacttgtgtttgaaattcacagcattgcctggatccctgctgtctttttgtgcctcccgctaacacacagctgtttttgttcatacatcattttgtgttcaactgcctggttacttcctcaggtcccttttatggtgaataatggacacatgggagtttgaacacccaagtgtgtggttattcaaacaggaagtctcaaggaagcacagtaactttgtcagaggaacaaaagatgggacaggaaaggctattgatgattctaggcttcaaacatctgctgggaaatctgacaatttctgaaatacagatattccatagcttacaaacaagttggtttgtttatttggaacttgttccattttttaaaaatcagggtattaaatcttcgtaaaatagaagtggagggaaaaaaaaggatataatgtggcatcattagtgttaaaaagaggagagaggctctgcctgtggcttgactgggtttcaggagaaaggctggagcagctcatcttgactgaaggtaaccctgaggctgtaacccggggtgagcacataggtgggacttgacagaggctgctagagctgacagaattggattaaaagatgattttatgcagagcttttgatgattgagcactggaggaatatgagataaagaagaatgtaggttgcacttaaagagcatgcagtccagtgggagagtaagaatgtgtgtatcaacaaattttctctgagacaaaacatgaagtgccgtgagagaaggatagaaattccatgtgattgcaaaggagatatgactatagaagatcaaaataaatgcttcccagaatgttgatctggtgaccgtgaagattccttatgaccttgggattccttgtttatgtgataaatgacttaccagaaatagtcaaataaatcctgattttagatttaaaaatgaaaattaaatctggaagtcaaagaagggggagctctggtttcatagcaatttatattaagcaagtggggtgatgcaaatgctacagaaaagagtactgtgtcaggcttaattaatggaagtgatagtattcaaaggagtacaagttctgtgcatcttattcccctgcctttaatttcagtcatggtaaactgttcatagtaaacatgctcccaccgtgtgggtactactacatttttttcttgactctttacttttctgttttttcctttggctacttcctaatcatctttaaaactcctgacaaatttcaactcctccaagaagattttgctaatttctaattcctctgttccctccagagcacttgcctttatgtcatttgatgtttatacgtccactcacttctaaaatccagtaagcatattgcatacctaggatgtgaggggtgctatattgtattgttttctctctttcccccattagctgagttcatcaaagacaagacgaatccatagatttcttaattcattcatttacaaagatttattaagcacctgttacacaaaaggtactgcatagtaccggagacagggcagagaagacctagagcttaagttctgggtaaaaaagcatgcagtacaaaggacctgacctagggaggatttcattggcttcccctccaccaccccactgacttttatgcccctagtgtacggcataataccttttatatggtagtaggggttcaaaaaagtttgctgaatgagtgaatttctatttctttgaggctatggacacagaatgcagatgagtgcaagaaacagcaattttgtttaggttttcccatgatggaatttgccttgtagatagggtttttaaaattgatcaggcagaataggatggctagtacatggtatagtttcctcaccagcattgttagatgaagagtaagtcactgtatcaaagagccccagtataaagtaataaagtaaataaaaacccagttttaaatcattgaagtttgtttctccttcaggtggtaattctgaggtcagtggttcaggacagcagggtagttctccacgctgacattcagggactcatgagtgtttcctggaaataatctgggatcctttaggrtatcattcttatgtgcctggttgaggctgggtgataggcccctgtgctttccaattgggaagatattgaggagtgtgtgcctaaatcttaacacttgaaaatcttacctccccaaagtgccataacacctgaaagtgtattatctgccaccagagagagcttagtcacttggccacctcataaacacagtagaggctggaaaatggggtctagctgggtggtcttgtgcctggccacagatctattacagtgatggatgggttggtggggagagaacagatttttggcagacagctctgccatgccaactcctgtgctgaagagtctggtttctcccaagttctggtctttctggagagtcttcagaggttcccattctgtggctggcagttgtagggagtggatatagaaaaatagggaccacgctcactgtggatcctcacaactttagcttttcagtaaaagagcctctgaagaaagggtgtgtactcattctgctcttagtgcacagccttcactccctgactttacagaattggtttattctttgaccttttccattttcacacccccagccctctcctggcactgagatcccactgtaccttcttggtgttgtgtacttacactgatgggctctatgtctatctgcctcggaggagcacatcccacatgggcattgtctgaattcacttgacgatgctgatggtgtttaccttcagctgtgacagaccaatcagagctgttttaaaatccagatgtcttttaggaatgagagttccagaagtgataaatcagtgctttttgtggcttgaacatatacagttttgttgtggaatcttcttaaatgtatatttatctttttcttcattgcgagttcattgaaggcagctgtgaatcatgttttaaccattaattaggtgtccaacttagagtggggtgcttatgatctagtagatttaggaagatgggtgtatgttacataacaccctcagcaggacccccatctccaagcaattgaatatatctgcagtaaaatgtattcgtacgaaacagrctgatgaaaggctatcatagcctcacactaggtcatgtattgttgtcacacattatgaaaatctcctgctgtttagggctttttgaattgagaatcacagatgaaggattatggacttatatcacatttgattacrtaagttatatcacttttacagatagtgataaaactactgaagactatataaaaatgtgaacaataggcatctggtaaattggttatctaaataagcagataaagtttaataggaaatttcatttcattgaaagggtgaattttgacatgttctaacaatttgagtgaatggattatgaaaytatggtaacaatatttagaactacagatagggcattacataaatgtttaaaagaagaaaagaaatagggttgaattctgataaaaagtgacctattagaaaagtatttctattcctctagggacatccgttcaatttttgttgttgcttcattgatttttgtaaaaaggtgttgccttttaaaaatcattttagaaaggcaatgtcatttttaatgacattactaccatgcatagttttgtgagaaacctggctatgttaaagccatttcatttgagatacattttgaattgaaagttattctgttgttcttgttttcagaagcagataattttggcgatgtctgtgtccttcttgtctgctctttatctgtttacctacctgcttatcacaactaactttctgtccagttttttttaatccttagtaaatcagtgtctaggaatctttagtcactcagttttgaggatgactgtgtaaatggttataaatgattgcttttgcctgttgtgttctgtcagcttggtttttgctttctaaaagattacagtctccttgaattgacatctttcttttttatttttttaaagtcaaactcattctctttatttgtgcagagtcctttgcccaaaatacatcatgttgtcctctgggctttactgtcctagtttcttttggaagaaaaatgccttctctataaattcttccccacatcttagaagtgtgacacagcagtgcttactgtatcactcattggtcacttgagcataccatcttctttgggaatcttttttatgtttatttattttcatatgcacccagcgtgggaaccgtgttttaaaccattaggtcagtaacttagagctgggtacttgactcgtaaaacgataggcatttaaatattctttggctcttttgatgaatcagaagatkcaattctaaactgacagagaaacctaggactaaattaaaaaaatatatccaggccatggctttggaagggtgtttggaagagctgtgttcactaatcattggagaaaggccacggagctatttcctsaagatttaagacatcccccttttgtggacagtagtaatagaagacctgtctgttctgttgaactttcctttaagaactggaaaataactgaaaccaaccacaaaattgtttctttttaagaagcgttgtcttcctttccaggatccacaatgccaagttaaatacctttctttttttagggtagcagagtttctcacactgagacttttaaacgtttctgttatattaattgtaaagtgtcatgaagttggtgtctcaatgcttaaaaaaaaaaaaagatccactaaagccttcttcttgtcatttgaaggttattaaaatgtaatacttcccttgtacattcttaatrctgatttccagtgaacccagggattatttctcagagaggaaattctgttgtcacctaggctaataattaccaagtgctcaccagtaacaactagaatcttctcagtaggttttttttttttggctttttttgttttaaatrtatatggccagttgattagtatgaattattgttttgtacttgcaagtcaatacaaggtaaaatagataattgtttatgcagccaagtattctgttttagtgcacataaatatggagtagaaataaaagtttccatatgaagtagattagtaactctagggacatttcttccaattttcctcaccccaggtatctactaccatggattttatgttttagtcttttgcttttaaaagaaaatagttttgtaattcctaaacaatgtattgtttgtttttgagctttgtaaaaatggtattctatatgtggtaattggcaacttgccaattgaaaaaaaagttcagtatatttttgaagtgtagctgtagttcattcatttgcattcctgtctagttaagattatactacacctaagcttttgattatcctgctgatggattttttgttgttgttgttgttttacgaatagaacgcttctatgggcattctcacacatgtctcctgatgcctatgtgtgagattctctctacctgggttgctgggtcataatacatgagtttttcaatgttataaaataatgcaaattgtttcccagagtgatcgtgctagtttagatgctcaactagcagtgttaataggcctgttgatccacattgggtattgtgagaattctcaaattttgatcatttggtggtataaaattgtatcttagtggttttatttataaaggagagtatcttttcatgtgtttattggtctttcatatttcctctccgcaaaatgtctcatcatgttttctttcccttattgatttgtagaattcttcatatattctttatactaatcctttgtcagttatgtgttttccttatcttccagtgtgtccagtgtataatttgtcttttacattttttctgtgatatcttttgaacaaaatgtcttaattttaatgcgatcacatttgtgggtactttttctgttagcccttttgagtcttatgtaagaagtctttccttatattttcttttaaggatcttctgaagttttgcctttctacatttaagtttatctggagtcgattcatgtgcattgtctttatctgctaggacaatttcctttccaacttattcttctattttagaaatatcttagctatgtttaggcctgtgcttatccatgtaaaatttagaatcaggttgtcaagttcctcagtaagctgtttgcatctcgattgaagttgcattgagtttgtgtatccatttggattgaattgacatctttattattgatttttttctccatgaacatggtataatttatatcttctctgtttaactccaataatatttaatagttttctcctcatgagccttgctcttttcctgatggatttattcctagatacattttattttttattgctattataattttttctgaattacactttctaactcttttgtcactggtatataaaaataaaactttttttgtgtgtgttgaccttataaccacttgcttaattgttttattctaataatttgtctttagcttctattgggtttatatgtaggtagtcatcatctgtaataatgacagttttgtttctccttaccaagccttaactcttttacttttttctctgttgattagaacaatatacagaatacatttaaaaaaattccccttaaatattatgcctttataaagctctgctaatttgataggtgagatatgttttaaagtttatctcttttataattatgaaggccattcttaattctgttgcataatatttatttctgtaagctacctcactttttttgtaaagaggtatgatactaacagtttctttcagcttagttttcaacttcttttgctgtaaggccattttaagaaatgttttgggtacaggtttcagttaattaaaatagctctaaaatatcaaattaggtagtatacagatattattcacctttttggtaaaattagctaccaaattagttgctgttcatactgtttgatgcaataagtggtaatctggaaaatggaaacatttctattcataaaattcactggagatttgattaatacatgtatttccctaaaaaacaaagcaaactgaaccagtggtaactcaaggaagcattgatagagggacttgggttttgttttgttcttcataactaaatcactcaattacagagtgtgataaatttctcaagcttctgagatattttaggtcagtctttatatttttatatcaattctgtggatcatgcattttaagctcttttgtctctttctcttcaaaactgtctaacgccctctgaaaccttatttatcatctgagaaaggattgcatttaaaagacttggaacaaagagtgttgaatgtatgggaccttgttaaaatgttgtcttgtaaaatgtgatagatatgagtcttttaagttttggggatagatagacccatgtgtaatttgtctgtaaacactacagaagtagttctcaaatgagtgtggtactgtccccgtaggggtatttagtggacaggaggggattgtggggaattggaggggatgggagacagtcccatacaacaaagaattgcccaaatcctgcctaacttttggatttctcacgggacatttgtgctattaaaaaacctgattataaatacctgagcctagaacataactttgtctttacacataaacagtttttttcataactttattatatgtaatttcccatgaatacaaccaccatgtatataaatatttttttagcttaccgagagttagttcaccaattcggaaggccccatctctgccaacgctgcctctcatgatattcaagttgcccatacaacacatatgtaaatcagtctgcttttctagcaatcagagtgaatctgtgtaccaatttgtatattcttagcctctttttttctaaaatatcaaatgtaaataaaagtgttgatagtagctgaaattttgaaatttgctttcaaccatcttttcctaaatgtgaatagctattactgtgtctaccytgtttcttcttacggaacaatgaaatcactaagagtaagtgaacattttacaaggaaacatgctgataaagttggcagagatacgtcattgtccctcagtgtaatttgttctgacctgttatacctacttagttaaaatgtcctctttatcttaaaacatacaggtaaatctgctggtgctacgtttcccaacaatgatttttattgcagtgtccacctatagctctatcctttcatttcctgtatgccttgtacagaatgacatccaattctgtttttaaaagtataaacttgttataaataagtacaaatgtctgatagctttgttatacattctagtatagtaatccctgagctattacctattaaaaggcgtgtatttccttttaacttctgctttatgttatagttagagctacacacrtgtacaccacccaccccacttgtaagttatatatgttgtagattatataatttatgagttttattttgggatggtaaaggagaagcattttaaaatatttgttatagtattggggacatgagtgtctgttgggcttgaaaatcttcactttacagcacctcatcctcacacgtgtcttttaaatagtcttctgcccctatattctctctcccttccgctctgttgtacacaggaagccaaagccctctcgaaaataccaggtatcacttcctcctattcagattcttagccaagttgttacctagtattaacattgtggtatatatattgtctcaccaactggagatatgatggcagggactacatcttgaatttcttcctgtctttattattaatatagttctttgcatctaatgtgtactccagaaatgtttgctgatatttctagtctactttcccactcttatagaagaaactaaatttggagcaaattctccaagttttcttactaaatcttcatatttgttgtatacaactgctctttaaatagttctcagcagaatcatcttaatatttttcttggtaaaatgccatctatagcatccccaggtgtagagaagacatacagaaatggaaagactttaatactggtctgattgtaattacagtattagaataagttgtggcagaagtctttttaaaaaattgtataattgtggtaaaagaaatctaattttttaagtttatctacagaggttgtgtcaataccatattcttgatttattttcttgtaactattttctccaattttgaatttaaggtttttttgtttttttttttgtttttgagacggagtttagctctgtcgcccaggctgaagtgcagtggtgtgatctcagctcactgcaacctccgcttcccgggttcaagcaattctcctgcctcagcctcccgtgtagctgggattacaggcatgtgccaccatgcccagctcatttttgtaattttagtagagacggggtttcaccatgttggccaggctggtctgaaactcctgaccccaagtgatccacctgccttggcctcygagagtgctgggatgacaggcgtgagccaccatgccaagccaaaagtgtctgttttcttatctccttaaataccatactctcccattctcaccaaactaaaacaaaaaaaaaaaatcattctggattttcttcctttgtgtcaattgtgttctttattttttaaactgggcataataggaatagtttgggcagcatcaatagtaaatcaaatctgtagtagataccatttcacatgtgtttccgtgcattatttttttcaaattcagtctccttgcataatacacttagaatcttatgtgctaaagatgtcgttcccactcaaggtagtgttatctgccagttgacctttatcaatcagatttcaaagttggtgttggttatattgtgtactctccatgtgagcttttattatgttgtttagtcatcttttgaaagatagtgttgtctctatttaaccctatctcttattagaaattacttctacattgtgactgttgtaatagttctttgatatatttacctcactttatcaatgtttctgcttgttttctcagattcttttttttttttttttttttgagacagagtctcactctcgcccaggctggaatgcagtggcgtgatctcggctcactgcaagcgccacctcccaggttcacgccattctcctgcctcagcctcccaagtagctgggactacaggcacccgctaccatgcctggctaatttttttgtatttttagtagagaaggggtttcaccacgttagccaggatggtctcgatctcctgacctcgtgatctgcccgcctcggcctcccaaagtgctgggattacaggcgtgagccaccgtgcctggcctctcagattcttaaagatagaatcactgggccaggctcggtggctcacgcctgtaatcccagcactttgggaggctgaggctggtggatcacatgaggtcaggagttcgagaccagcctgaccaacatggtgaaaccccgtctctactaaaaatacaaaattagctgagtctggtggtgcatgcctgttatctcaggtacctgggaggctgaggcaggagaatcgcttgaacctgggaggtggaggttgcaatgagccaagatcgtgctgttgcattccagcctgggcaacaggagtgaaactccatctcaaaaaaaaaaaaaaaaaaaagaattactgaattaaaagacgtggatatttttaaggcctttagatgttacagtcctaaattctgagttagcaggttatgagaatatctgttcctctgagaattacctttcctcttctcctttcaaattatttttttatctgaggtgtttacttttcaatattcaatagttaataagtcacagctgtctaggatgcaactctgattttgattgttatgatggattaaagatgaccacagatgctttgacactcctccttttgtgtgtggactgggctgtgactgctttaaccaatatgggacagtatgtgtgatgatatggcagttctaggcttagcctttgagaggatgggcagcttccacctgccttttggatcctgaactgccttctagaagttcaactatcctgagaccaccatatttgacaggacatgagcaggcatttctggtgagcattcctagctctgtccagcctttcctccatccccatcaaggcaccaggcagatgagcccacctggcagctgagtaccactgtgtgacttcagtcaataccgtgtggagtacacgaatcatccagctgaacccttcccaaattcttgactctcaaaatcatgagataaaaatggtggttgttttaagccactgagctttggagtagcttgttgtgcagcagtagataactggaacacttactgagtctctgggattattgagttrgagtgcctatgctgctcttcccaaggggaatcagccttttttccttcctggaatggttgcttagaagaacctgtagacacccagaggaagttacacttttctttggctttaactagagagccatgggagaggagccagaaatatcccgaggctatgcatttctgagttctaactgaagcctggcagaaatttcaaaccaagttatcacagggatcttgtgtctgagagagcagactgtcttctggtcagtatccttgtgtgtctaatgaagggaagacaggtgcagggatccatcttcagggtgttctccaggagagccataaatgtaacagtaggaaaacaagctatgttcatattcttggtttctgcttatttctctgataaaaaatcattcctttcattggtttctgcttgttcatctgataaaaaaatcattccttttgttacctgtcaaaacatacagccccctgattgcaactcaaggtgctctgcactgcgtatccaagagtaaccatcacttctgcttcccctgttttgttgcatgtgttggctagctacctatccatttttgtgttctcatccctttttctttctgttctgtctttcacaattaccctactttccattcctcttcccatctctcccaaactctgctaattgatattctggtcatactaaaaggctaatctatctatctttcttttgttctttcttttcttttttttttgacacagtctcrctctgtygcccaggctgagtgcagtggcatgatctcggctcaatgcaacctctgcctcctgggttcaagcagttctcatgcttcagcctcccgagtagctgggattacaggcatgcgccaccacgcccagctaatttttatatttttagtagaggtggagtttcaccatgttggccaggctggtctcttaactcctgacctcaggtaatccgcctgcctcagccttccaaagtgctgggattacaggtgtgagccaccatgctcagccacttaactttctttttcttacattttcatctctttatccctcctgctcatgtcccttcctctccctcaccttaagcacagcctgcttgggtttttgggtgtgtgtcytataataatatatcacttagtaaattataagcarcttgagaataaagaaggttctattcagtcataatgcttaagagtgttcatcaaattatttgggttaaataaaaccctttatttccattttcttctcccttactgaaaaaagctacactaatgttctctaggattgatgtgcatagagaatgggaacttaaagaattattgtcttaagggtatgtgggtttccttatccaaacacaggtaaatgagggaagagatgtaaacaacgattactctgttcttcctagtgttggttggagttctctgtamttctgtttcctgtccaaggagggagagatccgtcattctgaatttatttgtttgaatttatgggacaaaaatgctataaatcaaatcccttgttagggttttccagtgcgttawatgtaaaaacttgaaaagtttgctgaaaaacttggtttccgtgtccatatttaatagatcatattttccccagatattttcgactatagccattataagaaatatattttgtattgccacctagtcagtacatatagctgaaacaggtttatcaaagcaagtctaaccattatttcctgtatcatactctgatattttctattcacttctaattcttttttaaaaatgctcatctggatctgttttttgtgtgtgtttttttttttcatttcaaactaatgggttgtttgaaaagtattgagttacataatagttgcttgaatggtaagggtctgattctgagtctcatcagctctcctgagagaattggtgttcttagactgcattggtggctgaatctgatcagaacatttacattttgtgaagatcttgtataatccaaaacattcataatgaaagatagttttggttttttttttttgacagagtcttgctctgttgcccaggctggagtgcagtggcacgaacttggctcactgcaacctccatctcctgggctcaaacgattcttgtgcttcagcctcttgagtagctgggattacaggcgcacaccatcatgcctggctaattttttgtattttagtagagacggggttttaccatgttgcccaggctggtctcaaactcctgagctcaggcaatccacccgcctcggcctcccaaagtgctaggattacaggtgtgagccactgctcctggccaaagataggttttattattgggaaaaagtgttaagataggtgaaatctatagtctttgctcaaatgttgctttttattttctaagtgtcatcactagtgttttgcagaatgttctctcaacaagcagtactgcctattgaggtgggttgatttgttgttctgaatagttctgccacctccaatttcattttaaagtcattgattttcaggtgcatttgtaagrctagcatcattaatatcagcacttaatagctaacatttattaactactatgtgctatgcatggtgttgagtgcttttcttagattaatttaatcctcagcacaacccagtgcggatggagcactctcccagtttacggaggaggaagccgaggcatagaagccacacagctatttgtgaggattcaggctgtgcactctagggtctggttatagaggctrttctctgaatcacactgtgctctgcctcagaataaaatgccttctatacaacgtggctgtaaccttaacttctggggactggtatcacttgttactctttcctaaattttggggtcatttccagtattctaayggcaacgatactataacacagcccctaggatactgatattctgttatattgagaagaaascaggggtaaataaggtcttttgacattttaatgaactgattgcttagggtttcaagattaacccaccccgtatattgcaaggtcgcttctcagcctgaagtttacttaggtgaaaaacaggacattttatttctttagtgtctactttatgctagacacagttcctggcttggagactacaaaactcaatgtggagcatttggctttgattaagagggaagccattgattattcatagacttctaggaccacagccaccttagagccttaggggcttttcccacttgaccccttcttctactgaagaggagcaggccaggaagccagtggttcctcatggtatcaggattccttgttcttggtgctctattgtgttgccttttcttctgccatcttattcctttgattagtgagaactttgtgcatctttttttttttttttttgagatggagtttcgctcttgttgcctaggctggagtgcagtgacgcaatctcggctcactgcaacctccacctcccgggttcaagcgattctcctgcctcagcctcccgagtagctgggattacaggtgcctgccaccgcgcctggctaattttttgtatttttagcagagacggggtttcaccatgttggccaggctggtctcgaactcctgacctcaggtgatccacctgccttggcctccggaagtgctgggattacaggtatgagccaccgcgcccggacacatcctttctttatcatttctcttcctagtgtgtgaaatgtggcgatagatgtttataaccacttactagggattgactcagctatgaacttgatacctgcttagggtgactaatttagcctcttgaagcctcagttttctcatttgtaaaaaaarttagggtaaaaatataccctattgtgtaaaaaaaaaaacctactttataggattgatgtgaggattaaatgaaataaaggcattaggccgggtgcagtggctcatgcctgtaatcccagcatyttgagaggccaaggcgggcagatcacaaggtcaagagattgagaccatcctggccaacatggtgaaaccccatctgtactaaaaatacaaaaatgagatgggcatggtgtcgtgcacctgtagttgcagctactcgggaggctgaggcaggataatcgcttgaacctgggaggcagagattgcagtgaactgagatcacaccactgcacttcagcctgggcaacagagggagactccgtctcaaaaaaaagaaaaaaaaaagaaataaaggcattaatagtgtttatgtggtgtttggtgcaaagcaagcatacaattgatgattatttttcatgagcttaataaaattgagggtgtagctggggacaccttttggaagagagagattatagagttactgttggattaaaaagtgtcttgtgtatggaataagaatcaagtggcatttttatatttttatatttcagtcctctttctttagtaaagatggagtagaactggcccagtcccctctgctgctgcccagtgctgctgaaagggcagtgtggtgcagtggttagagcatgggctgtggaggcagatggatctcaggccagccrtgcttcagctgcctgctgccatgtgtcaggcctccttggatataaagttccataatttcctcaggtattaaaagtgagccatagtgtttcccttatgggattgtaaggtttaaatagaatggtgaacatagagcagccagtgcagcacccaccccatggtcgatccaccctctgcttccttttcattttctctgatacttgacgcttgccatatatgggctcctcttgctcccagtttctgtttcttccctstatgaccttaccaaatctggtgtgtttattatccaccagtcacgtcccactgtctttcaaggcctgacctgagccatcttcatccttgaagagttcttccaccctcctccccccatccccccgttcaccaattcattgatctgtcctgaatttctccagtaatacctgtttggcacttaactagtccatgagggggcataaagggacctcgtagaccttggaagtcattyagtcgaccaygctcattatacaggtgaggaagctgaggtccagggagatagcaattgcttaagatcaggtttcccatttctagactagagctttctccaccaccctatgtacygtttctgtttttaagcctgtaaaacaacaaacaccacaataaacaccaaaacstggaaataggagattatgtatgcagacttgtacttcatgggacagagagctgcttctgggtttgtactctgctcagaaggtgtatgctttattttactttagttggtaggtatactatatgagtaattctcttttctttaaaattgtaacacatgaattaataaacatacatttactaagcatctcctgtgtgcaaagctttgaggactgtgagcttcataaaagagtctgcgctttcagggcctacttgggctgttaaaaagctgtaaggataaggaaaatgcaatccgtattgagattcttgagctttctaaagtgttgtttccccacaagaactaaaaggaaacagattcagagaaacacagattggtgttcttaccttgttctctcctgtaccctctccaagaaaaggtatttagtagtggaaggtatattcgtttatatttcaaaggcacaatgatgtctgtttcacagctttctggatgtggtgagggactttatttggtcagccctcattccttaccactccctttgctatctttgatgggtaagcagatttcatgaggcaggccagtctctcgtttcactaggttgcctgactctctgaaaacttcctgactatcccaaaccatatagaaatttattttaaaagtttgacagctggccgggtgccgtggcttacgcctgtaatctccgcattttgggagcccgaggtgggtggattacctggggtcaggagtttgagaccaggttggccagcatggtgaaaccccgtctccactaaaaatacaaaaattagccgggcatgatggtgggcgcctgtaatcccagctactcaggaggctgaggcaggagaattgcttgagcccggggaggttacagtgagccaagatcacaccactccactccagcctgggtgacagagcaagactctgtcatacttttttttttgacagctgtcaaactgtagcctaagcctgaagggttgggaagttgaaaatatatgtcatatatatcatgctcatttaatctctattgagatgttctttttttccttcttacataaatattatgtgctctaactaaacatattatatatttttatgtgcagttcaatgcataaggaattgaatcacaattggaagtcctctttagaaggatttgctcttgtttgacagataatagcagacttcatctctttttaaaaataaaccatcagtttatgtcattgagtatatttgatccttctaaaaagaggttctctytcatatttattttttgtctatgatgtagttttctaaaagttcgtctctattggctacttcatttctgttctaaatgtagtaagttcttggaagtgtacttagaggcaatttaaggattttatcttaagcctgctgacttgtgtagttgagtggatgctagtttttggtcagttgttctatttcatacctgtaacataaggatattgagggtgactraattttacaatgctttgcattttgtacatctttatatgtgtctgcttcttgaaatcattgctttttgtgataaagacccrtctatggttatttcaatttgcttggcaggtgtatatttaagtctggttttgtttcttctagacagttatttgataatagagattcatattgttttctgtctccagcaaatactcactgaaatgaagaatgatggatttggtgatttgggagtctggtgtgtgaaaacacatcttaaaggattcaggtttaagttttttagttcttatacacggttcccatttttctgtaatgtcttcttatgtctcaatatgtaaatattttgtctttacttatactaatgtttcttgttacccaaattatctcctaagactgtttatgtagacttgaaatatttcttctgtctgtgggtgtgggtgtgagtaccttcccaaaaacatccaggaatttttgcccacctacttggtttccctggagcatgaaagaaggtgattaatggggtagaaaaaaattcacaaaaagccaccaacaaaaagctacctacatgtttacatgtattttaaaggaaaagcctgtcagctgcaatcaaagcagcaagggctcttcaaggaaggtaatatctatatgttgttctgttttataacatgtaaaattttctccccttgggaaaaaacgtctcacagaagattttcttgcaagatgactatgatatgacaggctctgtttttgttatgcataggcagttgcttctattgtgttccctgcagcctagtgcktgtgtattttcttagactcatctggtagtgaagtggcctctagctcaggtcttcacaggcagaacatccatgctttgaggaggctgtattagcaaaataagaaacctactcagagataagggagaagcttcattgttgatgctgttattaactcaggctcagcttcctggtttgagagatgttctgaatacatattgatggatgggttattaatacattacatcatggtggaacttggcatcccagactggataagcccacttgccctgttatataccagcatttgtggtttgtattaataactctgtaatcccagctacatggaaggctgaggcaggagaattgcttgaacccaggaggtggaggttgcagtaagccaagatcatgccattctactccagtatgggcaacaggagcaaaactctggcccaataataaaaataactaacccagattgtgtgacaggagataatggaaatgatctgagtggccacctaatttcagtgaaggaactagccaaggtaagtgacttgctcagtgtaagtccacaactaatttgtggccactcaggacattgaactgggtctcggagcaaattataagataggtaaaacagaggggacacaaaygtggaatagtgagagggtgaggagagtgcagttcaggctgggatcgtgtgtggcatattcgtaggaaaccacagaatctgaagttagttaggtttggatttcatttaccacttayaaactacgtgcatcagagtaagaaatttaatttctctgactgtaggttccttgattatagagatgttgtaaagattaaatgagatgacacgttggaagtktctggcactgtgtaggggacatcacatgttccatgatggcagctgttattgttctggtacctgaagtgggaaggggagcaaggaaggaaacgtgaggattgtgatagtagggagggctctgttgattttgaaaggagagtcctttcaaagcaagcctttagaaacctcacatctgatcatgccactcactgtctgcttagaaatcacccttggcccctcatcatgtagctagacttttaagtccttgtgaatgtgcctttcccacttgctccttgcaatccatttgtgctgtatctctggcagttcctggaacatgacatgcattttcattttcatcttaagtagtatggcatgcaccaatagttccagctactcaggaggctgaggcaggaggattgcttgagcccaggagttcaaggccagcctgggctacatagcaagaccccatctcaaaaaagaaaaaaaaaaaaaaagcaattacccctttaccctgtccctctgtcctgcatttgccatcctttaagactcaattcaaactttatttctactgtgcagtctcttggaccaggctctcctcatgtcttactttctcttgcagtgactcactacgcctattgtgtttccatagtaccctgtacacaatattacagtgcttactacactgtgtcctaacgatttgtttacatgtctgactcataattatcattacattccctggggacaagagctagatcttaatcatgtttgtattcttagcactaagttgatgccagacacacagtaggcacttattagatgcttatatgaccgaatgaatgggtgaaaagcagaagtagagaagttatcttaagttgatataacagtatgagcaaaatatggatgcaaaatcagtgctattgtgatggcaagaatgagacagtttgagaaaatatcgtgttgagaagtaggtttgtgtaaaatagagataggaagatatgatcacttcatgaaaggctttgaatatgaagctgaccaattgagatgtgttaggaagggtagccattttagtttttttgtcagaagtgacatggttagatagcagagttgcaggaaaattagtmtaatggtagtaggttaagttattgtagcaatccagatgtgagttaatgagggataggactagggtgatgtcgatcagaaaggcaaaaggagagacactgaaaacagcaaaccacaaaaactctggcaaaccagttcacttttagatatctcacattttggtgtgccaaggttcccagcccccatactcccttcaaaaataaagtcctttccattttagtctttggttattagtgtgtgaaaactctgcctaaatcctgaactytctactctgatttgtcagaggaacagttctttcagttttaatttttgtctttagattttttggttggtgttttttttttcttcccctaggctcatctgtataggactgtgagcccagaaggaaagttgggaaataatttgtcagtattctttggcatttacaagatgttcctatagtctcattataacatggtttcctgacattttgttatggttgttgttgatagtgctttttggaaaacaacatctatatctttttttcttttttaaaaagtgcttatatcttttaagttttatgttactttgagatattactgtaagttcttttgttcatagattatgaaaaatgtcaaaaggaattctaatcagaaatcagttttgctctgtgaatttgtacattgaaatttaaatgattctagttaatacattctgtctcttattttcatttaatgttgaggtgaatacacacatgtaaggccatataagaagagaataactaatgagtgcctattctgtccagtcttgggcttcacagacatcatttatattgaatgctcataatacctgataaagtaaatattaataatctagtaaggcaattaagactttgggcaattaaattctcactgtacgtcattgggacatggcagagaaggaagcctatgtctttttctgactatagtgccagttgactctgcacgtttgcatacagcagttctcagatcttcttagtaacagaatcctttatcccatgaaatcagactcccaatatataaaacaggtaagaatagtgttcagttatatacgtttattgtatttggtaygttaaatttaaggtggaaatctatgtttcaatcttcacttggtttcatcttaaaacttatttctatatattttgtttgcaaaattaaaaaagttcaaagtttcaaagatacgaagattctaatagcttttttgctgcatcaatactattttcttgtcagaacatgataaaaattacaatgtggaactttaatagctttttaaatagtttgtcttgtagtttcagggcagcatttgattatatgggtgcagaaaacttgagaaataggaggaaattttgttttaaagttgtattaggtgaggtgcatggatcacctaaggtcaggagttcgagaccacctggccaacatggcaaaaccccttctctactaaaaatataaaaattakctgggcgtggtggggcgtgcctgtagtctcagctactcgggaggctgtggcatgaggatcacttgaacccaggaggtggagtgagccagaattgcaccactacgctccagcctgggtgacagagcgagactctgtctaaaaaaataaaaaacttttatttactggccgggtgcagtggctcacgcctgtaatcctagcactttgggaggctgaggtgggcagatcatttgaggccaggagtttgagacctgcctgggcaatatggcgaaaccccatctctactaaaaacacaaaaaaattagctgtgcttggtggtgcatgcctgtaatcccagctacttgggtggatgaggctcaagaattgtttgaacccaggaggcagagttgcagtgagtcagcatcacaccactgcactccagcctgggcagatagagcaagactcagtatcaaaaaataataataaaaaaaagtagtattactaatcatatttagtgacatccacagtagttatcagttaagtacattttgagggcaggaagggagttagtgaatgcctccacatccaatattaaattcattgtttggcagaaaaacagtttttgaatgtaccttgtaatattttaagatgttactttgaacagtcaaaaaaggctgtcagctttttactcaaagttccagaatagtcaaatttcttttgttttacatgttgagtctaaatgaacacttttctgcagtccttagtgtagtaagatgggagcttgttcagcaagataggcaagttcatgcatatgagttttatttcagagcdaattgacataatttatcaaccaaagtgatttatttttaaaacacctcattagaaatactcagatctgcacattgccacaaagcaaatgaaaataagttagaagttggagttgtaatgtattgggtatacataccctggtagtgagaacttccaaggtaccttagtgaaaatgacagcctaaatggcgttgtctgttactatttggaagatgctgacatctgatgtttctaactgaccactagaacatgtgtcagcagttgcttttgtaggggccatgctattctcctgctctctcctatcattgctttaaacagtacactgtaatgtcttataaatcttccatgtattttttctgcagaaacaaaaacaaacacaggaagacagagacacatctgtctcatcaattccatttgaatcattataaagagtttagtcaaattcatacatcggatgaacttatcaaatacagagggtgcttttgcttgaaatcttccccaggtggttttgtgaggataatgctcttaattttattaattttatttttgtaataccttgctcatccatcgtaattgatacggatccctccattgcctttggataatgtttacctcgcacgtagttcattctgtgttatgataatttactttgaatgacaaattacttaaatttttattgacaggctttaagtataaaaaagacctgaaatttgaaatctgtattaggtattgtgaagcaaagtgggtaaactttattattgtagaattgactcttaaactatgaccaagtacaggcaccagccaggcagatgtgtttaggctttctctggcattggagcatggtacagggcagtaatgatgtaagtgcttctatatatatgtatatatagtcatgcattacttaacaatggagtacgttctgagaaatgctcgttaggtgattttgtcattgtgtgaatgtcatagggtgaacttagacaaacttcgatggtatgggcctactacatacctaggccatacgggatggcctattggtcctaggctataaacctgtatagcatgtgactgtattgaatactggaggccattgtaacacattggtaagtatagtaagtccttacttactggcttcaatatgcttctggtcacaaaaacataaccaaacataaacacttctaaaactaaactttgaaataagcatgagttatatgtatatttttaaaagattaataaaaacaagtaagacaatttttacccaatttttggtgaatcaatgagtaacagtggccgtagtggtgttgggttaaatcaaggaatgaagtttgtaaagcaaaaattgtaaggggcacctcctgttaccatataattaaaaaacaaaccaaaaaaccaaaacaaaataacaaatatggcaggtcaccacatacttttgtactgtatcgttcattatgatacatttatatgattactgtttattcaatgaatttgtagttgacaataatttgtattcattttctgacttattctagtttagggtcatatgtggctggagcctatcccagcagctcaggaaccaactttgctaggatgccattccactgcagggtgcactcacacacacccacgctcactcagactggaaccatctagacatgccagttaacctaaagtgcacatatttgggatgtgcacatggggaaaatgtgcaaactccacaaagacagtggccctggctgggaactgatttttttttttcttatcagcattataactgaacagtgttgaatgaaacaatgttgaacaaaatgacactacttaaggacctgctgtatttgtgtatctaaacatgccaaaagataggaaaaggtacggtaaaaatacggtactataatttataggaacaccatcttatatgtggttcgtctttgactgaaacattgttatgcagtgcatgactgtatgtatagcgagggagacagagactgtatatatatagaaagagatttaagtaattgacttatgtgattgtaggggctggcaagtccaaaatctgtggggcaggccagcaggctgcaaatttggataagaattgatgttgcaatcttgagtccaaaagctggaaactcaaccagaatttctaggttgcagtttggaagcagaattccttcttctggaacttaagtctgctattaaggcctatgacacattggatgaggcccacccatattatggatttgttttactcagagcctactgatttaaataggttaatcacatctaaaaatgctttaaaagcaatggctagactggtgtttgatcaagcagctggataccgtagcctagccaagatgacacatgagattaattgtcacgtgtatatttttgattataatttttgaaacattaatattttaaaattaagtttgattcagtgtgaatatgtctttggaagtctggagctctgagaagaatgacaagtagttgtttactttgagaggcaaatggtattgaaagagccagtgatttgcagctgggtgatttgggttcaaataaattccagctatgccatttacagtttgtgtgactttggtcaggtttcttgaacttgagtctcaatttccatgttaataaaataaggtattactttatcaagctactttaataagcgagagaatgcttgtaaaactcccactgaagtgactggcatatagtggcatttaatacatgataacgcattattgtcatagtgattatcattataagcttaggtttatattacaaagttttttatttccctttatatcttttaaactatatccttttaccaagtgtactgtactttctgtagtttgtgggaaaaattgaatcaaaatctagcattctcaactttagagttcttttttctaagaatgttgtaattgaacaactaaaagagacaattgacattatgccatcagagggttggacgaaggttaactgaggtatcctgaaaagcatctgccatgctggagaggatgtggggaaataggaatgcttttacactgttgatgggagtgtaaattagttcaaccattgtggaagacagtgtggtgattcctcaaggatctagaaccagaaataccatttgactcagcaatcccattactgggtatatacccaaaggattataaatcattctactataaagacacatgcacacatacgtttattgcagcactgttcacaatagcaaggacttggaaccaacccaaatgtccgtcagtgatagactggataaaggaaatgtggcacataaacaccatggaatactatgcagccataaaaaaggatgagttcatgtcatttgcagggacatggatgaagctggaaagcatcattctcagcaaactaacacaggaacagaaaaccaaacactgcatgttctcactcataagtgggagttgaacaatgagaacacatggacacagggaggggaacatcacatactggggcctttcagggggttgggggctagggaagggatagcattaggagaaatacctaatgtagatgacaggttgatgggttaatgggtgcagcaaaccaccatgcacatgttgtgtacctatgtaacraacctgcacattctgcacatgtatctgagaacttaaagtataatttaaaaaaaaatgtaaagaaaagcatctgccacagagcttgggccaataagtttggtttattgtgttttagtcattggtatatagcttttctgaagttatgcattacagttaattacattctaagagtgcattataaggttaatttcttgttttgataccagggtttgttaaaawggaacaatattttctagaaaagctttaaagtagtcatattcttacagattttaaatctaggactttgtctaactattgatgatttattgagtagctctgggatttttttcagaaattaaaaaaaatctttcatctgtacaatttttcagttttgtttagaattctttttttgtcattgcatttttaaagcactcattttaatttaataaaacgatgagtgtgtctcctaaagttgaccacacaactgcaaattgtattttttgcatttctttgttggcagtagtagtttcctattggctgttctgtacttatatatatagatatacatatatatttttgttgttgttgttgttgttgttgtttttgagagacggagtctcrctctgtcacccaggctggagtgcagtggcaggatcttggctcactgcaacctctgcctcccaggttcaagtaattctcctgcctcagcctcctgagtagctgggactacaagcgcacgccaccacatccagctatttttttttgtagttttagtagagatrgggttttactgtattggccaggctggtgtcaaactcctgacctcgttatccacctgccttggcctccyaaagtactgggattacagatgtgagccaccacgcctggccacttgtcaatatatttaaaaatttttttatttttggcttgtcagtattgaccttaatatttgtagtattgggagtatcatgatagcagaaaggactttggaaaatctattattagagggcttcacatgggtgcttctgtaataaaatgaatggtgaaaagagacttaaccatttatagttgttggcttcggataaatctcccagaaaataagtggattggagtccattaacccaagcttcccaaagcataatgggagttgagcttagggcctgtttcctagtgagtgacctactgaggcttaggggctagatcaaaaggatctggtagtactgagtttcttagtaccaaattgaaaatggatttcttttttttaaaaaaggcctttgttacaatcttattgcctgagatgatgtaacatgttaatgggttatccattttgtattgtttttttktgtgtgtgtatgtgtgtgtgtaaagaatacacacaatctcaatgctgaaatgaatttgaaatgtaaactaattattttcaagtgcataggatattacagtctaaggtaagaaacagtaagctagtactcatttgttgtgctaagcaaattactaattatttaggtgagcatgaagaagaaaaccaaaccagaaaggtttagggatattaatgttcttcaaattagttaagaaagttagcagcagccactgaatgaggacctactatgtgtaagcatattttatgctcattttcctcacaagaactctatgaagtagayatcaaattattgcaggtctctaattgcatatccagcactcaaggcaagaggtgtttcacaattcatgacttttttaggtttttagaaaagtgacacatgggctgggcrcggtagctcatgcctgtaatcccagcactttggaaggctgaggtgggtggatccatgaggtcaggagattgagaccatcctggctaacatggtgaaaccccattgctactaaaaacacaaaaaattagccgggcatggtggcgggcgcctgtagtcccagctacttgggaggctgaggcaggagaatcgcttgaacccaggaggcgaaggttgcagtgagccgagatcgcgccactgcactccagcctggcaacagagcgagactccatctcaaaaaaaaaagaaagaaaagtgacacaggtatatactttatatcagtggtccccaacctttttggcaccagggacttgttttgtgggagacagttttccactgttgaattctgcctggagtatatgttttaaaattcaatatgtaacttcatattacagactctctactgtacctgctatattgtgtattacaacaacatctgaactcagtgaatggttttaggttcattgtcaggactctgggtccatttatatggcatataagcattttaacttgtttcttgccatattttcaaaacagccttgtgtatgtctgggaacaataaatagggagtttcattatcactgttgtgctaatgcatgtttaaagttagacagatgagtagctgttcatcaatatatgtaaaacctagagaaatgattagctattcatcaatatatgtaaaacttaattattaaaaaaatgtaatgtcctatgtctgtgcactgggagatccaggaaaggtaaaagttaagtcattatcctcaaggagattacagtctagttggaggtgtatattatactatttattctgttgtttcagtgggatttgttgtgggagagaaaggtaagttaaacagaaagcctgaagagaggtctgggtgtccagtgtgtcagggaatgcctccttcttgtagcatccaaccagattgttttgggagttagaaatgtaatgcagtcagtcccccaacttaaagaaatacagcccagaccatctggtatgtcacagttgtgtggtaacagcagtaaggagcatcggctgagtctgaggggagagctgggtgctccttgcacctccctggccctggcaggtctctttgctgatcttgtgctgctttctgaggagcctgtttttagaatgcttctccaggtagccagcaccagtggaccatcattgaagtaggagtgggtgttgaaagagatagggagggcattccaggtagatagtgtggacaaaggcaccaagcctgaaaaaagaatggcccggttgaataattttaagtagtttgagatggcacagtgcccggcacacagtctcttcataaatgattactcaaagattgagtgagtggacagatgaatgaatgggctagattgtggcatgtgcgtggaattaggtaagagattcttagacttgatcataattgcctagtaaatcattcttccatagcccttttataaggtaaatacctagtcataaagttcaatctgtgattcactagttatatttgcaaattatttagtctctgggcctgtttcctcacctataaacaaggtagttaggcttgagaactcctctattccttccatctttagaatagctatgattttaagtaaagggacagggaccaactagtgcttctgttgggggttcagagctgaacctcttctgctgtcctggctctttaggcatctctctggcctgtcacagaggttggatgactgggatgccttgtggatgcccagatgttcctgggatacttccagttttgtgggtgatggtaatgtctgtgtgttcttcctttgtcatctgggccgtgatttgaaggatatactaccatttgtatttaatgtctagggtggtgagataagagctcctattagattttttaactagaaatggaataaatgctgtatctagttaataattaggaaaactttactcatattttttatttggggcttaaggagaaaataaactttaatttagggattttttttttcctgcttgaattcagtagggtcttcctcaaaatcttaaatgggagttctcagttccccttgtaatgtcaacctcggcaaatttcttctgttgatatggaaagaattgttggacaggtggtaagggtaactgagcagtgggtagggatgagttcaaagaagagaaatcctacagacgatggttggttggatgataaatatgaaggattgtgtgctgatgtattccctgtggtggtctgcaagagtgtgtgggagacatttgttctcatttcctgtttcatcacagcctgccacctgctgtgtcgctatacaaagtaacatcacttttaaagattgctgtttaggaaatcatgttttatatgtcaggaagctgggttttttttgtttttgtttttttttttttgagtcccattaaagactgatccaggaagcatctctctatatgaaacttggtgtgtatgtgtgtgtttgtgtgtgtgttgacaacttaggaaattggtgattgatgcagaaaggaagacaatgagtaacttgggattgtgcctgtatggatgttttgtctacacgtgggtggaggaaaatacttgatgctgtgttctgtagctattaccctgtggagtttctcacttgaaaattgaagctgtgtccagatacagctgtaattcagaataatagcaacatagtactgtctttgtttttctgggccctgggaagacaagtctacagctctttgaggttcatgtgtgactctacattccggcctcattatttggaggtttgatatttgcatgtttgcctgcttgctaagctttgaaaccacagaaatcaatctttatggtagtttgtggtcatttggggacatctgcagagcagtgaaaaatttgagtccctgaaacacacacagctcagctgaagtaaaaggaggtgatgttctgccttcttgtttcagctgcactgctgtaaataaatatcactttcttagcctatttaatgccgtattttccccatttctgtcctttttattggtgatttcactgcctaacatgaccctcaagcatagtgctgaagtgccgtcttaagttcccaaacacaagaaggtgtgtgccttagggagaaggtgcatgtgatgggtaagctttgttcaggcaaaacacatggaaaacaaggttatattctgtccagttgacgaaaatgttgagaccagaggtttgcagatgtcaacttctgaaacaatgattctgtattctctaatgcagtgttatgttatagaaatacaagtaccatgagcagtaaaaattgtatttagagtagaagctaattggtcctagtcatggttcacatatctgggtgaacatggggaatttttatgccttgtgaaacatattttaaaagttaccttttgaaaattaaaggaactgtttgatttggagctaagaacaaataatagcacataggtagtttgactttctgaattcttttaagtctgctatttggaggcactgtttgtcataatgtgaccatagtgagcttctgagtatggatgaaatcttgttacaacacattccaaagacgatgaggcatggggacatttaattcaagtgttcgttgcagggtctgcagacagctctttgaatatcttaaactccaagggtcctgtctgacttatgtatctgtckgcttccttagaggccagcttcatagagagccctctttcctcagattttcaacattgtattccgtttgcaaagacccttctttatgggtgtggtcacttctagaacgaatgcctcaattgaagctgggaaatggtggaagagactttttccaagttgctgttactgggagctgtgagagactattgaggtgtgattaatgaatgtcttttgggtattgcaggttaaaacaggggtccccaacccctgggccacgaaccggtaccagtctgtggcctgttaggaactgggctgcacagcaggaggggagcagcaggcaagcgagcgaagctttatttgtatttatagccactccccgttgcttgccttatggcctgagctctgccttctgtcaggtcagctgcagcattagattctcataggagcatgaaccctgttgtgaaatgtgcatgtgagggatctaggttgcgtgctctttatgagaatctaatgcctgatgatctgtcactgtctcccattgcccccagatggggccgtctagttgcaggaaaacaagctcagggctcccactgattctacwttatggttagttgcataattatttcattatatattacaaatgtaataataatagaaataaagtgcacaataaatgtaatgtgcttgaatcatcctgaaaccggttcctggtgccaaaaaggttggggactgctggattaaaggacagagtcagctggacatcattgtaacatcattgcttggtgttttagtagcattaagacttaagttttgctttttaaatttacttctatatgttgctggagaggatttacttctgtctctggtgatattcagctaggttttttagaatggtctgtctgtgggacaagaaaaaaatctcagctaacaaaataggtagggatttctggatgtaaacctaggagaagttaggaaccacagaagtaagccttaaatgccttttccaatctgaaagaaatagctataaaaacaaaggttttggcaggcttatggggagacagagtcagagttcagggcctttcaaagatatgtggtctgataacctcccaaacctttgagcttgttctctaaaaagcttttatcatctgtgtaaagggaaaacagaaatacaccattctgtgagtagagttggagccagctttgcatcacctaggtaacccagtgggcactcaagccttgaacttgtgttaaggtcaagccagtttggtgttactcccaggtgtctggtataagcaagtgaacattgttttggagcaagatactaggcctcaaagtactcatatatatgtgtatgtctgttttaaaatacagtgtccagcacatagtcaaagatggttaggcacattaaaaaatagggctataaatgaaagaaaacctagcaaaataatrgacaagagaagcagatacccaaatttcaggtatagaaattacagctgtgtttagtatgcttaacagaaaaaaggacaagtttgaagatcaggccactggaaacaacaaaaaagtggcatagattacatagattagaaaacaaccttgtaattctggaactaaaaaaatccattgctgggtttaatttgcaggatttacacatgttgacctataatttttcttactcctttttcccttatctgatttggtatcaaagttatactagcttcataaagtgaaatggaaaatattctttatttttctgttctaaaaaaatgaaattatgcaattattcaaatggaatacatagtaacattagtcatatgtatcttttacagactgacaggttagtgccaccaagtattcacaagtttctgttcatagagtatttttatacaaaaaaacagtgaatttaatagcactttttattctcttgagttttagggacgtacaactcaggaaatgctgagtatttggaatctaagagtgacatgtgcatgtgtaaaataagtgctgttatctaaaaaatacatcataaaagtttaccgtacagtgtgtgcacccttggacatgaatagaagacaaaagcaataaagccacttagtagtggtttactaagtgttctgccactcttgacagggtcctggtctaaagctggcactgtcagcatgtgaaaggctgcagtctgtaaggacctggggaagagaagacattttctgtatgaacataattgtacagtaatattgagcctgagttgcaggttttataaaggaagaggaggctaagtacttactgaaggaagagctagaccttttctctttattctattatgggagatttttgacattttatgagttagaaaaagttatctttttcattctgatctgttagttttatacctttaatccccaatcttactgtgaattactggagtctatttttaaaatcttggaaattttttatttagtgctgcaaaaaagaaaaatgaaactttacctgaatactaggtaactgaatagacataacggaaacctcttccatttatctaccttgggtrtatatattggccttcatctcatttagtttttacttcctcccaaattcagacacaacctcaatcccacttaagactaaaagaattatactgaaacaagatttgcccactgcttatatttttcttgtctaacggaaagtattttccaagatagattattaaaattatagatacatttgagcaagaatgaaaaagaaaagggttacctcagagttctgtctgatgtgggctttttttttttttttcgagacagggtgttactcctgttgcccaggctggagtgtagtagtgtgatcacagcccactgcagcctcgacctctccaggctcacatgattctcccacctcaaccccaagtagctgagactgctggtgtgcgccaccacacttggctaatttttacaaggacagggtttcgccatgttgcccaggctggtctcaaagtcctggactcaagcaatccacccatcttggcctcccaaagtgttggggatacaggaatgagccaccgcgcccagcgtatctgatgtttttaatctctttacaagcatgggttccaagtggctatcagtcctgtggtctctaaactttgattaagcatgctagtagtaaaatatttcttggcatactcctgtaatgcctgtaaattgatttatacttacaaataatacacatatatggtatagtaatatatgtattacaaggataggaaatagctcagaaggatgtggcaaaactaaatatagtgtttttaatattttctccacatctcaagggacctcttgtttactcattttggatactgatgatccagactccccactccttctctcagaaacagggaatttacactttctagagttagcccatttcaagtgttgtgttagtttgtatagtagagtgattggaatgagtagccacaagcatttgatggagcaaaactctcatattctgggagagtttttaaaacttaatttcctttcaaacagatccttgagttctgggtatttgaaatgtttggtttgtgactttcagccacctcctttgtggagaggaagaataagagctattaaaataacagtttcttaatttcttggcactctgggacatatgaaatcagtagatttgacattatgttgtctggtcaatttctctaaatgtttctgcagctgtcataagcaatggctcataaaacctcattctgtcattttgccagatcttatagcaatgggtacagagagaacttttttttctttagcaattcctttccaacagtaaacctgtaactatgcctccacagtaaagaaggatggatatgaagaatcccatcaccctttggaagtttgcgtgctttccaagctttttttgttattgttgggcacactttatattcatgctttcagcttcctttcgttttcctttatccctgagtagggaagaaggacattttgtctaattgagatttgtcatttttaattgttagcagtaaggaacaaaagagtgctgcagtgggatttttgatgaaaaatgagaaacttgagggaaagcacctcagtagttgtactttgctccttcgatgttttccatgaccgtttgttcatccttctttaccatctttgtccatcagcccaggggagcagtggaaccaagctgggtgagaaggcaggaggggctagcctccattttctcttccctagttcttccccctcacaccagcatatcctacctttgtagccctttaggaagagacagtgtacccagaccatatttcatcaaatcccccatcaagacaaagtccgtctgccacttgctttccttcttttctgccatttgttgccagtccatcatgtggatatactgtctaatgttgtaggtttgaccattggttattgaagcttggatatacatttgtgtagaaaatcactggcactcaaaacatttgtacacatgcagaagaaaaatctcttagagaccccactgtgtctccccttaccatctaataccttgtcctaaatacttaaacacagaaaaataktgtaactttatacccaggtacttaaagaaggacctcttgattttagttgttacctagtgacttttcactgcggtctcttgaagtagccaagattgcgtttcatgagttcattttggtaactgatgtaattaagagatactttggagaacagtgtgggttgcttttgtctaatttagagaaaacagaagaaaggacytaaaaggaaaacaatctcaaacccaacttgcccctgcatttctcctttttttttgaaaagcatggatgcttggtgaaagtcttagggaagtgattcctttgaagtacctaggagaataattatatagcattttcattttacattgtgatcctgttagtcrttttggagagggaagactaatgatagcagacaatgctggctatttgcaggaatgcctttccctgtatcctcttccctgttgcttgttctcagtgctgttctgatgactagctctttttccaaacaaatttttaatttttccataggttattggggtacaggtggtgtttggttacatgaataagttctttagtggtgatttgtcagattttggtgcacgcgagcactatacaccacaccctatttgtaatcttttgtcccttgcccccctcccatccttcccatcaagtcctcaaagtctattgtatctttcttaggcttttgcatcctcatagcttagctcccacatatcagtgagaacataggatgtttggttttccattcctgagttacttcacttagaataagagtcttcagtctcattcaggtcactgcaaatgccgttaattcattcctttttatggctgaatagtatttttatggccattgtgtatatatatatatatatatatacagtagcacagtttttttattcactcattgattgatggacatttgggttggttccacgattttgcgattgtgaattgtgctgttataaaactgatgactagctcttaccagttttctctctcatgtgtttggggcaataagttgtctcttaaatttattcaaccctgacattatatttttcttatcccttaaaagttgtgttttgctttttgtttgcttgtgtgtgtttgtgtgtttgcattttagtgtacttataaaagcttttggttcagaaagattactcccaacaagaattttattatatttgatattcttgactagttatgtatcctgttgttttctgcatctggagataagatgttaactggaaagatatttatcacattggaatgttagttgcttttttaaatgtgcttaaggcccaaagctcarttaataagataggatcctcatatcccaaaatcttgagccaagggagggaactaaacctttaacagatgagctggtcaggcgcggtggctcatgcctgtaatcccagcactttgggaggccgaggcggtggatcacgaggtcaggaaatcgagaccatcctggctaacacggtgaaacctcgtctctactaaaaatacaaaaaaattagccgggtgtggtggtgggcgcctgtagtcccagctactcaggaggctgaggtaggagaatggcatgaacctgggaggtggagcttgcagtgagccaagatcatgccactgcactccatcctgggtgacagagtgagactccgtctcaaaaaaaaaaaaaatagatggagtaattttaactcattcttatgttgttgtttaaaggcaacactgtgagatgaaggggatcgtgacatgtaattcatgtaagaaattgtaataatagaagctttaataacatataaagaatattgagtctgggcacggtggctcacctctgtaatcccagcaatttgggaggccgaggcaggcggatcacctgaggtcagaagttcgagaccagcctgaccaacatggagaaatcccatctctactaaaaatacaaaaaaattagctgggcgtggtggtgcatgcctgtaatccaggcaggagaatcgcttgaacccaggaggcagagtttgtggtgagccaagatygcacctttgcactccagcctgggcaacaagagcaaaactctgtcttaaaaaacaaaagaatattggaaataaggaggagtgaagagtgaaaattttaatctctgtcctgctctctgggagagagagtgctctaattttagacaactagacattatttttagacagaaccattgctacagaagggcagtttgccataatttgatagaactgttgcctaagaatgttcaactttcatttgttccaattctctgcttatcaagcaactttctgatctctaatctggttttttttttttttttttttttttttttttttttttttttgagatggagtctcactctgtcacccaggctggagtgcagtggtgtgatctcagctcactgcaacctccacttgccaggttcaagcgattctcctgcctcagcctcccaagtagctgggactgcaggcacatgccactacacccagctaatttttgtattttttggtagagacggggtttcactatgttggctaggctggtcttgatctcctgacctcaagtgatctgcctgccttggcctcccaaagtgctgggaggcaattcaccttcctcagcctcccaagtagctgggattacaggtgtgagccactgcacgtgcccagccctctaatctggtcttctktgaggacttgtcctgtgcagatatctattcccattgttttaacaaaaatagctttcattgaaattttacatatgattgtttatggtatttaaattagtttgattatcacaagtcagttccctagaacctaatcagcatttaatggactgataaaaattctgaatttgaagagcggtagatcaggtgattttacttgaaataactaacaagcattattagattacacagaattctgccaaaaagaaacataaatgtttttattactgtagtcgttttacagtgttactcatgatctcattgagtaatgataatgccatccatgacaatgtcaaaaacgtgttttttttggatgggtgtggtggctcatgcctgtaatcccagcactttgaggagccgagatgggtggatcacctgaggtcaggagttcgagactaggctggcaacatggtgaaaccccatctctactaaaaatacaaaaaattagccgggtgtggtggtgcacatgtgtaatcccagctactctggaggctgaggcaggtgaattgcttgaacctgggaagcggaggttgcagtgagccgagattatgccattgcactttagcctgggtaacacagactctgtcttaaaagaaaaaaaaawtttttttgctttttaaaaattgtactagctattttttccacagtgctgtttaagttatcacagtttctaggctgtgtccttcatcattgattatctacatccagatagctgatcactgatgaaatatacatgtgcaaaacttggagatgtggacactagttttagctgcagcttctgaagtggcaggatggggtggggcagggtgaggtagtgggtataactggagtcttcagcggatcagccccacttttgtcacctccctttctctggaagctaaggattccctcagctgcagccttggggcttaggatgattgataataaccccagctccacttattggtcactgagttgagtcagacctgctggggatcagaggttttgtttcttcctgtttttttttyccatactcagtagctagttaaatytcaaccattatagtttgatgccagtgttttaaatcctgtgttaaacaagaaacttacgttgttagactgtgtggtaaggttttagtttttagttagtttttttttttttcaacacagtccttggctttgctgatttggacctaacagctggccttaggacaactgtttggcagtactaatgttctcagatattttttaaatgtattttatttatttatttttttgagacggagttttgctcttgttgcccagggtggagtgcgctggcgcaatcttggctcactgcaacccccatcttctggtttcaaacggttcttctgcctcagcctcccaagtagctgggactacaggtgcctgccaccacgcccggctaatttttatattcttagtagagatgggatttcactatcttggccaggctggtcttgaacccctgaccacgtgatccgcctgcatcggcctcccaaaagtgctgggattataggcgtcagccaccgcgcccggcctgttctcaggttttaatacttttgaatgtaaactgcctttgaaaggctataacacagttcagttggcttctaaaacaagtgttttaaatgaaatttagtaatactgtttaaaaaatgaataactttatggccaggcatggtggctcacacctgtaatcccagcactttgggaggctgaggcagacggatcacttgaggtcaggaatttgagaccagcttggccaacgtggtgaaaccccatctctactgaaaatgcaaaaattagctgggcatggtggcacacacctrtggtcccagctacagtgaggtgagattgtgccactacactccagcctgggcaacagagcgagactccgcctcaaaaataaataaataaataaataaataaataaataaataaataaataaataaatctttagagtgtttttaggttcacagaaaaattaagtcaaaagtgcagaagtcccacatatttccttcctggatcaccacacacatagcctctgcaattgtcaacatttcctatcagaatggcatagttgttataatcaataaaacattaacatgtcataatcccctaaagtctatagtttaggctctctcttggtgttgtgcattctaaggatttggacaaatgtttcatgatatgtgctgttacagtatcattcaaaatagtttcactgccctaacaatcctctgctttgtctttcatccttctctcctcccccacctccaggcaatcacagacccttttactgtctcctttcccagaatgtcatatagttggagtmatatattatgtagccttttcagattggcttctttcatctacttatatgcatttaagtttcctctgtatctttttgtagcgtgatagctcattctttttatcactggataatattccattgtatgcatgtaccacaatttatccattcaattactgaaggacatactggttgcttccaagttttgtcaattgtgaataaaatttctataaacacatctgtatacatatttttgtgtggacatacattttcaactcagttgagcaaattcaagggatggattaccatacatttatcataccattcagcaattgtatgctaagagtatgtttagaagaaactgccaaactgtcttccaaagtagctgtaccattttgcattcccacmagcaatgaatgagagtagyaatgctttcgaatactaaagagattgcaatgttaaatgtatttttgatgatttccttgtggagatatcattatggcaaaggaccatgaagcacggtaaagcaaaggaccatgaagggtcatggtaaaggaggttactggtgataggtgtgtgtgtacgcaggagttgaagggcaagggcttcccaatgttttcccatctccaaattaccacagcccacccagatactgtgtcttacattttagaatcactgctggaaatggagttatattgttaatgtgattatgcactgatgtgctttcattatattagtattggtgatgaaagtatctttgtcattttaggcatgtaactaggcctgtaaagatgtcttaattgggggtttattaggattagtgtcaaccgtatggcaaccatatcccagtgctgggagtcaaagttagaactgtgactttggacattgctctttaaggtcagggtagtgtcctgtgaggttctgccagcctcagccttgatgtggataataccatcatttgtaatgttgtgatatggtggagcagragttctctggcctcagaaaacatagcttgtgtgaagttagtgaaatgctcatgcttctgctgtctgtgatactgaatctttcaatatttttggccttaactgtgacttgttctggtgggagaacttggaagaagtgaaaaaagatcaataactttttgaattggtgcaagacaggtaaagaagagaagtgttgggctttcttttacattattctgttaccatcaaaggtagattccctactattgccatatacaaatattctttcattccacaggattagagttgatgatggtctatctgtctttaaaggtagatctcaactttaaactttaaagttgagttttcttttgtaaagtaagagtaaaatggcaagcagatggaagcatctcaagcaaggcatccttccatctgggtgaattgtagctaatgtccagaaacagtaagaatcacacyggaacgagttgccagccagctgcccatatactacctgwtgtatgctggtatrtcctgagactgaaactttggtataggtactgctcagttaaatgtaggtcattctcacacagaatcccatttgggctaccatcttgtttcttttgaatcataacatgaaatttactatataagtatgtgtaaaacattaggctatttatcatttttccttttagaagttttttaaaaaggtttttgccaacttgaaggtgtaaaaattttaatataggtgaaataatcagatgtatatttaaaatatttattcatttacatgttttaaatcacatatatacagaattgggattgttttccacattcttaacattttacgggacaattttattccagtttttttacatacatctttgatatcagtagttattgaagtcacttttaaatcatcagcataatttcccatatattatattaattttcatgaataaattgtgatacagtgcttttttaaatttgcgtaagattgctgtcactggaagtcactggaagttttatctcaagccatgcatactgatctacataacattaggatagtttttcttaytggtttatatgtgggatctttacaatataactactcactctcctgcctcaaagtattctttaaaaagcatattattggctgggcgctgtggctcatgcctgtaatcccagcattatgggaggctgaggtgggcggatcacaaggtcaggagatcgagaccaagtgaaaccctgtctctagtaaaaaatacaaaaaattagctgggcgcagtggcgggccgcccgtagtcccagctactcaggaggctgaggcaggagaatggcgtgaacccgggaggcggagcttgcagtgagccaagatcgcgccgccgcactccagcctgggcgtcagagcaagactccgtctcaagaaaaaaaaaaaaaaagcatattatttacaacatcagcacttttaattttaaagccatacctactaagaatgactacataaacctgggttaatttatttttctcttaagaaaagcaaaagaaaacgaaacaaaacactttagattacatatcccaaataagtttctgaaacttgtattatctgaagtcatattaagctaatttgatttccccacagtaattggtggtctaaaatgaagtacttgggaagctctgtaagaactagaaaataagacagttctcccttttctgaaaggacaacttagaggagaaattctttcattatattaggcatatattgtatttagaactagactctgtccctatctgtacatgtattcatttaaattctccgtggtttccttacgacgcatcctttttttattgtgtcattaagagagacaatgctaggcattttactcaatgtgaatattcttaaaattcatttatgaaaacgtcaggagaagccctgaaagaaaatgtagttgagggtgtatattttattggtccattgtgtcaaaaccatccattcatattttattacttattcagaggaagaaatgtaaatttggccgggcatggtggctcacgcctgtaatcccagcattttgggatcacgaggtcagaagttcgagaccagcctggccaacatggtgaaaccccatctctactaaaactacaaaaattagccgggtgtggtggtgtgtgcctgtaatcccagctactcaggaggctgaggcatgggaattgcttgaacctaggaggtgggaggctacagtgagctgagatcacgccagtgccctccagcctgggcaacagagtgagactctgtctcaaaaaaaaaaaaaaaagtttatgaaatcatccatttgggctcagtttttgctgtttgtacctttcctaaggcttagtacaccctgctctgtgttgctccttgactggtggtttcactgaattgtccccattttttgtttgttttcttgtttgttttgttttttgagtcaggatcttgctatatcacccaggctggagtgcagtagtgtgaatatgactcactgcagcctcgacctcccaggctcaagggatcctcccaccttagccacctgaggagctcggaccacaggtgcaagccaccatgcttggctaatttttgtgttttttttttctgtagagatggggttttaccattgttgcccaggcttgtcttgaacacttggggtcaggtgatctgcctgccttggcctcccaaaatgctaggattgcaggcataagccagcattcccggctgtatacttttcaaggggcggggrgaatgcatttgtccttataggctccgttactgtagscatttagtactgcttgaaaattaaattagaaagtaagtgccacttaaaaagtttataaatatgctttataaattctaaaggtgtggaaaattggtgataattggtttagcctcataccattcttttgctcttgttttctaccacttagctctttttctccttctcatataccttttatttttcacactaatattgttctttttcacttatcactggacatttaagaacttggagtgcttgatccttagcatacatttgtgtccacttaggtcttttaggggagcccttgaagggcactaagtataagcagacaataaaaacaggaatgcctatatccataaataaataaatatatgtatatacaggcctcatttatgctaaattacacaattatactatatagtagacttgaaattatatttttgtggaaagaaggaaagtaaggagacaaatctagtgaaggctgccttgacttaacagtgcagaatcactgtgcagcaatgtgcttatatggccgcgttgcgattataatcckcctacatgcataagtcaatggggtctttgctccaaacttgtggaagaatgaatgagccaagtagtggtgggagttcagtttagttccactgttttgtaaattgggctaattttcaaaggtattcagacatttaccttttcaagtgatagaagcaagagcagagaattcatcctttcttgctactaaagaatttattctaaaacattacatgtcacttgtccctcgtggctagatgtggatagagatgctggattgtttgtttggagcatgcagattgcactgtttcatcttttgtagacacagaaatcaagagttatcttttttcttccaaagatggaaacaactatttgagaaccctatcattagaaaattgtaagcctttaaaatagaaccttaccttctattattcattgcaaattattttaacacaaacttacctgcagctgggcatataggactcgactgagtacagaatattggcaaaagcattgtagagggtcagaaaattacttaagtctgaacttgattggaaatcagctgatatttcatgtctctgatgtccttcatctttgcaaaatcagttcctgtggcattttagcatttctctagaacattactatgagaaaggaaagtattgaaaagatctagtaatagagatattttcagaaatctaacagataagatggtagagtcaagctctttggagctagatgtatacattaaagttcatcttgtataaactctttattttacacttaagaaaattgaggtatggctgctccttactccctagtacaatacttctctcactgtgtatcttaatyatttgtatcttatctcatctgtcatatggaattcctttagggcagggactcacccttattttatctatgtatcttcagtactcagcctattgcctggcactgagtaaatttcagggtatgtttgtaaattgaatgaatcattgactgaawtaaccaaacagcaagtcagactcacctgggttcactctcgttcttctattgggttgctgcttattttacaagtcagacagttctctccctataaaaggcaacaacaaaaacatacctcaaaataaagagatagctggggatgagtccgggccctcaaaatcttacgttcttatgtgtgtatgtgtgtgacatgtgaataaaacatgcagaaaataaaggggataattccaggtactgataataccatgaaaaaagtgtcatgagcatcagacagtaattatctaaatgtcttctttttagtagaaatctaaccccacacactgggcctcagtccatctatctcacagaaaggaaatccttgctactaccatgaaagcttatcacatgctcatggctgaaggagttcttctggaaagccagagctgctaaaaggaacttaggggatctgttcctaagttcctctaagatcccaatagaggactagaggcttctttccctcttgggggatgccatgttgattaatgaaatttttgctacttagctttaggaaaaaggcatttatttattttcttttctttcctttttttttttttgagacggagttttgctcttgttgcccaggctggagtgcaatggtgcgatgtcggctcaccacaacctccacctcccaggttcaagcgattctcctgcctcagcctcccaagtagctgggattacaggcatgcctcaccatgcccagctaattttgtatttttagtagagatggggtttctctatgttggtcaggctggtctggaactcctgacctcaggtgatccgcctcccaaagtgctgggattacaggcatgagccaccacacccaaccagaaaggtctattttctttgatcttattaaaggctgccatatacaaaggttttcttttaatgttgatctgtttttaaaatatggaagaaagccttgaaaggcatcatcataagctctacgtcaatatccagaaaatatcgtcttgttttagaattctagcctgttttgtttggtagatgagtcagtctactgtaaataaatatttattgagcacttgttttgtgccaagcacagtgccctagggattgtagtgtttttcaaattgtgggtcacagctccctaatgtcataaaatcaatttagtgagctataaccggcatattcaatcaaatggaatgaaaaatagaatatcagattgcatcatggatagtattgtattattttatcaaacttgagtttcaattgtgtatgtatgtgtgcaaggttgcaatataaagtgtcttttttacttgtgtcatggttagaaaagcttgaaaagcactattatagagcatacccaaaagtatatattccttgcttttgaataagttaaactcttgttggagcaagaaacacaaaagaataaatactcaagtagtgaattacaataagtgctatgtgttcggaaaagtaagatgataatacaagttgaaagtggcatggatggatatggtggaacttgaaccaaatctggaaagatggatagggcttggaaggrgtgaagactagagaatggcttaaaggtgagacgtggcatatggataatagggatggcaagactggaacagaggtttcagtttacattagagaactgtaggatatagtttggagatagaaaatgaagcacaattgtccagacttatggatgccttgtgataacatgcctgaggagtgtgtattagatcaggtaagctgcacagattcttaagctggggagtgataatgatatagggtgggtttatagaatactttccatcttcttcctaactcctctttagtcatggggagctcctaagggaatttcttctaggtaggtgttggataccaagtctctggcatcagatcaaagagagccagaaaggactttggctgttctccagaatgtaaatagaaaggtagaacaagtcccattgtgggtgcatgtgaaatactcccatggaggagaactgcagtgctgtctgtttgaaatacggcaaagaatggattgaagaacatttcttctgatatcactgtttaatgtttgctctcaatgtaaagggaaaagcagattaaagggcccatgtttttgaagtactgggaacctgactgacctacctgaaatatgctatgtaaataatttgtcatgtgatctccttaccctcaagacaccttcactgaatatgctatatacataatttataaaacagtttcaagcgtgattgcaaaaagtttctcctcattggaaagggacatttgatatttatctgccaaactctttactactttccaattaaagataaatttaaagaagtttctgaaatgataatgtgctttacggggaaggtgatttaactagaaagaagcttttaaaaaaatgactatttaatctataacactaaatacaccaataatttagatcgacttctgattgaaagttatgattctttgtcgtggcagattatcaaatgttctaaattgaggctrttctaggacatagtttttaatctaagtcatattaaataaagtttatgggggcccattgttttagactagcctcttggactaggccccagcagaccagactaaactagaatggagtygctcatgctaggtaccacataattaaactgaattctgaaacaggcctggtttgtttaagtaacaaaccagaagattcacaacaaccagtcaaaaggggcccagtttacctgggcatgataagaagtctyctctgttttaaccctaaaaggaaagtaacttttgaaacagtcaatctgctttttgttctgtttctgcttttctcagaacttttttgtctataaaaccaattcctctgctcagctcattggaacacttattctattttatagagtaagatgttgctcaattctggaatcacaaataaaagccaattaagacctttaaatttgttgtaattttatttcttaacagtcattagaaaaaaaaaagcagatgcatctaggattgcaagattatttacatgtagtccagggggattacatacattttagctattttgtagaaggtataatttaatcaggaacacaagttcaagcacagcccatgagagatgaagggatatgaagaacactaactttggtttctaaaggaaagtgtgtagagtgtacattcttactcgtctgcaaagagggtggatgaatgaaaaatgaagaagggggtgtattcgtttatacttatgaaggcatctgctcacaatcagtcacttgtagagagagtgccagctggcagggtacttgcgtgatgtaaattgtccatccgctcagaagagcagaagtacaaggaggccttgtgcaaaggactgaattcctacccagaggacaagggagggaggttcttgtagatatctaaatgagatctacttccattttccactttatttgcagttttcaacatgtcatttttcctgctgtcccagctacgattactgtttgacttgagtaatcagtttccccccttcactgcaactgctgcttattaagcctctgcctggtggggggagggtgggtataggaggggacactgctggaaaaatggtgtcactttttccaagagtgttgttttccttgtctttctgcttcactggttcatttttgtgagctgtataagagctaaaggwtattattacagatttcattttttgaaatgcatcaaaatctccatcccctcccctacctgctaatctttttgcttgttaagaaagaaagtgcttctttctgtgaaatcatagataattctaggggtatcaaatgtaatggaattaaatcttataaaatttctgaatggacttccttctgcttttttttcacgatagtagagaaaaaattcaaacttccttggacaaaattttaaaacagtatgccctgcagaagaagaggttttagtagaaatctttgtttttgtattctttgatttcttagatctggattggagtgggtcaccaaactttttctgtgagaggccactaagttaatattttaggctttgctggccatgcagggtctccacaattgcccaaccctgcccttgtagccagaaaagcagcgataaacagtgtaaagcattgtttacaaaaataggtggtgggctagatttgatcttccagctgtggtttgccagtctctgtcttggattctaagctacttaaagtgtgtcctacctccctccctctgcccttcctcttcctccttcccctccctctctaattactatatgaacatctggcacttcgtacttaagccccccttttaatgtatattttttaaatacctaaaatttcttctctgaaaaataaatatttctatgctagtctgtagccaacagaatgtaacaccctccctgaaaatgccaacattacccgacacagactgggattaaacaagtctaggcttctagacaaagaagaaacagtgttttcttatctttttgagtgtactgaagcagaagttaactctttgctttcasatgtgtcccttatcatcgagaattgctggtggtcctgtatcattttattataggaaggaaggatggacaccagagagggtggggaatttggtttacagggaatcttgaccagtgcctgcctataaagggtaccactgtgaaatccccagcagtaagtaggttttctaaaaatcaagtgtgtatttctacttgcctaggttttagggccttgtgaatgcaagtcgaatgatagaggaaattggcttggaggaaaatgttggggagtttgggtttagctgggtgcagtcacccctagacttggatgtggagtgagtacccctgttgactttaacatctgtgtgtgtcttaaagaagactgctacttttctggtttattgtctatgcctacagatgacacgtggaataaattgcacattaaaatgtctgacatgaaaatcagaagagcttaagttcattccacagaagccttttgttagaatcttcaaaggatgagaaccaggatgaagaagagtttacagtagggaagtatttctcaactgtaattgtacataaaaattgcctatggtgctttaaaaaaatacagagtctggggacacatgttctcgggatctcctaagggctgtcacagaccataaagtttaagaagaaaaaaaaaaaatacagagtttgggacctcacccaaaacctaccaaaatgaaacttgtggagatgaggctcaacaatttgcattttcaaaagctctgtgggtgattctaatagccagtctgggaccttattgtgggccagattatgagaactactataacaggaagacatagacctgggctggctctaatggaaaggggccttctagagcgcctgggggttttgaactgtttgggtacagataactctttttagtctggatwcttacagtgatcctgaaaatgtatattatgccttttctctttaggaaatctttgggaaggctttkttagagaacgtctttgtggatgaaaggggctctctttctccacatctcttagacccactccaatccactccaaaccaccagagaaagtcctcattgttcagtagaaatccagctgccacactggatcattcccatcagcacaacacatgatgtcttcccatcttaaaaagcaatttgttcttgaacacccctttcccccttcagctaccacctcatttctttatagaaaaattacttagtgggctgggtgcagtggttcacgcctataatcctagcaccttgggaggcccaggtgggaggattgcttgaggccaggagttcagtgttgcagtgagctatgatagtaccattgcactccatcctgggcgatttagggctctcccctgtctctaacagaaaataagaaaaattacttggaaaattgtttttattacctgtctccaatgcccccttcccttgtgcccagcattctctatggctttcattcctgtcagttctaacaaagcacttcaaggtcacacctccaggttgccaaatccagtagccaatgctcagtcttyatctttcttagcatttcaggagtatatgacaaagttcagttggtcactctcttctttttaaaagaagctttttaaaatttggcttctggaattctactcttttggtattctttctacttcagtggcttttctctccagtctccttttctgggtcctccccatttcccccattgctaaaagttggtatgtccygagacccagtctgtgtacctcttatctatctatgtccattccctagttgttttcctctaatcccatggctttgaatactaactgtatgctgacgacttccagatttctctctcttgctgcagccttttcctgaactccagacttttatatcctacctgctgaattgatattttcacttagaggtttcgtgggtatcttcaacttagtatatctgaaactgaactcccagtttcttactctccatccccccatggctgcttcatcattccagttgtataagccaaagcttgcatcccacatccagtycatcagtaaaagtggtttgttccaccctcaaaatatgtccaaaataccattatctgttagctggattgttgcaaaactcatctaactcatcttcttgtttctctgtcatcccttctgtagtctttggtcagtacagcaaccagtcatccttttgaaatgctagttagagcctgttactcctttgtatraaactctccagtgggttctcatcttattcagagtacaaaccaagtcttacagtgatctacagagccctccatgttggcattccctcctcctctcagcttctctcacctcatctcctaatacctttccaccttactcactgctgcttcagccgcactggcctcctcaccactccctggaacttgccagcatgtgcctgcctcagggtattgcacttgccattcctggaatgctcttcccattcctggaatgctcttcccccagatgttgcactgttttacttcttcaggactctgctcagatttcaccttatccatgtcatgagaccatctctgataatgctgaattaaataggctccccacaaactttctattcccacttcgtttttcactgtcatctgacacacagaattttcatttttattttaaaatctgttccttacccaagcatgctccctacttttactgtaagttctacaaggttgagaccttgtcttattctctgctgatccccagtgcctagaacagggactgacacatagtaggttttcagtaaatgtttgttgaatgaatggaagaatttggacttgagcaattatcaaggccagtcatagctgttaaccttgacctaatgggtggctgtggtaagaaattaataagcaattgtgaaaactgagaaagccattttagtatgtaagatatcttatggtatttgtaatttgtaattatttcctcttttaaggacagatgtaaacagtacatgatcaggggaattagggaccaagtttattaggaatgaaactaaagaataaaaggcactgtagcaaaatgaaggattggaggggtttttttgtttttygtttttgagatggagccttgctctgtcacccaagctggagtacagtaacacgatctcagctcactgcaacctctgcctcccgattcaagtgattctcctgcctcagcctcctgagaagctaggattacaggcacctgccaccacacccagctaatttttatatttttactagagacggggtttcaccatgttgatcaggctggtctccaactcccaaactaaggtgatctccygccttggcctcccaaagtgctgggactacaggtgtgagccaccgcgcccggtggattagagtattttaaatagcacatcacagtggacttttaagttcacttagcaaatagttgttgaatagaaaaagtaaactattggtcaactttttgtgactttgtgggattattggagttgaccttagtctattactataccaccgtgactaggtattagaatcttgkttttctaattagattttctctttttaaaaaaactatttttcactcttctgttatagataaaagccaaactatagccagctttcaatagtatatgaatatcacagaacaagaaatagcttcccacacaattatggtgtctttttcatatcttaacaattacacatttctgaaatatgggcttatgtagcttatatttaattgcctttttatttctttagtgttataattaacttagttgccttctttgtgactccgttaaatctcatgtcagtcaaatccctgtagtgggatctttgttcagcagagcgagtggattttttgcctcagcttacacgagtgggggtgaatattggccttgttcctttagcccagctcaaggacttattcatgcctgtagtctaccaccatgaattaggtctggtattgagtcttggaagcatggggtttgggttaataaggcatattccccagttcttggcttaaaatttcacttgggaatcttttttggtgagtatatcaaataaaatggcaaagatgtgcagattaggatgaatttatcgtatgttttgataatggaaattgtttgtaccctctaacagtgatttgcacttatttgaaattactctccaagggtgtttgacattctagtgttcagttaagaattctctctgtatgcatataatggctgttttatgatcacattttaattcctatgataagtcaattttggccctycagtttactgaagtgtatatggcattttggggcattgcaattaggcaatgcaagcagaaagcttttattttttagaacttctgcattaggttagtgctgtgatcttatttaaccatagcaccaagtagtattttgagggtgatagggaaagagaattgtctttttggcttaaactttaattttgatacttcatcgaaaaatctaatttccatagagattacggrtttatcttctccaaaatcatactgtctatttcagaacttttgttttcctcttagctccatagtgataatcataccattatttttataatagcttttgatacagaattctgttagctttaaaaaattctaaaatgatatcttctattttacctacctgctttgttatatttcactgtggcaacatagaattgagactttccatattccatctctgttcatcttagttagcgtgtctttccgttattaacaatggcccaagtgtgataggaagtgcttattgcctgtactcagaaaacatgactgttgaagccctttgttcattcatttgaaagggatactttctcaaattgtaagttccattgcatttgttgtcataaatttagttaggaattactattttatacaaaactgtaaaggttatttgtctgcatttttaagttgtgctgatctaaatatactttctaagggattgtcctcttgcactgttggcatttgacygattgacaagggggaggccatgaaaagggagtacagaaattaggggaaaggaacaggataataagtttttaaaaacaaacaattttgaagataagttttagccaatagaaactagcccttcaacrggcaataatgaggactgagtttttcagcatctggagtgactgcactgtaccagaccatcttggtatattccttatgtgcttagttgttctgtagtgcttccgatcatctgcctgtgtctgcttgaggatcccacagtcagtattaagttggccttgggtcgtcttaatcagtgaggctctatttgtgcaatccatccgctgaggtggaacaataacagctggtktgcagctggatatgttgtcctgggaactcttgtttcagccagcagttatgctaacaaaattgaaaacattttcaaatagttgctttctgtgactactgtttgtgttaactgtttggagatcccatttagtagcctaaacacaccccatctctaattgactttgtgctacaactttattaaagttttatatgcctaaaatcaagtctggcttcaaggagagcattccttttctgacttccaaagagttaacacataagagccagtagtgaaccagtgactcctaatttgatactttagaatgaactagttttctttttctaattcaagctgtggaagggcattttgcaattttgtaaaattctatatggctattgtcattcattactaaactctaaaggaggttgtttcacaagatccttatggaatttttctgagtagcacataacagaggagcatttatgttccccagcagtcagtgcttgaatccaattctaagacaagaagagtttctcccttattcagagagatgagaaatactttaccatgtaggaggcttaagcagaattccttggcttggtcccacatgaacaaaggctggattctcattgtcgatgcggcctgttcccctcctctcattccctcaaccagcatgaactgtaggatctagagcaggaagtattggttaattttgtgtgcttcattctaaacatctgcccttgagttttttgtttatggaagggatatggcagggggaggaagaggggcagtagaacactcagaagctaaacatttttttggtggtgtgtatatccatggttagtcttcgtgtgtgtgaacatggggtgaggagtggaagatgttctggttgaatagttgctggaatacatccagaaatgcacttactgttttccttaatcatttggcttggctactttaccttaaagccatactgtctactttcacttgctcccgcagcatgttgataatctagtagtgtcatcagactggaaattagaagacctggtccagttttctattcatctacctgttaactggatcttcttactttgtcaattgtgaaatgagtaggatggacagagtagggaagtatagtgagagagaggacatggtaaccctcaggtagagctatttaacagaataaaaagctccttagtgttccagttctggttgtagttaattccagataacacacatacctcgcactttgacccctctattccattttctgtatttgccttcttatttatccagactggattccaaattccttgaagcaactttattccccttgtcttgttgtctttcttttacattggcagaggggatgctgaatgctgcagcagaaatcacacctccacagagatgtttgtacaaaggcatggcctcctgctctcctctcagccacctggtctttgcccagtaagccttcttttttctagtcagctacctttgctggactttacattggctattataaagtttctacactctgttcaaatattccccacccaacattactccctgtctttgccgccagtcttgagcaggtatccttgattttcactacacagaaaaaaagtcatcagtagaactcgaattttaacttctgccccttaaaacctacaatgtcactttgcatatgcacccagacagagagcaaagaggcaggtttccttctgtagagaaccagtctcccaacaaacatggaatcccattcttgttttccagcttctatttttcacctttccctctctgctgactcaaatacaacagcatttaatacacgttcatctctatcagaaaacaaaaaagaaaagaaaagtctttccttggccctgtaacccttccaaatatcatcttcccctccttctcctcttctttaggcagactacatggtagattaactacactcactgtgtctgcctgctgtctattctcaattcctttgtttttgttgtttttttttgaaagggagtctcgctgtgttgcctaggctggagtgcaatgtcgcgatctcggctcactgcaacctccgcctcctgagttccagcaattctcccacctcatcctcctgagtagctgggattacaggcgcgtaccaccacgcctggctaattttttgaatttttaggagagacagggtttcaccatgttggccaggctagtctcgaactcctgacctcaagtgatctgcctgcctcggcctcccaaagtactgggattacaggccttagctactgmgcccggcccattctcaattccaaccactgccatcttgtccctggcactgcttttggtgcagctgtgacctctgtggcttgaagctgatggatacttcttagtcattatcttacttgactctcctagcagatttgaaccccattgattcctccctcctcaaaaccatctttccttggcttctgtggcatttttattcttttacttgccttcctccctctggctgccccctcatagcctcctctgtcatcttcctctgtgtgtgctgtgaatgtttgtgcacctcagggtggtctcagaagtcagctgtcacggaacacacttgctccatatgcttcaactgtactcaagtctccagtgtccatctgcatactagtgagtcccaagtctctgtctctaactcakacatctctcttggcccgtcaaactgctcacatccagctccctacagacatttcctcatctactgacctgcaggcatcccagaactagtgtatcggaaactgaattcatcttcccatcctgcccctgcgcctgcctccagtcctgcccacgcttctctgttctctatttcagtgagtagtactaccctccacttggttcatttgaaactagaaaactgaatgttattcttaatccttccacctcatggaatgggaaaaagcagctttgacaatgaaacagggtactaacagcgacaagttgaggagcctttcaaaagcagctccctatcgcctttgtagtacatcagttactaagttactattsaaaacggcttcctacacctcactgaggtccattcatttctctccattcctctgttcccattcttagttcaacctctgtcatctctcctggattactgccacatcttgacctccccatcttcgttcctgtcccttccaacctaatctccacactgatctttctaaaaaatcaaacctgatcatgtattttctggtttaatgccttcagtggctggccattgcctttaagctgaagttgctccttaaacatgaccgtagcctggtgtgctctgcttcttgtttgcctcatctccagccacttctgtagttctagctaccctagacaactctaattcctatggtgatcactcctctgtgttctctgggctttcatacatgccatttcatgtgcctggatgatgggtccctgtttgcttagctcattctaagcattcctcatgtcttggatttagatgccacttcctctaggaagcatttcttgaactcataaatctgggttagatgatcttctccatgctttccaaacatgatgtacttcccctgtcatggagtcatctcatgatgagttgtaaattgcagttgtctgtatgygccgttgggttgactgcaactctgagggtggtgcacgtgactctcttgtcatggaggtgtgtgagcctccatacagactgccacagagctccctcatttccagctgtggctgtagattggcataagaaaggtagccctgcaaatgaagctcagtgccagcaaggccaggccagcacctgcaagtagactgcatcagagtttaatgctagcataattgctttctggacattttgctacttgtggctctgtgtctgtggctgcagcaagagacatatgcctggttctttcagagggtggctttgtagtacagatgttgattggaacacaggatgccttgattgattttaccttctctcctttggcccagtctgctgccgttgggttgctaaagaacaatgagatatcagaaggatagagagaaaatagagaaagaaggataatctataatctacagactagtgagcaagcctttgaacagtcgaggccacctactcatgagtaaaattacattgtttaaccattctgtaatgtcttagatagtgagtctctggaatgccacagatactgtactataacctcgccctcattcaaaggtgatgtcttgacatttttgacgcaacaaagagatacaggtaaaacttgcattcttttaacagaaagtgtgtaaactgtatttgtgtgacttgtgtctaggcaaaatgcactgcatcctagatagaatattcatgtttgtatagtatcctttagtaactgtaccaggaacagtcaggtccttttatgtgaacgtattcagaatcccagttcagggattttctttataaaccctattgtggtaatgccttatatttgtatagaattttacaattagtcaagtatgtgtagatcttagtttgaccttccaacaactcttgaagtcggtggggcagggattgtcttcatttttacaaagagaaaatggcagagcagaaatcatatggttagtaaaggagggagtcaggacctgaactcaggtctcaaaatgccccatcctgtgttctttctgttatgccacatggctttatgttgaagctaatgtgtgtgcaagtatgtttcatgtatgtgggggacagttaatccaacctcctctaagatctgggccagttgagaaatagtyggatattgctcatcctgtcagttttattatagagaacgctcagttgaagaatgtggcctggacacatagctcgcatgggctttctgctcttttcctccctgaattgacctcacccacttactcccagatccagcagcaggacagcggcaggccccaccccacacagaggcagagccccactgtgttgcactgagtgcaggagaggagagagggggactccagccggcagccagagagagacaaagcggggtccaggccacacatgaggaatcgctccttgtctctcagggactagtgggtacgaggaagtgaaagtggcagaagtctctcctcaacacttctgagagcacagaagttgctgttctgtgggttttgtaggagagggttgggatggttcttgaattaattggcttagggagaaaaaactgtaagctccttgaatacagggatctctgtgtcttcacacattctgtcccctgatgtatatagcatagagctgagcatagatttgtgcccaacaaattcttgttgaccaaactgggatcttcactataacatagaagtagcaaagtatagatattgttagagttagcaagacccaatgtgtgaatgaatggtgattttatattttacccatgtgaagacacactggctggcaaccaagccatcctgaccataagaccacactctggcttttgcagggaactgtctgccccagtgactgctgtcttttcctctctgctcagagctcatttctcatatattctcttttgaacatattgaaacaacctttttaaacctcctttctccctttgtcttttttcccccatttcattgttcatccactgaaggaattttttttcctctttcttattctactccctgctacatctctcaaacactgtcctcccttcttcaaatgtctgtatcttaacttggtagataagtagaagaatagagctgatgatattctttctgcgtcaagagtaacgttacagttaatagagaatgaggtttttttaaagtcttaaagggcctggagacccatttagaaagttagcatatatttgcttttgtatcttttaattaagcttttgctgaagtaccagcattaagaataaaygtactttttattcaactttagttttaattaatagtataagtacagtactaacatacgccgccagttttcattgcacacaacatttccacaatgcacatcacgacaggcctttatgagccaacttatggacccaactgcagtttgtcattttgggggaaaatacgtagttttctgttttagaatagcctgtcttcttggtttgatgtgtacaaggagatttatatcctttgtcaagttccaaactaagctgggaatagagggcatttgtttgcttcatacgtatgatttatgacctttgatgtgtttgtcccacaggaaaagcttttgacatcacctatgtgcgtctcaagttccacaccagccgcccggagagctttgccatttacaagcgcacacgggaagacgggccctggattccttaccagtactacagtggttcctgygagaacacctactccaaggcaaaccgcggcttcatcaggacaggaggggacgagcagcaggccttgtgtactgatgaattcagtgacatttctcccctcactgggggcaaygtggccttttctaccctggaaggaaggcccagcgcctataactttgacaatagccctgtgctgcaggtaaattctcacaggttggcctgaagccagctagttctacaacatgcgaggtgtgggaagattattgtagtggggcttgtggtcccacttctgaggtacggggtcagagtagaatacttgagcaacacagacagagagctygattctgctctctgtgtactattaataagtgaaggaaagtagttttgttcctgctgcctggttgatgtttgttcttatgcacttgcagatctattctgggatgtaaactttacacattttttaaaaagtcaaacaattttaacgttagtctctgtacctgaggtggaaacattttccttctgaccttttgaagagaacatttgacctaattacccagatttcttggatcttttcttgcctattttttgatttgacaaaataaaatgtattttttaaaattagcaaaggggaaccgttgaagcaagatatttaagaatgccatcttctttcatttttacacaagaaaattttgattagrtttgtctggcacgattgctgatcattaaagaaactcctcatcacctaaaatggatgatgttagtaacaggatatggatgttagtaacaggatattaatttaggtacccatagcactgtacttaaacattgtgatagaaacmtttccctgtttgagaaggatttcttttttctcctgaattctacatscatattccttatacaccataatacrgaattcttctatgttgctcatatttctgtgaacttttcatatgtcctggctatttgattatggaaaagctggtgagcctcatgctgtactcagcactttaacacagaattggagatgctgctgcatgtggctgaagtcaacaaccacatggggatagcctttgtcagttgactgaaacaagaaagtctgataatgggttttcaaatgctgtgtacattatatgaaaagctattgtgatttctaaataggaaataccccatttttctagggtttctaatttggatcttcttattctttctcaccgttattatgttcagggactctctttctaattgtatggttttggacagtgacaaaagataagaatatatttttctgtgggttcagttgccccccttccattgtatttctgtaagttgctgggaaagcatgaatgtgaaagctgttggtaaactctgaggttatggtgagcaatgagtgtgcttgccaacaccttgcaaaaaagtgtttcttgcaatggagataagttgtgttcaaaataaatggccgagagaatagctgattttgatagatgaaaaagcagggccaggcgcagtggctcatgsctgtaataccagcactttgggaggcggaggcaggtggatcacttgaggtcaggcattcaaaacccacctggccaacatggtgaaaccctgtctctactaaaaatmcaaaaaaaaaaaaaaagttagttaagcatggtggcaggtgcctgtaatcccagctaccctggctgggaggctgaggcgggagaatcacttgaacccgggaggtggaggttgcagtgagcaaagatcatgccactgcactccagcctgggcaacagagtgagactccatctcaaaaaaaaaaaaaaaaaaaaaagaaagaaagaaaagaaaagaaaaagcagaagacygaatgcccagtggagaggtgacctacaaatactctttaagttgatcagctagcaaacatttgccagacttctttctttcctacagcaaattattgcwttttcctgtcctgatgaggcaacaatagaaagamcagagaaagaacagtgtagtcagtagaaartgcagygatacaaagttgtaactgtggttttctggcacctttgctaactgtacacccagtcagcctgtcttgagccatttccccaactgtaagaattgtgatgtttgttgctctttatgccgtagaaactagtgagactatatgaggtaatgagactgtgtggtaaaaatgctatgggttatgacctygcatttaaaaaaaaaaatgctgtgggcatctgcatagacgtggtcagtcagtttcattatgcagtaacatgagttacgtgtctctggatgtaagagctctgtctctgatayccagttgccaaggaggttgagctaatttgacttttagctgatctgacaatgagagagaactcttgcctctcttcctctcttcattgctycctaaacctccctgcagaagctgtaatctcccagatggggaaggagacccttyttggtttcaccatattataagtattactaagcatgtgttgatttatggtaataatttacatttattaaagcacttactatarcatactataatgtgacaagcastgttctaagccctttgattttctacctcagttaaccctcacagtaaccctgtaaggtagatacttttattgtctccattttacagatgaggaatcagaggcccagaaaggacataacttgccccaaatcacacagtttaagtggcagaactggaattcaaaacctgcagggtctagctccggggtctgttctttaaagatgcccattaggaaaaaaaaatggcttagctttttgagaagctcttattcaaagagagctgtgataaggtcgaagccttgtagaagatataataarcattaaacacagaaatatgtttagctatttacattacagaygactaaaagattcctactgttgtggccatgagtaggagttgttattggagttccaagtttggatatggtgaaatcgtcgtctcttttcctttctaattatacttgaaggctttgtggagattagcttttatgagctctccatgttgttctatatgccaggtatttggtgtggcttaaggcagtggttccaaatcagagctgtgcctcccagactcacctggagccttctgaaaacatagatgtctgcacctctgcacttgcttgttacgtctccaraggtgattttgttgtgcagtccctaggaaagacttaaaatggaaaygctstctttgagtggttatatgtaatacaccaccccaaaacctaatggttttagataactgtgatttatgatttctcatgattctgtgttagcctgggtcactcacctgacaggtcagctggggcctgggtctctgtctccctgtggtcttttatcatcaggaagcttgaccaggatttacaccacagcggaagtgatctgggagggtgagtccctgtgcacaagtacttgtcaagcctctgcttatgtcacatttgttgatgtaccctcggctgaaaccagtcacacacccaagcctagagtcagcagagaaagagactgcactggttgtgggccctagcagacatgattcactgggatcattagtatagcattctaccacacatgtaaacatctgcctaaaattagctcagtgtaagggcttagatctcataaaacctagggaaaaactctacagcccccatgcttgtcctctgccattatggtacacctaccaacttgataagttrtggtttcttcaaattcattcattcacttagcaaataatagttcgcatacctactgcatgctagggaaatggcagtggacaaaatagaaatttcctgccctcgtggtacttacagtgtggtgggaaggggaaggtgtgtgtggaaaaagacaatgtaaataaaatgagagtgggaaatagggagttgggtaggggtagcaatgttagataaggkggccagggaaggcctcagagagaaggtgatattgtggggagggtcaagacaaacacagacaacatcctattggttcaagcytaagtaatgatttattagcgagtacttgagcatctccctcagatctgtcagtaggggattgggttggcagggaggaatagatgctataaaatgggcaggggtggccaggcgtggtggctcacgcctgtaatcccagcactttgggaggccgaggcgggtgtatcacgaggtcaggagatcgagaccatcctggctaacacggtgaaaccctgtctctactaaaaatacaaaaaattagctgggcgtggtggcgggcgcctgtagtcccagctactcgggaggctgaggcaggagaatggcgtgaacccaagaggtggagcttgcagtgagctgagatcacgccactgcactccagccagggcgacagaacgagactccatctcaaaaaaaaagaaaaaaaaggacaggggcaggcaatgaccagcatctctgatccaaatgtggtgccccatgagctctaagctggtatcccttactggatttggggtccagatacaggatggagggaaggggcatgtgtatcgagtccctaatttatgctgcacattatattttatttaagcctctcagcagccttgcaaagaaattagttattatccttgtttttggagactccgagtagtaaagtaacaaattaaagaagggaagagtcaagaaggagaaaaatattagaaaattaaagaagtcattgagtattataatagatttagtgctaaagagggcrtaagttaaatgataataagttagtgatttagaacattttgtcacatttatatcattttcagtccctccacttctcttttatgtttctatttttgcttcctgacaggaatgggtaactgccactgacatcagagtaactcttaatcgcctgaacacttttggagatgaagtgtttaacgatcccaaagttctcaagtcctattattatgccatctctgattttgctgtaggtggcaggtaagtaaactattaaattagtcttgaaagtgtttggagcttttgcatagaggtgaatctagcaacttgtttayaaytatgttaataccgttgttagatgttttctttaccaagaataggagcggcagtccttcctgtgtgataatgcttagctgaaaagacagacagcagcctaggatattttcactgtgagatcttcttgttgttctggaaactaagcatgtaggttttccaaaaccttgtcaaatccacacayttagtgaattcttattgacaatttaagtgcaagggcactgtgaagcacttgaggaagggtaagactcaccttatcctacggagaagtcctgaccttctcggatcttacacatgaacagggtaggcaatgtatgaatatgtgaaaactgaaatacttgtaatcacctgtttttaaaaaatagataaagcagcagtagaaaagatgccacatatcaagaatgatccaaaactgccaggctagagaagcagatggcatctaagctgggtcttgaaagctttggataaggaaggagaggatgccttggttggatgcaagaggatggacatgttgtaagcagaagtttagagacgggagagtataaacccatttaactgaaggaaaatctcttaaatttgtagagttgtaaaccagaaagatagtttcgtggccagagaccttaaacagcaggtgaagaatcttggacttacctcccctgtgttagaccatgagatcccaaaagcagaaaacttatttttgtttacattgtttccggtatgggattggtgcttagtgaaagttgatgggaactgtacccaatgagaaatcaggcagaatttttggagtaggactctggtaagaaaacagtgggccaggaggattaatgtgcaaacagggtaaaaatagtrtacaattgagggaatttatattcctgttatgatgctggattaggcaacaaatacatgacattaagctggtggcagcagaatggaaaggaacatatagatgcattttattgtgaaggaaatgttaccaggacttcagtcaaaggtccttttatttagtgatcaggagaatggttggtaccattaacaaaataaagaagatgagctaaactgaagagtttggttatacatatgtaaaatttcaggtcatggkggacatcaaagtttgtgcagcagtcaaggataagagcttgagagaagatgagagctggagatctaaatttgggacttgtcctgccacactatcaatgattctgaagtattttagtgtatcagtgaatggtagttgaagctatgagactgattgctgtcattaaggaagcaagtgaggggaacattacgactccatggtgtacattagtattgatgggaatttccatgagtccttaatttgttatcatacttgcatctaggggatctttcagggattcttgctccagacaacctcaggggatattagtctgactaccaaacatccatatgggggtgaggtatctaatgtgtctcaccacctttaggtcggaatactttaaaatcattatggcagataattgctgatgttcatcaacttattttgtggttttgcaatcctgagcacataaataaagcactccttgatcttcccaataaccttatgaaataggcattgtcatcatccctgttttacaggcgaggcacagaggttaagttacaytggtaagtgacagggaagggtttcaaacccaggcagcctggcttcagagtccatgcttttctgaaccactatattctgctacctcttgacacacaggtttgacttcaggaattgatcctacagrtagcctcagaaattgttagggactttcttttcatayctggttaatccctacccctgttaagtaaagctaccttgtttaattttttttatccttaaaaattcagacatccattacttaatcttgctcagttccycagtttacacttttgaatggtaaaacttacttctttgtgtacatagtttttctgtgtgcatttctgggactttgcagctgttccattttttggagtatctcttctctccccagatgtaaatgtaatggacacgcaagcgartgtatgaagaaygaatttgataagctggtgtgtaattgcaaacataacacatatggagtagactgtgaaaagtgtcttcctttcttcaatgaccggccgtggaggagggcaactgcrgaaagtgccagtgaatgcctgcgtgagtgccccatgacgtcagtctgtcagttgtcttaaggacttccaagggtggaagaaggaaygggtgactttcttttattcctccttgaaaggaaagctctgaaaggccagctttttgtgtaatttgagtagtattcaagtcagaggaaagtcatagatgagggcaattcactgtaaaggcaaactgagggttttgtgtttccttcatgaacacatgtcccagagttggagcagcatctgcaaggtttagaaatttgtttggatccaaatactgggccagtgtagtctactccggaatatggtttctctagtcgtatttgttcccctttaaaatactattatttttatcaatgctcaggcatccaaggtaattaacatgtatcaaatataatgagttctaggctaagagggccattccaagattatttcttttttcttttctttttttttttttgagactgagtctcactctgtcagctaggctggagtgagtgatctcaactcactgcaacttccacctcctgggttcaagtgattgtcttgcctcagcctcctgagtagctgggattacaggtgyrtgccaccatgcccagctaacttttgtgtttttagtagagacggggtttcaccatgttggccaggctggtctcgaactcctgacctcaggtgatccacctgccttggcctcctaaagtgctgggattacaggtgggagccactgcgcctggccgcacaagattttttctcraaactattttttctttatctcactraagagtacaacggggagaattttcccactcccctgttggagaggtgggtagctttgggaagaagaataggtcctagtattcctagaaaaaggtaaaaatgaaaaaaaagtaaaatgaaaaaacttraaacattgtttatcccttcataatgtcatggtttattctgaacagatagagaaagaaatctcaggagaaaggaaccttttaatcatgattttaaagcagaaatacttttcttatgtccttacaaatattgtttatcatattctgttaagaataaagagaaaaagaagatactcttaacttgcagaaattattggcagaggctgggaacggtggctaacgcctgtaatctcagcatttgggaggcctatggggttggatcacctgaggtcaggagttcgagaccagcctggccaacatggtgaaaccccgtctctactaaaaatasaaaaattagccaggtgtggtggtgcacgcctgtaatcacagctactcacttgggaagctgaggcaggagaattgcttgaacctgggaggcggaggttgcagtgagtcaagattgcrccactgcactccarcctgggcaacagagtgagactccgtctcaaaaaacaaaaacaaacaaamaaattattggcagaaaccccgagaagggaccactatcttaactcackactgtttccactgaactgccgagaggagattttcttattcatcttttcaacaaatcctaagatttgcaagtaaaatttacagcctcctctaacatttgtaagcacttgcttgaccttctttaattccattactgaactgtaatattcagtgttggaagctctacaataaaggctggtacaagaatgaaatactcctaatatgtggcatctaaataaatggacatgtgtgcttgaaaagcattctgcttaataatgtcgtattttgagtctatccaggaagttacttaaagaaccaaacattgccaattcacctctagcaaatgaactgagtactgtagctaaaggactttgatgaggaactaagtcaatttgcttttctcgttggtcccttcagcactgtgacacttcaaagagtgacatttctggatgttgtgacaatactacattaattgtcaggatgctagggctagggaagagaactaccttctctcaaggagggagccatggcatttgctttagctgtaggttgggacagtgtggacagtggtgttattctgctttaccgtctcagaacatcagatcttcaggtgggttgggcttggtggattgagggataagctagggcrtcttgagggaagagaaatagctaatgaaggaaggaaaagggcactttaaaactaacttaacaaaactctaatttttggtggcaataactcaagtttctaaaaaagttttcagttgtaatactgtactrtgaaataactgatcataagaaagagagaaaaagaacaaaaggggctgagtatggtggctcacacttgcagtyccagcacttgggaggccaaggtgggagactcatttgggaccaacctgggcaatatagtgaaaccctgtctctgcaaaaataaaaaataaaataattagcaaggcatggtggcatgtgcctgtactcccagctacgtggcaggatgaggcagaaggatcacttgagcctgggagtttgagaccagtctgagcaacagagcaagaccttgtctctgcaaaaaattttttaaaaattagctgagtatagtggcacacacctgtagtcccagctacttgggaggctaaggcaggaggaggatcacgtgagctcaggaatttgaggctgcaatgagttatggtgacaccactgcactcmagagtgagaccctgtctccaaaaaacaaacaaatcaaaatgtgttcatgattttggttagaagaagtctgcattaaaaaagaaaaatatattccaaaaaagatgtattcgaatattttttttaaacaacatcctgttcgatttgaaaccaaataaaacttctttttatttactcttcaagatactgtctacattttgggaagaatcaataactcagaaaaaaatctttttattataaatatagtaaggaatttttgtgactacagatacttggtcttgaaatatggttgtgccctgcagggaatatagctacttaacagatcacccatttggagttgaggcttccctgtacatggatgtttctggaggatctagatttctttttaattctgctttcatctgtcstggcactaattttgacccatatgtctcaagttaccccagtctagatatataaataatctggcactttggaagttagtgtcttaatgtatttgactcatctgaggcctaaaaagttaaggtaaattgaagcctgcatataaaatggcactttgtttttggagttgatactagaataaaggctaaagattcaggagaattataatttgacttgacttttacttgtatatgaacaattacctggaggcagattattttctaagtacgagaattccttgtatcttacgatggtgctgttttttagagggaggaacatttctttatcatctggctgtatataccctttattgacatcctgttgggttttgttggtggtggttttttgtttgtttgtttttgagacagagttttagctcttgtcgcccaggctggtgcccagtggcrtgatctcagctcactgcaacctccgcctctcaggctcaagcgattctcttgcctcagcctaccaagtggctgggattacaggcatctgctaccacacccggctaattttttgtatttttagtagagatggggtttcaccgtgttggccaggctggtctcaaactcatgacctcaggtgatctgcctgcctcagccttccaaagtgctgggattataggcatgagccactgcacctgaccttcttgttgttgttaatgaacagtgcatctggtaatcattctyagtctaccaccatctgtctgtctcagagatgtgggaaattatgtttggttttaagtcttaaaatgctcttcttaaaggtacccagatctgatgtaactcgtgtgttttgactgacagcctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggtaagtgacaggaagatggattgaaagacaaaatgatagttccgtggacccccggaaaggaaagctttgtttccaaggcatttggacaactaaatgtggagatgtatacattattgtaacacagaaatcagtcaagatctgtctctaccccatgcctccaccttttttaaccaagttgaactttcagatgagtttctggtgtgtaagaggggggtggtggcctgagtaatggttctgcaaataattagcagcaggatcatagagacaatttgaactttgactgtaaaaggttaactgctttgtgagttcttccttgttgatgattttgtttagtctaatctccttagagtgctgaaatattcttagcatgtttgygtgtgtacagagatgcacagcattcttagtctagcccattcttcaagagtttaacctttatatttgtcatttaggcctatatatacttaaattctagacatgggccttaaggggctgtgatcacccacagagaagtaactgatcttgtgtgcagtgtttcattgggtacaaagtgattttcaacattgatgagtaaattcatcttagcatgtgtctagaaacttaaaatgccatgacttaaagggtcatgattttgagaaagttctgatttaaaatttggtttttattacctttgtgaccatcaggagattgcatactggttctcaggcattgcttttaattaccagttatctttctttaacacattgattttacttrmgtatctggccgaatttttgtttgacaataggcatyttacattttaggctctctaagcacacagtgtgatagttayggmagatgcagctgtaagccaggagtgatgggggacaaatgtgaccgttgccagcctggattccattctctcactgaagcaggatgcaggtaaaatattttcaaagccagaagaagggggcagaatctatatatagtcaacacatattaatagatcttatggcttattggcagcagggtaaacatttttcctgtaataattgtcaacaagactgaggactagctgtaatggtgagccacaaggggtttggcttgtacagagagtaagcagagttttaatgggatgactatcttaaactgaaaccaaatataaaaatgactttaggctcacacctgtaatcccaacactttgggaggccaaggtggctggatcacgaggtcaggagatcaagaccatggtgaaaccccgtctatactaaaaatacaaaaaaawttagccaggcgtggtggcgggcagcagtagtcccagctactcgggaggctgaggcaggagaatggcgtgaacctgggaggyggagcttgcagtgrgccgagatcgcgccactgcactccagcgtgggtgacagagcgagactctgtctcaaaaaaaaaaaaaatgactttagggtccattttgttctaygtgtatttcttttaaaaaartctgttggctgggcgcctgtggctcacgcctgtaatcccagcactttgggaagccgaggcaggcggatcacaaggtcaagagatcaagaccatcctggccaacattttgaaaccctgtctctactaaaaatacaaaaattagctgggtgtggtggcgtgcgcctgtagtcccagctactcaggaggctgaggcaggagaatctcttgaaccctggaggcggaggttgcagtgagctgagatggygccactgcactccatcctgggcgacagtgtgagactctgtctcaaaaaaaaaaaaatctgttaacatgtaaaacaaagggctgacttgaagagtggaagttttctcccttctctgattgttttatccrtttttcattgaataggccatgctcttgtgatccctctggcagcatagatgaatgtaatrttgaaacaggaagatgtgtttgcaaagacaatgtcgaaggcttcaattgtgaaaggtagtgcattctttctctagctgcattgtgttttctgttaccatatttcaagtaaaaaaaaagtaactgattgtgtcttaatctttttcagatgcaaacctggattttttaatctggaatcatctaatcctcggggttgcacaccctgcttctgctttgggcattcttctgtctgtacaaacgctgttggctacagtgtttattctatctcctctacctttcagattggtaatttagacctcatcccccaacctgttagaactgtgagattacacttaaaatatttttaaaaataaaatcagtgactctttgagggctttttgatggttggcaacactttgtattatttagcatgcatagtttttgtagtttggcctttyaatttaatgaaaatgtacttttggctttagaatttatctcaatgaatagtgattacaaatgttatataaatagtaataaagtaaaatatagtttgagtggtatagcatatattggtactgttgtaggatccatttattcaaaaaggtttattgatgcctttctgtatacaaggtgtggtcttacacatttttatgatacatagaggacctgaattcaggatgtttacagtgtaaagtgcttgtgttttccttctctacctgcagatgaggatgggtggcgtgcggaacagagagatggctctgaagcatctctcgagtggtcctctgagaggcaagatatcgccgtgatctcagacagctactttcctcggtacttcattgctcctggtaagtaaggctagaaagcagtctgacctgctgtgtgcctctgtttagtctcagtctcacattcttgcccaccattgtgtctgtattccagcaaagttcttgggcaagcaggtgttgagttatggtcagaacctctccttctcctttcgagtggacaggcgagatactcgcctctctgcmgaagaccttgtgcttgagggagctggcttaagagtatctgtacccttgatcgctcagggcaattcctatccaagtgagaccactgtgaagtatgtcttcaggtaagatagccttctttgtaaagtgagacttgacgaacattgtgaaagtggtgtctttatttaagtttaactggcctctagatgtattttaaagaaaaacttctgggttattgtggtgattttgtaaaagggagccttcctttctttacctttatcttttccaattgtactaccaaaccaatagtcttattttttatttgatttgattgttagagcattgcattgttggggcataaatgaataagaaatatttccccaacatccagaattgtccttacagaggttaatgtggccctttctttctctccaggctccatgaagcaacagattacccttggaggcctgctcttaccccttttgaatttcagaagctcctaaacaacttgacctctatcaagatacgtgggacatacagtgagagaagtaagttatgatataatttaggagagttgtttaaaaagatgattggttagaaagattcatgataatgcaaaagtttctctttcctaataatataacactgagaagtgtataacaactcacattatacatgaattatatataaagacaatgcattttttaacggctttcaaggacctggaaaaaatttggtaaaattagtaaatwgtattatttactaattgattactcaattgatcagtaggtcaattgaggttacattgtatataaatagattttctaaaaaacctaattataggctaggcgcagttgcttacacctgtaatcctagcactttgggaggctgaggcgagcagatcacttgaggccaggagtttgagaccagcctggccaacatggtgraaccccgtctctattaaaaatacaaaaattagccaggtggggtggcaaaagcctgtaatcccagctacttgggtggctgagggatgagattcgcttaaacccgggaggcagtggttgcagtgagctgagctcatgccactgcattccagcctgggcgacagaatgagaatctgtctcagaaaaaaaaaaaaaatctgattataattctactggctcaagttgcctcatcttcatttctttttatttactgttgtgtaattataatttataatttgagccattggttaaattattaaaagtcataaattattgaatgattttgttataattttwggtgaacaagagtttaagacttaaaaatttttttttttgagacggagtcttgctctgtcacccaggctgtggtgcaatagcatgatcttggctcactgcaacctccgcctcctggttcaagcgattctcctgctcagcctcccaagtagctgggattaccggcacgccccaccacacccagctaatttttgtatttttagtagagatggggttttaccatattggccaggctgatctcaaactcctgacctcaggtgatccccctgcctcggcctcccaaagtgctgggattacaggcatgagcccctgcacccggycaaaattttttttcttaaaaaaaagttttaaacaaggacctttttctctagcaaggtacagctgtttggggaggtggagttagtgatgatgtggtattgggagaggcatctgcagcttagatgtgttgatttttgaaatgcctgcatgaatatccagataaaaatggcttataagtagttagaaatatgaatctggggcttaggaagagattaggactagcgatccagatttagaaggttgtcaacatatgggcaataatttttaaacttggaaatatgacagaaaatatagatggraaagaaggatggaatcctggaaacagttaagtccatgctctaagacccaagggcaacatggcgaaaccacatctctactaaaaagtacaaaaattagcacagtatggtggtgcatgcctgtagtcccagcttctctggaggctgaggtgagaggatcacgtgcactcaggaggtcaaggctgcagtgagtggtaattgtgccactccactccagcctggacaatgagtgtgaccctgtctgaaaaaaaagtaaaataaataaataagagccaagggagaaaaagaattttaagaaagagaaacaattaacaagtttaggaagctagcatcgttgggttttggattggtgattccttaatcrctgctgagtttttgtttttaagaagtgttaaaactgtccaggcgtggtaactcatgcctgtaattccagtactttgggaggctgaggcaggaggattgcttgaggctaggtgttcaagagcagcctgggcaacatagcaagattctgtctctataaatcaaaaaaattagctgggcatggtggcacacacctgtggtcctagctacctcggaggctgagggcaggaggatgcatgaacccaagaggtcaagctcgcagtgagctgtgatcatgccgttgcacaccagcctgagtttacagagtggatctatctcaaaaaaaaaaaaaaaaaaaaaaagrtggcggggtggtgttgaaactgaaagatcacagtgctttaagaagtaatttgaagttgagtaagtaaaataaagaatgttcagttaagaagtttggctataaggaaaagacatggactataatttgggagtaggaacaagattgaagaaagtatttttagaatggggagacttaaggatgtttagaattggaagcacagtaaccaataaagccatatctcatgacctaactaggcaagataaacctgtaaacatactaaaagtagtacatttagggtagtaatggaggtgtccttcagccttaggtggttaattttcaaatgaattttataaacagcaagtgctatttcataacatgaaaaatacgctttaagcataagactgcaaaacactagagtggaatggagattacagggaaatatgatgatgttactgaggcctatacctctctgataaaatgttcctgttgatgcttgtatcaggggcaccactggattggatgaaccattggtctaaggcaatataaggtttcctctgatttcttatagaaatggaaaagcattgagctttggagtaattgtatacttgtcagaagtaaccctgagtattagaactttacttgagagtttttgttttttgttttttggggggttttttggctgttttacagagggcagaaattatrtaacctgagtattacctgttgacaggtgctttcccttctgtcttayccttgaactctgtagtgcctgcttttgtagcaaaagaatgaaaacactccttaatggctgtagacataaactcttcttttccccccacactcttgttcatatctcttctcactccaaatgattgtctgatgcttttcatttttcacattggtggggactgtaaaattcagcaaatctaggggtacatgtgtgtgttttaaaaaaaatwagtttgggccgggcatggtggctcaagcctgtaatcccagcactttgggaggccaaggtgggctgatcacctaaggtcaggagttcgagaccagcctggccaacatggtgaaaccctgtctcttctaawaaaaaaaaatacaaaaattagccgggcatggtggcatgcgcctgtaatcccagctgcttgggaggctgagacaggagaattgcttgaacccaggaggcggagrttgcagtgagtcgagattgcaccactgcactccagcctgggagacggagtgagactccatctcaataaataaatatatatataaacaaacaaataaattaataaataaaataaaagtttgctataccaccactccagatacttagcactcagtaccacatgattgttctaaatgctgttttctaattctcttctccagggtgtagacgtggatatctcgtttagtgtatcagagcccagttaagcaaatggctrattttctctggaatttggggtctagttactttttagtgttactgactttacacaaggtttggaaaacaagccagttcagtgattttcttttcctcactatacacaggtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcragacctgtgatcctgagacaggtgagatgatctttggcagctcttagacctaacttctctttagcaattgtgtagaaagtgctcattgtcttatatactygtacatttgcctgttttctcacrcctgccttccaaataggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagtctgctcrcttcatctgctttcagtgttcccttctataaaaagacctaggggaaaggggcttcggagttgttttggatctttgtgtttggttcagtttcagtggttatggttttcctaataggaagctgaggctcactctccttgtttccttccatctctcttttgggtatcccctgattgtctccatctgtcaaccaagggctttcatgtcaccttgatctaccgtctcccctttaggtgatcaaatctcatcttgaggcttcaaaagcctttctatatctatgatagctaagtttgtatttccagccctggcacctctcctgagctacctacttgccatttccacttggatggtgggctagaagccttccacttgcctttccacatccctgttcacctttctscaccctgactgagacctgcatgcactacatcaaatgtcaggctccatttgcattcagacagcagaaagcacatatgggagctcacagagaaggaggagggtgaggacagagtatttatcccatrgccccttctctatggggttctctggatcgatgacctcaaatcygtcattgatgagccaaatcagctcctggkaggccttctccaaacagctctttttgcctttaggttctgctagctgccccacccaccacctgaggcccagggtatggagcctatctcaagtgctgcactcttctcgcagtttccttacactccgtgctgatttgattgtgtcagccattttctgctgtgattttgattcacatagccaaaggaactcaaatttaaacaaatccaagttaaatatttgatttcctccctttttcttcgaccctttrtttctcctccagtcttgttcatcttagtaaatatgctgccattagcctagttgctcaagctgaaaccttagggcctatacttgattcatcttcctttcaagtcctagaaacagtcagcaaatcttactgatgttatctcagatctgaccacttttcaccacttcaastatcaccaacctggttcaaacctctgttatctctcacctgggattgcctaattgttctccctgcctcacctgctcccctacaatggmtccaatctyaacatgaaagccaaaatggtcctttcaaaatgtacctcagattacaccacttttaaaccctccaatagcttcttgatacactaaaaccaaatcctttactctgacctccatgcttctacatgggtttgaactgcttccatggcttatcttgtttttctgaaactttcttcccttggatattatcctggctggtctcttctctgtctttccattgctatcccaatgtctccttcttacagaggctttccctacccaccaatataaagtagccctcaccttcaccccatcatgctgctctattttgtttaaattttttatgcttatccctatctgaagtaatcttgtttatttgtatgtctgtgtattggtcttcaccaaccgctgcatacacttcatgagagcagagaccttgtccaccttgttcacatcatcctaatgacctagaacagtgctggtatatagtagatgctcagaaaatacttgttgaatgaattaataaacctcggattcccagaaatttgagtctaattcaggccctactggttacaaagatatcacgagcccaacttgaactaatcaaggtaggaaagtggaaaaggaaggatgaggagcagtgagtagtagagtggaaagagctctggattctagctctccctctctacctgtcacttctttggttgcaggcaaattacttatcctctctgttctctgagctataatatttaatacaagcagtcagcaactgatgatttytaagttctcttctaacatgccctgattctgtaccaattgatactgattaacaaggattagcacatgcctcttacattttaagagaatggttctgctcaccctgttgtgtgggaaacttacagtgtcaagagtggcacttcacctcttttaatatcatctgccaaaacaacatatatgaatgtgccatcctttgagactggagaagtttataaaccttgggcttgactcatttaccgagcacttttaatacatgatttgggttgattgtcacaacaattaaagtgaagtaggcagaccaggtgcttcctgtctagtgaggaaatagagatgtgctcaaggtcactctggtggtctggccccgtgccagggctgcagcccaggtcctctgccctccactgcaccatgtcttctctcatgtgatgattacactagattacctgtagccagtggtaatctagcaccaaaaatgtctaaggcctttctttcataacatcagattgtctcatccccaggtaagagatgtgagctctgtgatgatggctactttggagaccccctgggtagaaacggccctgtgagactttgccgcctgtgccagtgcagtgacaacatcgatcccaaygcagttggaaattgcaatcgcttgacgggagaatgyctgaagtgcatctataacactgctggcttctattgtgaccggtgcaaagacggattttttggaaatcccctggctcccaatccagcagacaaatgcaaaggtaatcagcctttgatcagattctgtcacagctaaatgcccctttattgtgagaattcttgtgtgtctcttaaaatatgtatagttgtttagtccaatagaaatacattgtgaaccgcttttgtcttttaaaattttctagtcaccacattaaaaaagtataaagaaggacagtcatggyggctgacacctgtggtccygtaaaaagaaacaggtgaaatgaatactaatgtattttatttaatatatccaacatatgatttcaataagtaatcaataaaaattgttaatgaaatatatgttytttctcaygctaagccttcaaaatccagtgtgtatctcacgtttatagcacatctcaattcagactcaccagccacatttaaagtgctcagtagccacatgtgacagcagctaccaacctggcaacacaggtctaaagaatctctttaggttgtttatattttagtatttctctcaggtgatttgtgtcttttgccatctctgtcttcctgccttagcctgcaattgcaatcygtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgagacataggtgcctttggtgaaartaatctttgctttttctgttataaaaaatgaatttttataagtacatttaataattgactgttcagaaattactggagcgcctaatgtargcaaggcatccttcaggggcagtgctggagaattgtaataaagctaatgaaagaaaggagtggagcacagtggccccagctgtgccagaatcacctgagcaaccttttaaaagcacaaattgccgggtcctttctgaggcacttagaatcagacccttcagggttgcagcctgggaacttctgttttcaaagctgctacttagtgtccatacagtcccaggytggagagcactggtagcagttaarttaggaaaagaggttctgaatagcactcatgaaaattacttgaaccttaggggcttaataacccttaacattccatcttagtaacccttaccattcagttttctgatacaagttacaaattacatcagtgctatactaaaaaaaaaaaaaagttgtgcttaaagtctgtttttcttgcctgagaartgtcctgtgttcattttcaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaacgtaaggggtgttggtggcatacaactctaagcttccactaattccagttagtgtcttaaggccagaaaggactttgacarcctcagtctagccacttgactcatagtcagggctgtacctaagtcatcgtagatgctttatttgaagaatattatccatttctaaaactctgcagatcaaagccttctctggtttcttygtatgttttcttttacaacgtttctgatgcttcctttttccaatcttttattttttccaaggaagtcttcctttgattactgagctttcccactgtggttcatgaaacttctttattgattgcattcttagtgcagataatgaaatagtggaggattctgttcacaacrtgtttgttgacttgctgtagttgcttcccacccttggggcccttttggtatgattacgtgtaaacatctgcttctccttggcataaacacttgcctggaattgggcctcagaacagattggcttttgctttctgaattccttcatttctcctgtggaatgtagcataagtaattgactcagttcagagaacacagtgaataaacaaactataagataatgcaaaagaagcattagcatttgggttttctagttccttagagaaatattaaacagtggagaattgaaggtagagatgaatccttgaagtgcatgaaacgagcactgatagtttcataacttctctaattgctaagtaacctgaagtgtgtcccaaaggttgcacgttttactttaaagctcattttgacttttaaaaatgtcagttttctctgctaaacagacttagccatttaagatctcataaatagtcctgtttttcaaaaaaattataatgacagtatagtcagcttatagtcagcttattgttatcagtctgaattaagagatatactcttccttcttttgctaattaygtattattttctccttattctgcagcctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggtaagctgtcaatagtgcattcattcattcatccagcagacgytgagtggcaacttactgtgcactaatctctatagaaaaagtggtgaacaagrtagatgtggtccctgttcttaaagacttatgttycagttgggaggcaaataataaaaaayaaataaataaacaaaacaaacactgagataagtgccaggaagaatacaaatggagaataactgggggaaactactttatrtaaggcctctctacagaattcatctaaggtgagatctgatggatacaaaggaatgagccgagtgaaaagtaatggtaggtttgttccaggcagaaggaacctggtrtacagaggcctgaaagctggagagtggctggagcctgctgagtgcagagggtgtgttctgttttttaagackggagaggttggtacggrcaggttatatgggaacatgatgaccatagtaagaagtttagattttatcccaaatccaataagaatgcattgaagaaactcttaaaatctgggaaatccagattatattttaagaggagcactcttgactgatgtgtgaagaatgatggttaggaatggggcttaatgggaagcctcaattggattggataaatatgcgtgtttggggacaggataggaaaagagaagaataaggatgtgtcttgggttttttgcttaaggtagctggaggccttatttactgagatggagattcctcagagagaatagaggtaagaggtataattttggatgttaagtttgagatacctatcagagagctgagtggaggtatcacgaaggtaatctgacactcaagggagaggtcagagctgaagtctcatcagcatrcagtctttaaagtcaaaggaatggctctgaaggttttttttgaagctggaaaaataaactagccacgtcttctcttcagaagtagacatgcatggagtggatagaactacatattcatgcagcacaccaacatggcacatgtatacatatgtaacaaacctgcatgttgtgcacatgtatcctaaaacttaaagtataataataattwwaaaaaaaaaagaactacatattcatggagtgcccatgattcctgcaggaagtgtgattgagttcttcaggaatacttgtgtgtcctacctttcccttttctttcttctttatgtttaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaaggtacgcatgattgaacagtrcatgacttctgtgagatggaccaatctttagatgtggctcctaaagcaaggttattagtatagttttataaaattctttctcagtttttaaactactcrtagattataaatcatttcattttttaaacactaattcaaaaagcaacctgacaaatttactgctttaagctacagtaagcatagggtgattttccaacaaataaaaaactattcgatattcaaatttcaagcattttatgaatctgttctattacaaggtgtcttaaaatattaaaatagttttaaaaatcattaaaggcatgcgttttcataagctttttttttttttttttgagccacagtcactctgttgcccaggctggagtgcagtgacgcgatcttggctcactgcaacctccacctcctgggttcaagtgattctcctgcctcagcctcccaagtacctgggactacaggcacatgcccaccatgcccaggyaatttttttgtattttgagtagagatggcagttcaccgtgttagccaggatggtctcgatctcctgacctcgtgatttgcccacctcagcctcccaaagtgctgggattacaggcttgagccactgcgcccagccaaaaaatttttacattatcaaataattgagtaaccttccaagcaggaccaccatatatagttaggcaagagtttgtagaatgtcacctctgcacatacatttggtagccaagttccaagttggttttttccaaacctgtattcatcttcattggtcttacctttgacttctcatcttttttttttttcccacattccttagaaaatttagaccccaacaccgagcatgatgctgaaatatgaattggtcaatttacttaatggtttttatatattaataaaacctcatgatacatgagagttttaataataacagacttatatttatcttttgatttgttaggacctgagtatgagatttaagttgaatgagcataytaataaagaataatttgaagaactattcaaaaacagagatcagtttgaaagaaattacactgataatgctggcacatgggggtggcaaaagagtctatttagtttaaaatacaaaatgagtttaatttgtcatacttcaacttatgttttaaacctagttttttctgggttttgaaaaatgttcggcttttagggctggcagcatttttaacaacattgtagatttatgactaaattgcatgtgctggtattaaagtcagtcattctcaccttcattaaacattccttgggtgtcttctctttgccaaccactgcataagaccagcgatatagtggtgagtaagaaagagttcgtagtcaagtggacagatggacgcacggttggaggtgtgatgagtgcacagtgaaggacctactgggtgtggtaaaggctgtccagctatggcaggggctttgtggaaacctggcagaaagttgcgaygtttagaagagtagagatacatagggcctcagatttcatgtgagatgatatgatcctcttcagataatttacagactttcttctgcaaaccattttagatgttgaccagaatttgatggatcgcctacagagagtgaataacactctgtccagccaaattagccgtttacagaatatccrgaataccattgaagagactggaaacttggctgaacaagcgcgtgcccatgtagagaacacagagcggttgattgaaatcgcatccagagaacttgagaaagcaaaagtcgctgctgccaatgtggtaagtgattgcaaacrtctgaggtggggatgggggaggcccctggggtttgtagcaagtctgttactggcagtggagtgcttcttcaactaaattgactccatgcatctttttatttgtccctaaatatggggcaraaaagccacattgctcatagttggcatgaaacagttattaaaaactggataaaaaccaagggacatctgggttatttctctagctttgttccttctatggaactaggcagtttaatcttcctttatcctttactgaaaatagaatctgcaatcaagggtgctgatattaaataaagatctctgaaaataagaagaggtattcttggggccaggcgcggtggctcacgcctgtaatcccagcactttgggaggccgaggcgggtggatcacctgaggtcgagagttcgagaccagcttgaccaacatggagaaaccccgtctctactaaaaatacaaaattagccgggtatggtggtgcatgcctgtaawcccggctacttgggaggctaaggcaggagaaccacntgaacccaggaagcagaggttgcggtgaactgaaattgtgccattgcccttctgcctgggcaacaagagtgaaactatctcaaaaaaaaaaaaaaaaaaaaaaggtagaggcattctttttgccctctaacaaaaatttagttttgactcttgctttattaaatgtaaataattcagtcctttgagaataagtgctttatttcctgtgcagtcagtcactcagccagaatctacaggggacccaaacaacatgactcttttggcagaagaggctcgaaagcttgctgaacggtaacttctagatccctgtttaatggttaagttgtggcttccgttatggkgtgtgtgtgtgtgtgtgtgtgtgtgtgtgtgtgtgtgtgtgtgtgtggtcttatcccataacccataaacactttctacataacccacttttgcacactttgctctcttttctaagatattatcagctgtgtatactcttttcttccttttactttgacattagaatattcactttgaatattagaatacaatggtttgaagacaaatcatatttatatttctcaaaaccataatatttttagatttttaacttatttaagactgtagtaactgaatgaaactagcagattgttgttaataaagattaggcgtgggatttgtttttaactagataaatgatttcttgctggcatacacaattttatatgtacattactctcaaataattaaatttaaaagtagtttttctgaagaattataaacattttctcttataaatgtataccaataatttttttggaaaatattctcatctcagttttagartgctattcataaattcagccccactgaaatgatcacaaaattccaaatgaatgacgttttctaatatttgtagaattgttgcccatgttagtatatgtacatataataaagtaggccgggagcagtggctcatgcctgtaatcccagcactttgggaggccaaggcgggtggatcacctaaggtcaggagtttgagaccagcctggccaacatggcgaaacccatctctactaaagatgcattagctgggcatggtgtgtatgygtgtaataccagctactcaggagactgaggtaggagaattgcttgaaccgggaggcggaggttgcaataagccaagatcacgccactgcacaccagcctgggtgacagagcgagactccatttcaaataataataataatamtaataakaataaagtaagcattacctraattttacttatgtccctatcagatggttgtttcatggcttattttttgttttatctgtatagtcataaacaggaagctgatgacattgttcgagtggcaaagacagccaatgatacgtcaactgaggcatacaacctgcttctgaggacactggcaggagaaaatcaaacagcatttgagattgaagagcttaataggaagtgagtataatttgaaagtggtttacaccccttcaggtgttctggtaagtaacactagttcaatgaaaaattaaatgctggtgcattcagggcatacattcatgcagtaagatttcctttgttaatcatgcttttgaaatggaaaagtaagtagagaagggcatgtgaagccacagagatttggtttgattcaattactgtaactacagagaatagtaacaagatgagccatgatacttaaaattgtgcacaaataaagaagaaaaaatataatagagtaagtagaggaaacataattgaactacaaatctttaaagggtgtctgaaataagaaagtatatggtaagccatacattatagaaaattttttcttttttttgttgtttttgtgagatgaagtctcactcttgtcccccaggctaaagtgcaatggcgcgatctcggctcactgcatcctcygcctcccgggttcaagcgattctcctgcctcggcctcctgagtagctgggattacaggtgcctgccaccacacccagctaatttttgtattttcagtasagwcggggtttcactatgttggccaggctggttttgaactcctgacctgaagtgatctgctcacctcagcctcccaaagtgctgggattacaggcgtgagccactgtgcccggccaagccatacattataaatagaaatgataaaagaaaatgtaaatatgcaaaatgttggtattaaaatgcaagcattttaatgtagcatttcctttgaggttttgggcgtattatcacatgatcatgttaatctggttaacattaagatgctaaaagcagctaagattgtcattaaaccacattatttgtgtcttaggtatgaacaagcgaagaacatctcacaggatctggaaaaacaagctgcccgagtacatgaggaggccaaaagggccggtgacaaagctgtgragatctatgccagcgtggctcagctgagccctttggactctgagacactggaggtatgggggcagcctgtacgcacagccccacccygtctctcccccaagtctatgtgagagccgactgctctgcacctccctctgtcctcccactgactcgctggtaaagttgagtcttatttcacatacgctaatagaacttaccaaggtagccagatgtggtggctcatgcctgtaatgccaaccctgggaggctgaggtgggaggattccttgaggccaggagttcaagaccagcctggtcaacatagtgagaccccatctcttaaaaaaacaaaaacaaaaacttaccaaggtaaagaatcctgtgattgtaaacattaaatagcaaagactactttaatgatatgaacaatcactcctaagtctttagtgcaaatccaaattataataatacatttgaattgcttaaagcagagtacatgtagacatttactcccaggctctgtctagtagagacctagagagaaataagagagaatggtttaattaaaagactatagcaggatgttctgaggcaggtaaaatattttggaattggtaggattttatttcatatctgtactcttaatcatggattctcactccaagctctgtataaatggtattttttttgcattaagcttgaggtttactaagtttcacttcttatatctgaggtgttgacttgatttttaccataaaggtttaggtctctttagatatgtacagattgtctgattctatatatttataattagaaaataggcagaattagtctatgatgataaaaatcagaacaatggcaggcacagtgttggaaaggtagagtagagatcgggtggaaagggagaaaagggagcttcttgggtgatggaaatctgtatyttgattggggtgttggttatgcagaaatgcatttgtcaaaactcatcaaactrtatgtggattctgtgaacttcagtgggtgtaaagtatatctcatttttwaaaaaagtccataaaatcttgatctgtgcagttcttttaaaaatatcattgagtattaggtgttacagagttcctaagcctaccttttcattagtttaaatgttttatccaaagtgtagtgatcttacttgcttttcacagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcaggttggtttgatttgcaggtcgcttcatttcttgaggcaacatttgaacagtccaaatgggtctgtgatratgccgtactttcagagacagcagaccccagtgctgagagagcagcctaacagattttatgctggsaagtctcagggtggcacctctggagagccttgtctgtccaggagacagaagggatttgctttgagggttcatcctctcatctgccatgtgtttgcagaccgcagaccaactcctagcccgagctgatgctgccaaggccctcgctgaagaagctgcaaagaagggacgggataccttacaagaagctaatgacattctcaacaacctgaaaggtagaaaaggctgagataacaggggcaaatgcttccgccactagagtgattttttttttaatcatgacttttaccatatttattacttcatccccaactccctactttttttatgctaaagtatttcaaagggaaatcccagagctcctgtcattttatccctgcatacttcagtatggatttttttttaaagatgttttcttattaggcaaactcacataaccaagatgcctayttagagaacttatataggtaaatgragattatctttcattttctctgccagtggcatctgattctttgttgttgtttttttttcttcaccccagatagaagagaaatgtgaccaattcactgagcaactgtgaattcttgtctgataaaacagtcataggttctataaatagagaagctttacaggatgctttacagggtactagttgaaaatatgggccaggcacggtggcctgtaatcccaacacttcgggaggaaggatcactggaggccaggagttgaasaccagttcctcactggggaatatagtgagaccccatctctataaaaaaaaawtttttttttaattagccgggcatgctggcacatacctgtagtcctagctacttgagaggctgaggtgggaggatcccttgrgcycaggaggtcamggctgcactaagcagtgattgtgccactgcattccagccagggtgacagagtgaaaccttgtctctcaaaaaaaaaaaaaaaaaaagtagtagttcaaaatatggactctggtgtcagtgggccttggttcaaaaccctgcaccctgcaccacaggtcatgtaacttctttaatcctcaattttcttataaaaatgatacagcctattttatgtcaaagacacaaagctcttaactcagtacccgacacacagtaaacactaaataaattgcagcttttaataatggttgaggtagtggtaatgggatgctcagcgctctgcattttaaagcacattgttgaagtaagaattctatttccagaaayggaacatttctataacactaactgggagacctattctgtagagatgtgtaatttctaaaatttcagcccatgctstcttccattttttaccctgacttccattgttcataaaacaaaatccagttggaactccctgaaaggccccctttttacttgttgggagtttagctcaaatgtrtccttgaacttgtttcagattttgataggcgygtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcragcgcwgtccaaaaggtgtgcgtttcctcttctccaagagtccctgcccatatctttctctggtyactttccagtttctttccagaccctcagagcccttgcagatttttttcctgaacttcagtaaaattgtcttaaaccatatttgtctttttttttttcttttgactaggcatgagagtaggtatccacattgaggaggggaactcagtaaaagsgtgctttactctaaaatttctactatgtctcagtgtgaggtctggcttcagaggtctatagagcccattcccacaaaaaatcagactttttctaaataaacattcttctttgacctagacaggtggtatttatttcaatactatgtagtgtgccttatcaatataactttcaagtccccctttcaagtatattgccatatgtaagccactcctaggagagacttcccatagctgccattgctaggattctttgaagtcatcttcaagaataatgttttttagtttggctttctcttatttcaaggtmaatctgtttgttttatttaaaagagagattggagcaattttagaattaggtatttaagaatcagasaaacctcttagtttccttagaacagttggcttttggattaattatattttataaaatactcatatttcaggattgtggtctttttgtacattatgatgaactgccaagaatgaaccaagctagctttgaatttaaattttacctcagcgaaagcatctaatcaatatgatgtcgtagaaagtgtatgccattaaatgtttatcatttgctgtctgtatgaccccaactaaaaatagcaataatagaacagaagtttccaggattaaagaagaggatacaaatgaaagtgctagataaaatacaaaatgttattatgtgggtagtaattttttttatgattatttataacccaaattgataatgtaagtcatgagatagtataaatcaatatattattatttctggattatatttttaagacattttataaattataaaaggarcgggagcatacttgagaaaaaggaaagcttttttaaaaaaagtacaattttcttttgtgcctagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcmgggatggtaagaggttttggtatatttgctcattggcagaaagtgaacagtgtttaataataaagatcccccacttgttgagaagagtcttttttatattgacttctgtttttcatcacattgtctcgtcaagaattgggttagtagcttacatagaagacaaagaatttggatcttctgccaggtaattttgttgcacaattgtcctgtcccaaagttactcagttaaaagtaaaacattgctttacacgtttgaggttttaggacattaaaagtatgtgtttatatttttcactgggtaattcataaatgttaataaaaaaggaatgcaatgaagttaattttcttcttattcttgttctcccagcacctttagagacaaagacaagtttcttgtatataagaaatttttgaagatggcattgtctaccaccccaccaaaacatatgaaacttacatctagtttaatttttcacgttttgtgataatktgtatgcaaggtactatttgtaacaaaattgacttgtcaatggatggcccaaggaagaactaaggtccatttttctgttctatgctatattttgctttgaaaagactttaatggagtcacagtaggaatattctttttccagttgggtgtagcaatcacggtaatgacatacacgaacttgtggttacttgctcactttcagtggcaaagaagaggccrtcgttcactgctgccagaaaacatagtccctcastgtgggtcattttcatcttgggatggaaaaaagaagtacaaagcctgttaatctcagtaaaaactctagggaagtgataaaggaaactatctctgtgcaaccacctaattttattatgctttttacaggtaggggggtggatgttggtttggattgtcctgattttctccgttatggtgtggctcaagtaaaaattcccataaaggtgtctgggcgcagtggttcactcctgtaatcccagcactttgagaggccgaggtgggtggatcgcctgtggtcaggaattcgagaccagcctggccaacatggtgaaacgctatctctactaaaaatacaaaaattagttgggcatggtggtgggtgcctgttaccccagctacataggaggctgaggcaggagaattgcttgaacttgggaggtggaggttgtaatgagccaagatcactccaccctgggccacagaggaagactccgtctcaaaaaaacaaaaattcccataaaaaaaatagatgtttctcacatgttgagcatatatggatttcatttttaatatgattgtagaaacattagatttaaagcatattgaaaaagaaaacagtatattctttaggagcttcaaaaaagggttttggtttagttcaaagggtgaaagaagatcttttattattttggtaaataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaagaggaggctggagaccacaggttaaatgcaggtgcatcgctcttggccggccctggcagggtcctttctccctccttttacackcgcagacaagcttgtggatgctcaataaggacagctgccgtttggacagagattaatcatttatttgtgaaggttttttctgccttgctttcttgttcttttttaaatcttcacattgttttgatcccaaaatgtttgtgttgtccttactcaaaactaggaaaaacaattatgtggtaagaggctcagagccacttacttaaatctcaactagatttatttgtgagaacatctgttttctgatatttagacacttcctcttccattgctgtttcctatgactcatgcacagttatttgttcaggtttcatggaatttcccaagtgtatttacctttgtttggtttttaaaatgtaaattatattgccccaataaatgagtatgtgtgtcagggggactgtggctgggtcattgcatgtggarggggagtttacagaagagaactcctagaagagctttacttaactatgaaaattttcaaagaataggacatttctaataagtccctaagagtgtcctgaaggacatgttttggttctgaaacatagtttctataatcrtccttaaaaaataacttgtttctgcttaataggctttactatgaatatacctccatatattattragttagaatgtgagaaaaggagattaatttttgaagtacaaatatagtgagttagtgagtgtaggcatcctgactgcctagtcataactttgatgaagtagaaataccaacatcctcaatatgaagatatgcagcagccccaccaaaaaaaaaaaaaaaaaaaagcaatgagaggtttcaatttcctaagttagaaaagggaagaaaatctggaaattagatttgttgggtcattgggaaaaaagatttaaagaagatgaaaacawacagtcaagactctttgcctcatttttcccttacaggcttcacaggctgctcaagaagccgagatcaatgccagaaaagccaaaaactctgttactagcctcctcagcattattaatgacctcttggagcagctgggtacgtagccatagagtcatttttgtcagtctctgaatcttttgtactgttcttaggatctgatatagtacagttgactcaaaagcagatgatataggtttacatgaatcccttttaagtcattaattaaattattaatatttccttttgctgttgcttatttttgaaagccttataaaataaatgtttgtcttgcatgacagggtctttaagagcaacttgcttctttaccatacttattatttgtcagctttacagtgtgacctgaatcatgactttaggctgtgttaatgtgacaagtacttactaggtgccttctgtggaccttgccctaagtagaacactgtggtctgaggagtttctttttatattttgaagatatattgccagctagggtagcatttatggtccagtatcattgtacaactaaacagtgatttttcttaactcatcttgctggcagtatctttaagggatttaaagtaaaggatttcaatagtagaataaaagaatagtagaatcacaggctgggtgtgatggctcacactggtaatcccagtactttaagaagccatgcaaggaggatagcttgaggccaggagtttgagaccagcctaggcaacatagcgagatctcacctcgtctcttcaaattattttaaaaattagctgggtgtggtgctacacgcctgtagtcctagctacccgggagactgaagcaggtgcatcacttgagtttgaggtgatagtgagctgttatcgtgccactgcactccaccctgggcaacagagcgaaaccctgtctcaatttaaaaaacgaaaaagaacacttaaaactggtcatgactttactgcctggaattctcttcatttgctaagtaaggacagtccgatgaggggaaagctttcatgccaaaagagagaaaaaccttgatttttcaaggaaatctatgcatacggaaaccttcttttaatccagtttgatagggtgttagggagcaggcttcattttaggacagatgcacttttgtcaccagactccattataaagtgtcaacactctagccaggactctttgtagcaaggcattatattttaatttgccagcctttaaagactggtgcattttgttttggtggggggctacaggggtattttttatcrgtctcaaatgtcaagaataagttatgtgccaacagatggatataaaatgaaagtaagctagaagagaaagctttttgtggaacagccagacttttaacattagtctgacttgggttagtatctttgctttgttgcctataggctgtgcaaacttgggcaaattatttaacatctgagaatcactgatgtaaaatggtcttgtgagactttaatcaagtcaagtatgcatgaaatgctgtctattgtgtctgcttttgtttgttatggaaacatctcatttctttcaaaagaacctctttttcttgctaagcttaaagtgaagacttgctgaaattatttcagcattttactcctggccattttccataggaaggctcctaatagtgtctaactcctgaaagcagaaagtgaccttcaaaactgacccatcttccctggaatctctctaagagctgagggattagggttcttagagatttgtgtatctttgatggcactaaaatgacatagagtttacatgtatacacctggaaaaggtattaaatgttatcagatggccctcaaaggtctagaacatggtagctgtgcattgaggaaacattctgcaaaaaccattgtctcagaaagaaacatccagctctatattaattgtatgctcagacccatccctgctgggttaggtcagcatttgtacttggtttgcatattttataccattgtgtgacatcaacaatctgcaagtcacatttgccgggctgcctgtgcagaatggcagctgctgggcctagagtctagtgcaggtacttgtgaagggatcattcttactgaatatgtctgttctcttctatgtactttctgaccctccagggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggytgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatswctgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttkgctactaacagtagcattgtgatggccagtatatccagtccatggataaagaaaatgcatctgcatctcctrcccctcttccttctaagcaaaaggaaataaacatcctgtgccaaaggtattggtcatttagaatgtcggtagccatccatcagtgcttttagytattatgagtgtaggacactgagccatccgtgggtcaggatgcaattatttataaaagtcyccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaarttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttytggcaattgttggagctggataggtaagttttataagggagtacattttgactgagcacttagggcatcaggaacagtgctacttactgrtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggygtgctgttgcaaagttttcacgtcatygtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccrgggtggttaataaaatgcaacacttggcatttttatgttttaagaaaaacagtattttatttataataaaatctgaatatttgtaaccctttatatttggtgtggcctgagtgtggtactggggacataagatgttttaaaaggtataatgaatgaaaagccatacataataccttctttgggtgacttattttcttgagaacaattcagtatacattttatatatatataaatatatatatgtatatatgtatatatgcctctctcaagttgggatactgcagtgtagtctggaagttggtgaactttttctataaagagctggatagtaaatgttttaggctttgcaggccatgcgcctatgggctgtagtttactggaaccccagtgtagcctcaatactcagtaacaactgacagtcaggcacagtggctcatgcctgtaatcccaacactttaggaggctgaggtgggctgatcccttaaggttaggagctcgagaccagcctgaccaacatggtaaaacccagtctctactaaaaatacaaaaataactgagcatggtggtgcgtacctgtaatcctagctactcaggaggctgaggcaggagaatagcttgaacccgagaggtggagtgcagtgagctgagatcatgccactgcactccagctgaggcaacaaagcaagactccgtctcaaaaaaaaaaaaaaaaactaagatttgttggacatcctaaattagcagatgtatgttaaaagttgtctgtctctcaatacacacgtgtctagcttaaggtagtttctttagatgatgagaagctcttaagcctatgatttaataaaaagtaagtaatgtgctgcactaacaggctagaatcgggtaattttactagaatttacctcactctttctggagggaggacccatctgaagtgacctgagaccaggtgaggcctttgggagctacagagacagcaggaaggctttgggcctgcaaaggccttccctttactctttgatgccctgtttattgccctgggcctccgtggatttcatgccaccttcccaatcttaggaattgttacaactatgatacctgtaaagaagaacctgaactactctcattagacttcctcggagaaagctttagagggcactaattactagtactattacagctttcttacatgccctgtttttaacctttattgaggaccatttcccctcatttgtaggactaattcagatgcagctatgtctcctttatcattactgtcagagtgataagtgagattttaaaattttgctcctattccatcagtcattttcaggacagcagtttctcaaaagttgctactagcataatctgattcagaatatccccagaggtttactccataaataaacatcctagccccttaatacacctgaactcatcagctccgcttccattaagctcaaaatggaatgcctgaagaagaccccaggcacccaggaaggtgaggaggtgggaaagcaggtggatacattcataagggaaggaaggacaggcccaaggaaagattagatctctccaggcacatagattatgaaaacagaaacaagagaattctaaatggcagataattttgtccacactaagcaggtttaaatgaataataataggtagagtaaaaaatacgaagctttttaggaagttatctgtccaaggttccactagggagctatgatcaactatatagtgccttgtatttgtattgagtctcctagaatgactgtatttgttctacattagtgaatgaattctaaataatagaagtcaaatgcatacttaagagaattatttttctttaaatccaatgaaaagccaaaagccccgactaggaattcaaacattagaaacatcaacatttcaaaacttatgacacctccatgtccttgccttaactcctctctctgccttgaatgtcctttctttcctctgcccagtacagtaaagcctaaggtcaaggtatcacctgtgttgggattggccagtccttcttgtgtccaccacttctcccacctttgctctgtcttctagaatggcccttggacacatctttatagttaggtgccactaatctttccctcccactttgctcccacccccaaagatcagggtctgtgttatttatgttatccttggggctaggagacatacactaggcactcaggttgtatgatagtgaaaaggtagcctttctccacctatgctcccatacttgttacttttttcctactgtgcacagacagggagtcttatggcagtttgttcacgcactgtctcaactcctaacagcgttctgctctctcaacattcccacctaagtgtggattggcctcttgtttgcaggaagataagcaaagccacagtcttgcattatatggcacagcacacaccacatacactgccatgtggtcagcaactggctagtgcaatctggtctgcaaggcccattgccctggctcccagcctcagacccaccattcccaatgcaggttttccatacagttcctcctgcagcccagcattaatttcctttttctctaattcctggaaatcatcccagtaaatttcaatcaaccaattaatttggtgttttatcctgtttgcatgtgcactttagcaagcctygtaattaatactggccatgaagttattatttatgattaactcagtatagtttgcttatttctataaaaagtcaagcatcaggcacttgatcaagaatgtgaccttctattacactattgtccccatgagtaagtccaactcaatttaagtgatcctccatgaaacgtgcctggtttgaagacaacccttccatcttcccatcattcttttcaccttggctactaacaaaaaaaaatcacttgaacttcagaccgatgcttttcaggcccatcccatggtatctgccctaatacagagatcctttgtcatctagtaactaaatgcagccatcaaattttgtccatgttacttttgttaatgttaagaatttctaatccaattcctttctgaatattcagtgccttctaggacattctgtcctaattttccttacacttctctgttgatccccaccactttttccatggacatttctttcctcctgaccatggtctctgtgttggggttactgcagagtaagcacaaatcagccatgagcagaaatgtctgggagatatgctgtcctagtgtggattataaattcctcggttgctgagctagcgtccagaataaaggctcaggaggcacagctgttatttcaatgattatatgtttggcgtggtcagagaggtttgtgttacaacttgctgatcgtttgtggctcagacagtctgctctcagagctgtctcacttgggctgatacaggagatcagacctggccggagagagttttgcctcattgatttcagataggctgccttctaagtttctgaaggacttaggaaggactggcattatcaagatagcttgtatgttttaaggcactttcgtgattattttctttcatttctccctcatttgaagagagtcttcatttggccaagggggaaactcaaagcatggtttgctattccaccacctttaccactgttttagcacgttgccttattctctctcatgatttggatcaattttccttttatgaaggaaatatacttgtattttattataagctgcctcaaatctcttttttggagagagtgaggcaggatttaaatatatcagcaacttacccaatattaaggaaccacttagtggcagaattattacgtggaacctgattgtcctcaagcagcctgggccacacacaccatacagctcatgcacctctcctgctcacacaccacacagctcacacccctgtcctcctcacacaccacacagcccacacccctctcctcacaccacacagctcacacccctctcctcacacaccacacagctcacacccctctcctcctcacaccacacagctcacacccctctcctcctcacaccacagagcccacacccctcttcctcacacaccacacagctcacacccctctcctcacacaccacacagctcacatccctctcctcacacaccacacagcccacacccctgtcctcctcacacaccacacagcccacacccctcctcacacaccacacagctcacacccctctcctgctcacacaccacacagcccacacccctctcctcctcacacaccacacagctcacacccctctcctcacacaccacacagcccacacccctctcctcacacaccagacagctcacacccctctcctcctcacacaccacacagctcacacccctctcctcctcacacaccacacagctcacacccctctcctgctcacacaccacacagctcacaccccacccctctcctgctcacacaccacacagctcacacccctctcctcacacaccacacagcccacacccctctcctcacacaccagacagctcacacccctcctcctcacacaccacacagcccacacccctctcctcctcacacaccagacagctcacacccctctcctcctcacacaccacacagctcacacccctctcctcacacaccacacagctcacacccctctcctcacacaccacacagttcacacccctctcctcacacaccacacagctcacacccctctcctcctcacacaccacacagctcacacccctctcccgctgcccttgtttctccctctctttccctttccctacttaggctcaaggataaggcacctaaggctagttcacctagataattttgcttaataagggaattcacctagattttaaccctctttggaatatttttacaccattttcatttccctattctttttgctttttaataactttactcagtttttgtaattttcttctttcaaataagtcccattatcacagcattttataaatgatgagattgttttgtatttttatgaaagactgtttttctcttttctactttttaaacccttttattttgaaataattttagatttgcagaagatttacaaaggtagtacagagagttcccatatacccttcacccagcctcccccaatattagcatgtgacataactatggtacatttattaaaactaagaaattaacattggtacagtactattaattaaagtacagtcttttgcctacttttaaacatctttttttctaaggctccatttttaaagtaatactgggttttaaagcagaaaatcagaatatttgacattaatacccaagttatggggcaacaggaatttgaagtccaaaataattgattttacttttatattatgctcaagacttcccaatgtataatatattcatagttaattgcagataatgacattaagcaacttaataaaatacccttaaagttttagaaagagatattaaaatatccatctgaataaacatggcattcacaatatgtcacaaatttaagtatttattagatacaggaaacttacttagaaggatttgtttttaaattttttgtattaagacataatttcagacttatgaaaaaattgcaagagtagtacaaaaaaatcccatttttttttacccagattccctcagtgttttcatgtcttttgtagggacatggatgaagctggaaaccatcattctcagcaaactatcgcaaggacaaaaaaccaaacactgcatgttctcataggtgggaactgaacaatgagaacacatggacacaggaaggggaacatcacacaccggggcctgttgtggggtgggaggagcggggagggatagcattaggagatatacctaatgtgggtgacgggttaataggtgcagcacaccaacatggcacatgtatacatatgtaacaaacctgcacgttgtgcacatgtaccctagaacttaaagtataaaaaaatatatatatatgtatatacaaaattttactactattgctttatcctttctctctctggctcccacaaatgagagggagagaaaactgttttaa

SEQ ID NO: 12416 - DNA, 229429 bp, Homo sapiens
gcatgccctcaggctacccagaaccggtgtttgctaaagatgacagtccactggaagactctcttactgttgctaaaccttgtgctgcatattgttgtctatactgagacccaaactcactctggatcctggaactcattcactgaaacttcttccctttcctcatccaaatgagtgttttgttaggaaacgtaatccatccgtactaatttggaatttgcagaaacatttgggattttgcaagggaggagagttgctgattctaatccagtctcaagtgattccgtcaacatagatttagtattttctcaagacagtttggggctgatgctgctgtggattcctagtgaggaccaaacctgaaatcttcacactatggacctgagagtctccttggatattttacctcctcccatcccatattgcttctggccagatgcaggtgtgtcagcccacacctagatgaatttcaagggggaacaatggcatcatcctctcctgaagtttcacctgctctgtcgcttgaacgcacgtaagccaccttgtgagactgttcaataccgggggacatagtatctgcctcattttaaggtgcccatgttttagtggaaggtgctttgctatctgtgacatttttgaatacagcaatggatttgagtgggcaaagctgctctgtaagacagggtggggtcattgaagccattttaaaaagagaaaacaaaagaaaacctcaggcattttaatatgttaaatacgcatccaattattaattctaaagacttctacaaatcaacctagatgaaacttttttcacctttttcctgcctcttttccccttctcagaaacatttagacctaccctatggcaatgactattgggaagtctctgccctgtatatcagggtagcacaaataattcagcacaaagcagcccagttactgtagcttggcattaggataagtatatcttaagaaagttcttatgcagacttggcttcaggcaataaaacgtcatagacgtataactgtagcgagtgaaatttctagggagcaaattaggctgaaaacatcttctagagacagctagaaaggaattgtacaccaccccaaaataaggcaagttatgcagtaaatgtttcatttattggccttcttccattactattagggttaaaagacatcttgtcaataagaaaagtatatttatggaggactgatgtctttcagaaagctgttcctgtcacaaatgcctatagcagtggtaatcggcttatgaaggcaggtgatgaaaccctgtacagatgcgtacatctccccattaacccttggatcatcaggtattattgtcactttattacctggacctgttattagctgaagcaaggtgatcaagccgggcacttcagaaaaatgtcagaacagaagagtgttcctcagggtttcaaggggagagagtatgtgtctctccaagtcccttcacagagtctttggggggatagaggatgcctgtgaagtgggcgcttttgcctaacccttcctcttgctaaatttgaaaactcttgggtgtccaattttttaacgttcctatgttggctaagggagtagctttcctcaaggtccaaataaggaaccatcacccacgcagaacaaaaagcaaacagaaaatctcacagcggaatcaggactttggcttctaaacatttccccattttatagcttccttatgttttcagagtctttttttggcttcctttagcacactcccggcatagataagtccaacacagtggggtaacagatcatccatcttggagcccagatctttaaagaaaaatcacacaggaacacaaatacacacacccacacatgtacatatcactgtcaagggtaacttagcagaatcttgccgagtgactgggggagctgaatatggttgtcaacatgtattccccacttcgggtaaatctgacagactagccttgtttttctcaaattccagagccaagctttcaatatggtttgtcttctttgctggtgtgcgtgaatctctgagccataactggggcgtgtggtgaaacgatggaatcacggacttttaaatattaacaggcaacttaaaaaagcccattccaaccacctcatccaccaggtgagacaagacgaaggggccgtgggtgacacagcctgtggcaggcctatttctgcagtcccctgtcaggcacattcctgtatttcaatgggcacctaacacttcaccatatctcccacgtggggaaccaacacttaaaaggtgatttgtgtaaacagaaacctccttttcatgctcattgatagggataaacaaggaagcacctctggaagaggtaacactactcacttaagttttaaggtatcagcatgtatccaaagagaaggatttaatcaagggagggctgaaggagaggagaaaacagaagagaagcagcagaagggcagtggatgaagagggcgaggtcaaagtcagagaggcctagggacagctacttacagttcaggacctggactggcgccaggaatggactccaaggggtgagggcccagcttctccctgccttcctcccaaaatatgcagagacctaactggattccaagggatgagggcacagcttctcccccctcccacccatttcccaacatgcagagcccatggtggcaaaatcccctggctcaggctaaagtcagaactggtctggtttcctgtgtttttcaaatctctgccatttgggcagaacgcttggtcctataaaccaggagtcatcagtatccacagagaagttgcctcagcacttggacccaagtcaactgtgtttaaaatttcacaccaaatctataaattacacattcacattgtgggccagcctaccttttttttcaaatagtattcaaggtatttttctttttttttcttttctttttttttttttttttgagacggagtctcgctctgttggccaggctggagtgcagtggcgccatcacggctcactgcaagctccgcctcccgggttcacgccattctcctgcctcagccttccgagtagctgggactacaggcacccgccaccacgcctggttaattttttgtatttttagtagagacggtgtttcaccgtgttagccaggatggtctcgatctcctgacctcgtgatccgcccgccttggcctcccaaagtgctgggattacaggcatgagccactgcgcccggctattcaaggtatttttcaataccttgctgcctggctactgcagtgccaattctgccattcccccccgctcctcaattcaggcatcacctgagggacttgcagagcatcagggatctggcccctctgagatcttgctggtctactcaagcctttgtacagcaccaggcaacgaaattaaatgtgggacatgcactatcacagaataactttttaattgcttaattaaatcagagatttaaggaaggagagattcaaaagagttccctttgaatgagaaaaataaggatatgccaaaatggataaagttactaatcatgggaacaaagcccttagtatttacatatgataaaaatgcaggccagtatagtaaaatcagtaagtacattctttaaaatttcaattcagtatattcctgagattttattatacaggtagtactataaagaacatagaagacctcattatccaacttaattcagaccagggtttgattaaaaaaataaaaaacaaaaaactaccacacaggacaaagaaattgccataaaattgagttcctataaatgtgttccagtttaagtaactaagtccctaaaatgagccttagtaaagtctacgctgcatatagacagacttaggcacatcaagtatacaggtgacaattagcaagtgtataaagctatggtcatttcgctaaatgtgtaaatctaaaggcaaccaagtaaaagacctaaaaaaggaaactgttaagtccatttgtacatggatttaacagtgaagcatttcattcttcatgttttcacttggtgtcttgaaataatcccctttctgtctccactctccctcttagacactgcacctgccttatttatttatgaagtctgaaggttagtcctacctgctgagactaattagccctgtgctttgtatcctatgcaatcctgtctgattaaatgtacacatttgttttacttcttttcaggctccttctcactctacttctgatattctgattaatatcaaagttgggagttacagtgattctcctctgcctcccccccaacccatttttattttgcctgcatcttattctttagtgtgcaaatgtggttgtgatttttttccagtgcaggggaattcgttggccttgtcaatctcggtatcattatttttagtagtctttctgagactttagcctataaaacagttttgctgaaaccccaaactctctaaatattayatggcaaatttgctttcttttggaaacctcggtgctgatgggccagctgaagtgcaggtgagctttttcagggaagggtgggacaacagtacatcctggactctagactaatactactcctaagaggcaatttgctaaatcctactgatttatttttttcttttttctctttttcatgttgtagtgtccagtctacttcttactgggtatttgcaaaaatgaattttcttgctctatcacccaggaacattgtgttttgggagctgggtctttcctctttaacataattccattccccattttgtagcaaatcagtctgctcctcctctaatacctaaaagtcaacaaatacctgcctcaagccccaggtttcccatcttctcccgaaggtcttctagcatcggtttggttagcaatttcctgccagagccacctacatcttgattattttggtcagtctttcggggatttcatttcagacccccttcgagaaacactgtagcccaactgatcccaggggttggtgaactttcagttttattttccctgacggtgttaacgcccaaacttttcacctcctaagtcaaaaaggactttgactctagctcatttcctactacctccaacgtcagttaaaaaaaaaaaaaaaaaagcaaaacaccactctacatttaaaagaatcatatatttttccttaaggatacttttaatgtttctgacatttagcatttgttttttgcataaaaagtcgttttggcatatccatcctagtgggacttaacatttcatgaaatgattcactactaataaacaaaaaagggaggagggaggcctcatgggttaatagtttctttcattgtagatgaccaggaactttgaccagccccttcacttccccaagctctctgaaagtggagggttgatctttccttttgaccacttttgtcgcatcccgtctaagggtggctgatttcactgctgaattaaccaccaagcacccccccaccccctcccccagccaccactttctcaaatactacccttccttttccccctcccttaagacttatttctaatatttctaaagtgcactgttttgggcctctccccatccccgccccccaagtgggctttccttccgccttcctcggctcggattcctgacttggtcgccacccccttctcctcctctcccaccccgcattgtctttctgaaaccgccccctcccggagcaagtccctgcaccctcgcccagaatcccgggctcgcacacactccgcgcaggccgctccccctgcacactcctccctccgtctccccccggcttccccgcccctctcttcctccttctttccctcctccctctcccggcgcccgaaaggatcattgttagccgcccccgccccgcccaccccggctgtttatttatgcacacgtcactgggccggccccgccctccggcatctcattaaggcagtgtgttcctctcgccctgtcaataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggtaggaaaagcccctcgggctggtggggttttttatctgtttcctgggcttggcaaatgttgctgaaaggggagaaatcggggctgggggcggcggcggggcccggcgggcggcgtgtgcgtacggtgccaccattgcaaaaacttgtaaccctgtttttttctaccccccctcgacctcgccgattctttttctcccccttctcccccttctgcgtggcgtttgcccctcgccctccccacctccacccctctgggaaggcggaaagacggcctccgcctcgctccgaaagtttccgagacaaatcccgggaaagtttggaagaaggtgagtacgccccgcgcgccccgcagccgcccggagccgccccccgggccggccgccccgcgcgccccggccccgcgcccggctcggcctggccctgcgccggcccggtcggggcgcccggcccctcggggcactttctaaaaagtttctcctcactctctcccgctccgcgcggccgccgctgtcccctcgccgccccgccatgttagcggccaagaggcaagatggagggctctttaaggggccaccgtatcccggctaccccttcatcatgatccccgacctgacgagcccctacctccccaacggatcgctctcgcccaccgcccgaaccgtaagtgcctccgcgcccggcccccgcccgctgcccgcccgcccgcgccgcccgccgggccccgcatgcggcccctgccctgccccctccccgcctccccctccccgcctcctcccctccctccctcccctcccccgctcgtggcccaggaggcccgaaactctccaaacttttctgccttttgtggactggatttgtttgcacttcgccacgttcttgctttcagtttgctgcctcgtgatgttggggagacctctctgtccaagcagggctttgttggtggggaggggggggaatccgaagaactttcctttgcgttctggttccccctccccctttggtggtggtgtttgtttcttcaccctgggaagatgactctgtggctcttyctttgctctctctccctctctctccttctcttccttccctcttctgtggcgtcttgggctttccccggttaaccccttggctgccgctgcgggccacgagtgactgactgtgctgcgcccgatgcgcrgggtagagagtgggtttcctccaggcattggacttgagaactggctagcgcgcagagcccggggccctggagaggctccttggctttctcttttgggcgrctatgtatttagctttctagtggagattgctggctctcggccctccttcccccttcccctggaaggtcacacttcccagattggtcccaccgcaaacttgggggctctgaggcgtccttttctttggcaacccgcagggccgcgagcgccctgggcgccgtggcgggctcsgctgcccggcgcactggctgcgggctctcccgggccgcgcagggcagcagggctgagtggggcggggaggcccctgcggcccggattcttggtttgtgtgcagccggaatggactcctccaagcggacttgtgtatttctagggaattttggcgccttgggatgtatggcggggtcggcgctcgccagcttccgtgtaggcccgtcgtgggccccaggggggccagagaccagggtgtgcgggctcaaggaggtgcgggggccgagggaggctggggcgcctctccttcaagggagtgggccgccgatcgccggccacccaactttgggggccccagggcagcgcggggtgccgggctcggggggcgcttcctgcagggtcggtcccgcgcccwaccctgacatttgttaatacggctcatcccctcccccaccggcctgtgccccctgccctcaccctgaaccccctcctcctcatccctccctgccctgccctactcacctccggggttattctttcctcaggtagggcctcgtcagcttcagccttccctccctcttctaagaagcctggattacgaatccctggacgcaagacgcatttgtgcccggcttccggtattgtcattttacaccttctccagtttggtcccctaccccttatttacacacacgacttttgttttttctttttcggtaactctagatagcaatttgaaataatgcacccactgttcagcagccatggattcggtgctaatggccgagggcttgccggacgggagtcgatcagatctacaagtgtttttaagcattaaaatattaactatcaggtttgacttgcttttttgggccctggcaaaatggcaagggcatgctagaccggtcattttttttatggctagggaagagaaataattattccccccctgcccggcgcccaracatgcttgggaagctgggagagcggttcggctcaacccccttctccagggccagttccaccaggctgcaggggccgcgctctgggcttgcagctgtaggggaagcacagttcgcttactttgtatttttcttgggagcttgtggggcatcttaaacgggaccgttcggctcagaatcgcagtgttcgcctaccaataaaccggaccaagcaacattccaaagaatccctgagaatttctgcctctcctcccctcccccttccgatggaaacctccctggtattattttaaaatccacttaaccatctgaatattgagctttgatggcgggcttgctagctttcttgactctttttaaactcgctgtctgatactggcaatcttgccatcccttctcaaacttgagcagttgtgttgtcttgtaattagcaaacagggaaattgctaaaggcaaataaatgatttcccggtgagaaaaggaaggctcccaatgatcggtcccttttgtgggcattataggaatagacggcgtctagttattttaattgtggacatagcgggtggcctggtgctgtgacatcagattgagtctcagaacacatttctgaactcagtaggcagttttagtacttacatgtcaaacaccagcagacatctttgtgtacactgccccttcgtccttcctccctgttacctgggttagattatgtgctccaaaattaaagttatttatttaggctggtcagcagagcagtggaaatgaggatggtaggctgttgtgtgtcattcctgacgtcttcaatcagaaggccagcttgcaatccagatttgatacagctgcgggaggaatggaggaatgcataggcaagatagcgggcttcccatactcttctgaaatccttagtgttttatagggtgtgtttttaatggcaaggtgtaaagacaaatttcgctgtatgctttattattttccctttgctccttggtggcggtgatttttgctacattttctgttacttatggtgtacctgtaagcagctgcatcctttaaaaagcaaactctctggaaccctgatttctgcttttttatttaagaatgtaaagaattagagagtatcattaaatcggcttatgatgaataatacattatctcaagaataatgctttaattgctgaagacaccataaagcttgatagtaataattttattttaaaatgacaaagatttctgcataatattaatttagtctttgattcagtaataggaatggcttttaaaaagacagattcagatacaaaactgcattaaggagaggtctagttaagtagatgggaagtgttagaactgcaaatattagaactgtggtaacatttgtatattaaagataagaatactgtaacctattaaagttgattggaaaaagtagttttacatttctttttccctcctggcaaagkggaaataggaatatggtggttgaaattccagttaggtttgaaatttctttttaaggacttgattattcgagcccttgcatcttctcttatccaaagttatttgcttttcaaccgagctctttgctactaggttgaacagataaataagctgcatcttgaattcatttttgaacttggaatccagcatttaaaggaaaccgagaggggcctattcattgggattttatttagccgggyaacttctctttctggcttgtgaaaaatggacgttttttcctcactgaaacaacataatcctttctaatacaaaagatttagaccttggagtgtgaagggttaatggtggtccttcccagttgtcctcccacccccccacctcacccctgattgttttgacaacacttttcaaagtgtgacattccaagcccctacataacaatgtaatattactgtaattacacaggtcattacattttaaatagagaacaataaaatgcttatcgccctgaaaaagaacaggtgttcttacccttctttggtatttatgctaattgtttttcatctccttcagaaatatttatggcgaacatgtttagatttcaatctcaatgcaaccgtattaattccatgctaatctttataggttggggtttaatgtctgcagtatggattataggctcaacattcacccaataagtcatattttaatgattataaattaaatatgccagcgctttccactttgttgatattgaaactttctgaaatcccagaaacaaactcaggcatttgggagcctaacgagcttatctggaagacgtgtttttggaaacttttgactgtttaagggaaggagctttgactgatgccctctgtgtctgattgagaaagagttttttgaggaaaacaatcctcgttcttgctaggagttcttcaccttgattttaattttactgatagggatttcatttagagtcattgctggaagttggtcagctttctgtttcttagcaagctgtgaaaaagttaccggaaggtttccrggggcttgcagatcaagaatgctgttctgtttgccgtgctggatcgctgcagttctgcacgccattraaaaaaatatttgctttagaaaactagcattttaatagttgcaccagaggctgtgcttttaaagattacagtagaagtctttccaggtttygaatgcctccttacatcccacgaggtgcccctggctgtgtgcaaaaagtgcctagatttctcggtggagaaatcctggtgcaacttctcttacacacgtgcagtgggtaaactagaaggtatctaagaggattttacattttgtcagatgtttcacaacaggcccccctgaatcacattaaaaatgcactgtagagaaaggacagctgcaaatttttgtgtggacgcgtgtttctggaccrtgactaaaactccgaggacctttcccccagctgtctggaagttatgtggaagttggtttattggcagttaagtatgagacaacctggatttagcaaatgctctctcctgcacaggaagtagatgacattatattgggggaagggaggagatttcaggcaaggagtgatttaccttttttttttttttttttttttaaatgctggagttgccaaataaataagcactttccagggaagtaagtgtaagctttttagtcttggtgagtggcattagataatatctttgactgcatttataattcttttgaggtgacacattttaaagtttggaaaaggaggctgaaccaaattcttgagggtcttattttcaaaggggtgtgtgatgtgggcatctgagtttcttctgggagtgaatattggcaactatgtaagtaaatcttcaactctgacttataattgagcacatttgtgaaggaaatggttaattttacaaccaaaggcaaactcgcacctcgacaggtctgctgaaagaaatgtgccccagtctttttgctggcaagcgcaccaccaggtcataaatccacaggctttatttacagcccataacacttatgaatgttaagatatttgacgccacgttggccttataatattcaaggtccgcagacattggcagtagctcagatttctctcactaattataagcaatgagatggggggaggtggtggtatcctaatgcaaatgctgccctcccttctccgctgacccccacctctacaatcttgagtttactgagacagacgccaccactcctttggcagctgacttgtacgtttcctctaggctattgttatacacatttataaagagcactttcaggaatggaaattcagtgggggctctgcacagatgcctttttcaaaagcaaagttgctctaggtgtttgcatcttttcccttttcttttctccctttttcctttctttctcttttcttaattccccccaacacccccaccttttttttttttttttttttttttttgagattacattgcctatattgtgcattttccccaggaatacttaaagaaacctggtatgggagacggctctttaatttatwtgatgttcccctgagtggaagggaaaatgtacacattacatagtacactagttaaactagttaacgtgagagtttttaaaaaagtgagatgaggtgaagagagttgactaaaagaatataataggtgaggggraaaaaaatccaggtttacactggggatgggagggctgcttatttgtgaaaaatgtactggtatctgcgggaggaggcacagaaaagtagccagaggagacagaataaatgcctaagaaagataagaaaagtataatacaagagaacaaagatttgggtttgggggaattgaaattggagattggaagtttccttatggaggggcgtgggagtaccctgggctgggctattaaaaagggatattgctttgctcagcaaagatgggctgcgatcccttcattasccagggtgttctacctagccacagatgtgtttcctatcagttactgtgtaagcatctgagggtgaggcattatctgtggtggagactggagtgtgagagagaaggccagttgtcctgctgattttaatttatgttgaaaaagtgggctgttctggtgtattacaaactgactacgcggtataaggaggaagtgagattcaaaggtgtttgccaggccaggagagatgatggctctcatttctgactggatccttccttccatccaacccaaacttaaagacccaggccgaaaggttttcttttctaatcaatggcatgcagaaacttactagccctcagggatagatatgaatccctaaacagctcattacaaagaaggggctgtgggatctttgaacgggttatcagccgaggtgttctttgcttttcccaagataggttttttctccttaggcacatctgatttcgggctagtaattcgacctgttatattttattctttttgtcatgcagtagccccaaccaggtcggtctacggaggaaggaatggccaggagtggcatcagccctgaaggagttaaaattgctccctaaagtttggcatcatgaaaataaatttgaggcctggtaggcattagcagggcacagcacatttacagagcttaattagtacgcactgtaattgttcatggtctgccagaagaagtaatgttcaggaaaagtggagtccctctcttgcagtcttcagcttgaaaccgataaatcacttgcatatttgtgtagtgattcaaatggagctaagacctctcccatcccaacatgtggtaaattgtaaagtcaatgaattgcagatgtaggctacagtgagattctctaagaaaatgcagaatgaatgggaaagagtgacgctataaatatttactgagaagataactagattccttcgtgctgggccaattatgatgtactaaaatatattagtaaaatgcttaaaaaattgagaggatttgtgtgggtctttgggtgggttggtttgttttggaaagtgaaataaaaggcactatgttgttgtcgtgtcagttttattaagcctgaatcacaatggcatacccagggaaggacacatgaaacccacattaatgcaaattaattcgttatgagttgcagcactgcgactgctaagtggagtaatgatggggcatcattttaagagttttagtgtagcaacttttaatgaaaaatgctgtgttaggaacatgtctcagcacttcagcccacgtgtttttctatatgctagaaatatgttttgtacaagagcaggaaacttgattcactttattttttcccccagacagtttaagagctttaattatgttttgacgttgaragaaaatcatctagtttttctcaaaaatcaacccagaaatgcccatcaccataaagaagttcaagctcaactttttttttttgcgagactttgcagcacaaagtggagaaacgatgaacatagcatttccccgcagacctacagataaaactttcttgaagcgactttttcccctttttttcttcttagagaattttggtctcaggcaatgttgcaagtcaatacttctttccccaaatgtgagtaggtggatacgtatagaagctgtaaaagttaatgatcgttctctgactcatagctgatggtttcaggttgaggaaaagaaaaattaatgagggtaaatagacatttgatggaacattgagacagtaggagagattgttcttgtgtctaaaggcatgcattttgttgcagcagaatttctgaggcagaatgccaggaagtgaaaggggatgctgtcgttaagttattgtttagggatggtacaaatgttcagtgtctagatctctgcaggaatgtttaagctcaagtaccaggcaatgctggttttgccttttctcttgaagtcagaggccccccttggtactttttataagggcaggcagtcacccaaagtcttggtcaaaagtttatttcccattaaatgtaaaaggctctcaacacaggactgggggcagtggggtaggggaagctgggcttataatggcctgtggttgctcaaatgactaatgacctaagaaaaggtcttaggtatactaaaaaaaagtattttgtttcttaaggtaattacatggaaattagatttcaagtggctcatggtagcagctacagggtagagaggaaagtggaccaaaaaaactaacacctcctaggaaatgatctgtttttttttttaatatagataagagaaagccaggtgattcataaaactgaaaataaagtaaatgttccacctcttcccaatttagcaggacgaataggcatcaaaaattaatgtgcatcatgttagaagttagcttagtgctggaaaaaccaacagaggatttcaattgttttaattgtctttgaggaggagattcctgtggttgaaaaaagctgtttcccattccatgtctgggtatctctgatgttttgcrtatcagaaacatcaaatttagagcccagtagtgattagaaataagatgaagaatctagatatgatgataataagggaaggggttaatcttaaaatgttggtctttacattgctgaagaattttgcaagcctgtgctgagaactgccgagtcttcaccgttcttcctctggacaagtgagggctgaggcatttgtgggtagtagaatgggggatgggcttggtcactgatttttgttgagagcttcatgggaagcaatgaaatggaaaatacgctggagttctcatctggtgactccctgggtactccaggcagggaagtgccattttgaaggtgtgaggcacagccaggtgagagcagccatgtttgccggatgaggaaatgatgtggagtggtcttggagcactcctggtgactggtgcaggacagtcccaagagatgaggcagatgggaacctgtttttttttttttgagatggagtttcgctcttgttttccaggccggagtgcagtggtgcgatcttggctcactgtagcctctgccttcccggctcaagcaattctcctgcctcagcctcccgagtagctgggattataggcgcacaccaccatgctgggctaattttatttttgtatttttagtggagatggtgtttcgccatcttggccaggctggtctggaactcctgtcctcagatgatccggcctcctcggcctcccaaaatgctgggattacaggcgcgagccattgcgcccagcctgggaacctggtttttattttattttattattattttttgagacggagttttgctcttgttgcccaggctggagtgcaatgcctagatctcgctcaccgcaacctccccctcccgggttcaagcgattctcctgcctcagcctccctcatagctgggattacaggaatgcgccaccacgcccggctaatttttgtattttttagtagagacggggtttcaccatgttggtcaggctggtctcgaactcccgacctcaggtgacccccccccccccaacctcggccttccaaagcgctgggattacaggcgtgagccatcgtgcccggccagaacctggtttttaaactcagatgtgccttagtcatcttgtcctggacttcgcagtctcacctcatattccaaagcacacaaatggcctaccatcttttattcttccttctagcttctggagagagaaatgattgttccagtttagaatgccaggrgtttactgggtgtttgtattttttatctgtgccttaaaaaaattagattataatgaacaagacatctttatgttttacagggaaggaaaaagcagtgaaagtatgcattttcgaaagaaaagtgtgttgggaaaagagagagagggtggaaacccaaaggagaaatraaaattttaagtccttgttgcagtagctggaggaagtgagcttggaaatctctccagcgcaatggttgctggctgggaagaaagatctgacttagacacagaataagctgcttgtgctgggtgtgtttgtragctgggtgaggttttctgtgtcgctgggcacstgagggaagttacgtggctggggggtggggtggggggcattagaagggagtatgggtgtctgtgggcgctcgcgtgtgcgtgtatgtgtgtgtgtgtgtgtgwgagagagagagagaaggtaaaattaactttgtcctatatgttggtttctctgctagagtcttaaggaacttgcagctgcatttttattgtttcaattacagcattctctctaggattgttggtgttatttgggtgatgatgaaggcaaggattaagaacagaactggacaagtgaaaattgaatttggattaaccacagtttgattaatttattcataagattgtgactatatgaatttttttcaacaacatatccttagttatcaggtgtccactcaattttaattgacaatataagattcctrtggtaaccctgtgtacagattgcctaggggctctgcagggattgtgggaagagaagcttggacaagtttccattaagatctgaatcaggcgattggaaaagaagagaataaaaccaactgaaaagagagggacaagttgttagtgttgcstactctgctttgaaggagaaccctcctcagacaagagctactttctggccaagaattccaggctcgcagagaaacctgtcccaggcacagaagttgttttaacatgatgcagaattgtcacagtaattagtgcaatctccgtttactgactggcagtttttacacaaaggagatagggacaaagggtgcaaagtcatctttgtttttcagcaggtcactttacttatttatttttattttttatttttgagatggagtctcactcttaccgcctaggctggagtgcagcgataaggtcttggctcactgcaacttctgcctcctggrtccaagcaattttcctgcctcagcctcctgagtagctgggactataggcgcccgccaccacgcctggctaatttttgtattcttggtagagacggggtttcaccatgttggccagggtggtctcaaacctctgacctcaggtgatctgcccgcctcagccccccaaartgctgggattacaggcgtgagccactgcgccctgccagcggttcacttcagatactgcttctgagtatgtgtggggggctgtgtgtgggggacagatcttctgttgttttagggcaatgtggttcattactctcctttgacaggtatagggtttttttcccacctacttcattgtgtctccttttaattttgattaatattctgtttggggcaagcagacttacattatatctatatataaatatatatgtaatgttttctatttgtttatttggaacagataaaatgatctcagagcccactgcatcctaaaatggatatttatagacttagcccatgaacaacatggatttagactattttttttatgggattactacccttgtgtttattttgagttagttcaaaagttcttatgtgattttttccacttttatttattttttaaaactgtgtggactgaattgtttttcttccagggagcaagatacaaattatctggatctgaaactcgcagcctaaattacactttgtgctagtaacacagacgtgttctggtagtagtaatagcacaggagtagtaacggtagtttattataatactacagatccatttttggaaatgcagttgatttgcctgttgcaaggaggggaaatggacatcaatttcacagggtcatctgattcctcattagtagttcctatttggcaaattaaaatgcattttcagataattgttgagatccttcagtgattattgtattgtttataaagtaaatcagcagatggtgtttgttttcccaattgatgggatcccaagattagcaagtattacttgggaagatgagaattgggtgaacaatcttgctcttcctatttcgggatacctgcttcattgatgggtggtctctaggacttcagagggaaaggctgaggayagacttagaccttggggagggtctgagccaatcagtgacttacattcactcagttgccatctaataggtggtcctcccttagaaaattggyggctttctggcagtgtttggccctctctttggggaagtgtggattactagagtgcaggcgacagagatggcctgggatggacagcttagtcatcatgaaagaatgtgtaaggcatcgggtggcccctgaattctgtctgacacatttgttttcccagaaatagaattgcattggagagttggggcccagttattagaaatatggggrtggggtgcttgtacttgttgcagtcttgtggcttctcataatcttttctctcctaatccttcctcttgcctacatgttgcaattctgatgactttttgcagcgcacagttcatttttcttcagcatcccgctcagcacactggcttcctttatgtcttaatgggcatccgtctttccttttcatgtcattgattctcactcgtggcccccatcttccctgtatgcttattgaataggtgcttaaaaaacaaaaacaaaaacaaaaacaaaaaaactttaccttagattgttatgatcatcttatccatagcaacaaatgaaagtacacaggtcttgattgaatgccaaggctgcagttcaatctaggaaggtttgtctgctattcataaactgcttaagatgttttcttgtagtttgtgacataagcagaacgctttgatttggtttctttctacagctccattttcagtccggcagcacacattactctgcgtacaaaacgattgaacaccagattgcagttcaggtaggaaacgcaagagattctgaagcttgaattgtctatatgtaggtctcttgtgtgttttattctccgccccttcccccaactgagataatgatgatgatgatgatgatgatgatggtggtggtggtggtggtgatggtggtggtggtggtgatggtggtggtggtgatggtggtggtggtggtggtgggggggggttgaatcactgggggagaaggggagcaaaggagagagaagcaggagaaatgctgctgaaatgatttagagatatggaaagaaagagaaggctgtgcttattgttaagagtttcttgaccgggcataatgggcacacagaccccagcttgactactgtttttctttgcttagggagggatcttgaattgggagtaaaacggggtggcacaatgtgaatgggaaggcttaaggggagaggtgggagaggaggccgtgcaacagccagagggttgtttctggtggatcaaaatcatgttaagtggtgctaagaatatctctttggacctgatcatcctgaaatgttgatttctcttggacctgtctatgtatgacactaaatgtgctggaagggaaaggcgacagatcccagcttctgatgagtgtcctgtttcctgctcacgtagtacttccattctcttaaatccgaaggctaaacaaatcatggactaatatagactcggagctgaactgatgccagcagaatgcagtagaggagggagagcagactaatacgattttcgtctgtctgcctggccttgctgggatggatgtacctcatggtgtaactaatggtaccaaaacttcttgagtgttctggcttaaccctttgaagggattctcttgaaaccgtttgctgtagtgttgaggtctagctggagagccttctttttttgtgagttgatgttggtttgttagatcatttgtgttattccatgacttcttttctgggcaagagcccttgcagataacttgtctgtgtgtgtgtatatgtgtgtgtgtgtgtgtgtgtgtgtgtgtgtgtgtgtgtgtgtgtgtggtcttaggtagctgcagccacaatgcatctttgtagctctgtcatctcagttctgcatcttccttgataagacttccagatagctgtttgccccaggtaaacggaattattccgccagtgaaaagcatgagtcagcagacatttttatttggtgcattcctagtgtttctgtactcattttcaggccacagcaacttattttaaaaatatttgaggctgggtgaggtggctcatgcctgtaatcccagcactttgggaggctgaggcgggcggatcacttgaggtcaggagttcgagaccagcctggccaacatggtgaaaccccatctctactaaaaaatgtaaaagttagctcagtgtggtggtgggtgcctgtaatcccagttaatcaggaggctgaggcaggagaatcacttgaacccgggaggcggaggttgcggtgagccgagatcacgccactgcactccagcctgggtgacaagagtgagactctgtctaaaatatatttatatatatatatatatatatatatattttcttttcttgattacttctgcagttgtgccgccaaccttcttatgtgtgtcttttgggggaaagtgtgactcttgattttacccttctccactcctaactgtttccaagactgacatgtctttaacttgaggctgcaattgttctttttggcatgctgcccatttgtccctccttcttccttttgatggacagcatagtaagtcwtgctcccagaaagtgctttaggtgcgggacttggttagagaacaagcccaaaccctaactcctggtgcctgagtggatgtacaactcttggtgaacgggtggatgtaccatgtcgaggcctcctacatctcgggtagtgctggaaaatcttattgcctggggtgtgggaattgttgaggttgaataggatagtgatccttatcttggtgtggaaaggctggctggggccatgtcactgggagactagcccagaccagaccagctgttgtatctttacacccgttgctgaagtgccccttgttaggccgagcagttcgtctttctccaaaccacctggcacggtgcaggccatgtgaagctctttctcaggaggaagatggagtaaattacagagctcattgttttggaggactgaaacyattactattcctccatgaacaggtagtattgttctctgcttctatttgctaaggcttgatgcccatgtgggcaaacagagagacattttattagagacccagcaccatgcttttgcagtgttcattctccctcagtctctgctagacccgcacaaggccaagctaaatggcatctagctgtaattttagtttgatcctcaaaggataaatggaaaaagcaaaaccaaagaagcaaagggaaaagaaggggaaagcttagacgaaatgaaattgttcccaaagtacattggggagctcataatcttttcgctctggatgtggcatagagcagatatgttcctttcgctccattctccaacttaagactaaatgcagcgtgattgtcggggcagaattattgtccctggaaacttaaaactgttcaaccttaataaatactagatttcaatagaagctgagcttgttgctctcctaagctacatcctaaaataacccagagtactatgaccctgtgcatcacattagactcatacgactcatactcttttcccttcccatccctcctgtaatctcaggactcagccaagctcactgtttatatgaatggccttgggtgattctatagacacgtcactttcttataaaaggtttggacacaatagcagttgctatgtttagatctttcctacttttgacagcctcctagctccccttggttttgaaaagacaagagcaactcagatggccacgttctcccaaaatggataacacaaatgaaactagaaagaaaattaaaagttttttttttttttttgagacggagtttcgctctttgttgcccaggctggagtgcaatggcgcgatctcggctcaccgcaacctccgcctcccaggttcaagtgattctcctgcctcagcctcccgagtagctgggattacaggcatgtgccaccacgcccggctatttttgtatttttagtggagatggggtttctccatgttggtcaggctggtctcgaactcccgacctcaggtgatcctcctgcctcggcctcccaaagtgctgggattacaggcgtgagccaccgctcctggccaaaaattaaaagatcttttagaaaagacattgttttaaaattctattgacttttaaaatgttttattgaagtataatatacatgtaacatagtacacagaactttagtagagagtagagaggtggatgaagttttccatatgtgaacgtccatgaaaccattactcagatcaatatatatagaatgaggttgggacacctttactgtcaagggccagacactaaatgttttgggctttttgagccgctcagtctctgttgcaactacatttgatccttgaatggcacaacatgagtttgaaccacatggatccacttagacatggattttcttctgcctctgagacagcaagaccaaccccttctcttccttctcttcctcctcttcctcctcagccaactcatcccaaagacggcaaggatgaagacctttatgatgatccacttccacttaatgaatagtaaatatgttttctttatgattttcctaataacattttctttagcttacactattgtaagaatacagcatataatatatacataaattatatattaattgactgtttatgttatcggtcaggctttcagtcaacagtaggctattagttaagtttttggggagtcaaaaggtatactcgggttttctttttcattttttttgaaacggattctcattctgtcgcccaggctggagtgcagtggcgtgatctcggctcactgcaacctccgcctcccaggatcaagcaattctcctacctcagcctcgctagtagctgggactacgggtacctgccaccacgttcggctcatttttttgtatttttagtagagatggggtttcactgtgttagccaggatggtctcaatctcctgacctcgtgatccggccatttggcctcccaaagtgctgggattataggtgtgagccactgggcctgacctatactcggcttttcagctgtgtgggggttcggtgtccctggcctgggggttcaggggtcaactgtactcagcgcttctattgtggtttgaaagcagtcaatgataaacccaaaggaatatatatatattccttgttgtgtctcagtaaaactttatttagaaaaaaacaggcagtggctgtatttggtcccagaggctaacttctgataaagagctccccagaagtctaccttgtttccccctttttccagttatttggcttcttcctctctcccctgcccccactgaaaagtctgttagttttatttatcactgtggattagttttacctgttttttgacttcatgtaaatggaatcttatagaatgtactgtttcatgtctggccacactcagcatatgtctgtgagtttcatccatgttattttgggtagcaatggtttgctctttttcatggccaagtagtattccactgatgaatatgcttcagtgcatgcatccttcctacgttgttggatatttggagtgcttccagtttttttgcgattatgaataaagttctagtaacattctcccacacatcttttggggaaacatatatttccatttctgtttatacaccaagagtagacttggaggggcatggggtaaatgtgtgtttagtcttgcactgaccttctgagagagacttgagtgctggatttgagtattgtcattgcaacagggccagtagttgttaggtatgtgagtgatacgtgtagggtgagcagtaaatttatctaggtgtgatcagaggccaattgcccaagctccggtgcaggccccttcatgcagtgatttggcctttggccccagctcctaggaactcctcccactgtctccattaacctgggaggaggactagcaggctgaattccagaggtggacccacattgcagatgtgtgtaaacagagctgtctcccaggaatgccctgcaggtgattgtagataatgtttaggcatctctattgccttcatgaagaaagcccttccaacactcctactctcagcattattccaaacctatgagcactgttgtgatgaaggtcgagacccacagaagatgtttcccttggtttttggaagggctacttctgagccaattaagcctttgttttaagagcgttttggccaaaggttaatgttttaacaccaagtcagatgtgatttaggaaaaacctccacatgcagcaaaaacaaactgtgtaaacctttcttggttgttattctttttagatttgaagtggtttgtgtgtgtgtgtgtgtgtgcatgtgcgcgcttgtgcgtccacacaaagacaactaggagaggatccagaagaaatggaccattttatttgtttacacagctgaggagtggatactgtgcrgtgggggttactttccctcttgttcttatgcttgcaagttcccatctgagctttaccaaagcctaaccttctgcttggtcttagaactcctccaccatgaatcagtaaggccaccaggaccctcctccagggcctgggtgctttttggagccaaggrgagaagaatactaactggagagtgtccttaccccatgttggccacttattcctggatgtgaactggatgttyagtcttgtccgtgtcttaacattgttaagattcctggggtgcgttgacacagagtctatgtctgtgtctgagcagacccttcatactgtgatgagcatggccagaaattagtaccagcggactggcccagcattgaagaatgaggtggcagtgtttgcagggcgcttgactttctcccacttcaggtttttgatgagggtctcttgtgttctgggcctttcctctcacccatcacaagttccctggccttcttgttttcatgaggatttgctctcttggctgagcagcagatccaggctaagtgaagaactcctggaaacaggttcagcccttggtgcagtcacttcctcacgtttcctttagagctgtagcagacttaggctgtgacatttcatgtccattttccacaaaggaatgaagaattagagagagatcatttcactagagtagtttgatagaacctgtggatggcaggtaacttgctcaagaggttcattgacttgctatggtgatgagttttarcctaattagctaatttaagtccatacctcagaagaatgttcattcatgaaaaatatttgcatctaatgtgtgccaggccactggagaattcatcagtgagcaaaacagacaaaaatcccttgctctcaccaagcttaaattctagtgatattttaatattaatttttaatatttaaattctagtgatactgacttataaacaccccgttcccaaactgagttaggtttccagtgtagtccaggagttagattttccttttcttttattttttttgagacagagccttactctgttgtccaggctggagtttttcctctgccttgctctgttgtccaggctggaggtttttcctccgcctcccaggtttcaagcgattcccgtgcctcagccttttgagtagctgggattacaggtgtgcaccaccacacctggctaatttttgtatttttagtaaagacgggggtttcaccatgttggccaggctggtcttgaactcctgacctcagatgatcctcctgccttggcctcccaaagtgctgggattacaggtgtgagccaccacgcccggacaggagttacttttttttttttgagatggaatcttgctctgtcacccagtctggaatgcagtggcgtgatgtcggctcactgcaacctccgcttcccgggttcaagcaattctcccgcctcagcctcctgagtagctgggactacaggtgtgtgccaccacacccagctaagttttgtatttttagtagagacgaggtctcaccatgttggccaggctagtctcaaacttctgacctcaggtgatccatctgctttggcctcccaaagtgctgggattacaggtgtgagccactgggcctggccgtcatttttttctttcctttttttttgaagcggagtctcgctctatttcccaggctggtgtgcagtggtgcgatctcggctcactgcaacctctgcctcctgagttcaagggattctcctgctttagcctcccgctggccgtcatttttaatcagggttgtgattttcaacctattgaagtttgagaattgctgccttagagtcttctgaaaccaatcaattgatcatttattggctgtcccagtcattttcactagccaaataaaaagtgagggctggctaagtactacattgggataatattttcttattttgaatgagaaattggactgcccttatgttccagtgagtttttgaggcctttattttcccattcttatgtgaagacagccagatacttttgcaaagcttgagaaaaagcatttgtttatggaagagtagcttggacaataaggtgcttagactttggggtcagaggcaataacagtagttagtaataatagctgcttatgcttattgaattctcttgagggatccagtgttaaatgctttttgtgaattattattactattttgagacagggtctcactctgtcacccaggctggagcacagtggtgtgatcatagctcactgmagcctcsacctccctggactaaggtgattctcccacctcagcctcttgagtagctgggactacaggtatgcatcaccacacctggctaatttttgcatttttagtggagatggggcttcgccatgttgcccaggctggtctctaactcctgagctcaagctctccgcctgccttagcctccyaaagtgctgggattacaggcgtgatccaccgcgcccagcatatgtgaattctttattgattcttcataacaacacagagggaaatttgaaaggtgtagttactggtattatcaccattatcctcattttgtaaatgaggaaacagatacctgagatattttgcccaaggccaattaggattcaaacccagacagtgtgactagagagagattgtcctacataggcttatggtaactattgcctgctcaaagtaatgctcacagtggtctaggggttcccttacagcagtggctaccaaccagccttctgggcaacacacatagaaatcacgtgggacctggtaaaaagtacagaatcctgggttctactccttggagattctcatttagggattaggtcagtgtttcacaagctcaagtatcacctggagggcacccggagagcagactgggaatccacccccagggtgtcaggttctgtaagcttggaacgggtcctgacatttgcaagcttttaattaatgctgtgttccttctctggggatagctcttggagaaccaccggactagggcaagggttcccagcttggactgttaggttatactcactcaggaagcatttcaaacaatattcagcccaggccctgccctagaccaaccgagtcagcatctctgggggttgtggcctgtgcatccctgggttgcaaaagcttcccagcttttagtgagcaggccaggttgaggcatctggtctaggggatcctggaatctgctaccacttccccacactggatgattctaatgcacacagtcacactagagaacaactattgtaagccttttttattgtttaattttaattttatttatttatttttgagatggagtctcactctgttacccaggctggagtacagtggtgccatctcggctcactgcaacctctgcctcctgggttcaagctgttygcctgcctcagcctcccaagtatctgagattacaggttcttgccaccacgccctggctaatttttgtatttttggtagatacggcgtttcaccatgttggccaggctggtcttgaaccctcacctcaagtaatctgcccgccttggcctcccaaagtactgggattataggtgggggccactgcaccctgccaatttttaattgttttgtagagacgggtctcaccttgttgcccaggctgatacagtccattttaataggcaaggaaacaggtgcatggaggtgaatgggttggtcccagttcttaccacttggtggacacgggacaagacaagaatccaggagtccagtgcagctatctttcaacacggctttctttctatctttccaggagaggttatcatcttgtctaagccaatagcaattggattacattggccagataaaataaaacaatctagttttaccgtttttacttatatcattttaaaacttatatctgttttaattatatcattgtatttgtacgagttgagatatttgtatctgttcattctccaccatattagggcacttagttcggaagagggctggtgaggataccaagacaatgtctggtagtctttaactggaactaccagaaagaaaaaaacaactgtcgtatcagccatacgtgtgcctcttatgggccacggcaggtgggcctcgaggtctgacctatggcagtcagctgctggtattttctttttttttgtttttgtttttgagatgagtctcgctctgttgcccaggctggagtgcagtggcgcgatctcggctcactgccacttctgcctcctgagttcaagcaattctctgcctcagcctcccgagtggctgggattacaggtgcctgccaccatgcctggctaatttttttgtatttttagtagagacggggtttcaccatcttgaccaggctggtcttgaactcctgacctcatgatccacccacctcggcctcccaaagtgctgggattacaggcatgaaccaccgcgcccggctgtctgctggtattttcttagcataacttcattttgtaaattctactttataatattattttataaagtccctgaaaatcatgggattgtttagctgagcacagaaatttctaaatgggttgtgaccaacatttacaggcttatcaggcttagtagttaatttgtttcttgagtttgatttggttgcatggtatcaaatcctgatcaaacagataagtggttgcttctttttttttctttttcttttttttttactggtttgccttgaaatcttagcatccacttcagttaaacagaaatggcattacctgttcccgggggttccaccaaaaccactggttggatggtagtgtgtttaatagttaatgaatactacattgaaatgtaaaaataaagtttaaaagtaggtacgtgtactatattatctctatatttatatgttataaaaagaaacattcacatcaaacatatgtggagtctttgaagcatcttcacaaaatcctagtgttttaaggggtgcagctaggaaaatacttggttataccacattccacccagattgaggctcggtctggaaactggcatgtctgtgtctttggttagtagtaggggctggatgagataggatgacttaatgcaggacttctcagcctcagcactgttgacattttgggctggagaattcttcgttgcaggggaccatcccgtgcattgtagggtgtttatttttaaattttatttatttttatttttatttgagacaagagtctcactctattgcttaggctggagtgcagtgttgcgatcttggatcactgcaacttctgcctcctgggttcaagggattctcatacctcaacctccccagtagctgggattataggcgtgcaccaccatgcttggctaatttttgtattttcagtagagatgaggtttcaccaygttggccaggctgttctcaaactcctgacctcaagtgatccgcccgtctcggcctcccaaagtgctgggattacaggcgtgagccgccatggtcggcctgtagggtgtttatttagcaccattcattgacctcttccctcttgatgccactggcacccaacaaaaatgtgacaactgaaaatatctctagacattgctgcatgtcccctggggatcaaaatcatcccttggttgagaacctctgactcagtctaatagtttaaagcatgcatcctaccattgatattatactatattacctttgcattttaaagaaacaggtacgagtggaggtgaatagttcagttcctgcttctggagtcaggtatatctatctgggtttgagtgtcggctctgctaagcttcagtttcctaaatctgtaaaatggggataatggcagtacctgtttctagagttgggagattaaacaaggtaagatatataatgatctgggcagtacgatgatacagggaagcgtgcttgataaatgtaagctgctatttttaccattgaggattatgaagtacttgtttgcacatttagaatatgctttatcccaacatgcattgtgtattttttatttcctgtcaagagcatcacacatgataaatttgataacttggactatctttgctgtgtaacaaagatttatgactcctattcctgttggttgctgtttgcatttctcttatgtcactgaaaattttttgctgggtccttgttacatttgactagaatataagcacttctgaagggctaagattgtgtcttactcagagattgtgttttactcatatttatatccctgtagcaccatgcactaatttcctgggacatcgtaggtgtacaactaggggtgtgaatgtgtttgaatatctaattgtgggcagaaaggaaacagtatataagtgagattggggtaggtgtatattagaggtaacaaagtgtgcttttagaatttttaaataacagccccttttataatatraaagaccaaaaataatttgtttttgtgctcagccaggtagtttgagatgagtgttcgaccactttgtcaacttggtgttcttttccacgtatcttagattttgattccagctctccatcagtgcgtgaatttgcactgctgtcttagagactatggcatcatccaaacagtggtaactatggttggactggtgtctatttctatgaccatcttctgattttcagaatgcttagaggttagttggcttttaaaagcaatattaccttttttttttttttttaaatgtcaggcagcattacctgtcagatcataatattttcatacactttgacaattgtcattcattcctgcaggggacttcaaaacaaattttaaacaagatgttttcctaattgtggatggatgagcctgcacagacagattcattcttttctctttccaaacctcgtgcctcccagatttttgaggttgagatgaagcaccagaataaatagctttggttgcaaaccagaaatcttccaaggcttgaaaatggatgtgtgtgatagtagcccattctaggggtactggaagattcttytcactagggctttggtgaggctgccctgtagggaagaagtcttgtgtcaacagtttttaagttgattcagtaagcattgttgatgattgaaattgaagaattgtgaagacaattcatcttgaggaacagagagcatagggtgtgagccaggctgctgggagcagacattgacatacgggccgtcatcaaactaattgttgtttgaattacctgttatgatccgatgacaaatctgccttgctcctgccactggagcagaaaatgtagcttgaactggcgtgatgttagcaagtgtaaactgtacttcaacaagatggataaacccaattatggggcagacctgtagagagaaaatccatttaaatctcataatgttaagcagagctgtgtttaattcatttggaccaatttgggaatgatgtatgagtgttggtgaacattagtcaaagaggggaccacttgggggaaagggatgtgccgatgccgcaggccactcgggggaggcagctggggtgtcgtctcagcagcctgcactaatggcggggaaaggcagcaatgaccaaacgatgtactgcctgctgtcggggagcagcgctgtgtaaataaaccaataaggaaaacatacgaagcagaaaggagaggagttgtttttcctaaatgctattgacagcccaaaacataaaggaaatttgaggttccctttctctatttctaaaccctgaaacccgtatgggctctgctaagccttgtaacaggaggcctagaaaaagctcttgccagaaagcttaatgatgatttgaaagagagaaagaaaaaggacagctaaatttaaattgatatcttggggcatttgattctctattggaaaacagttaagagggattattattttgaaatatatgtcttatgcatatttgaaatggagtctagaaggtcttgtctatttaaaaatctccctctctattttttaatagctactaagtggtgacccagctttgcacatagtgggtgctgaatgtatactgattaggtgaatgaaagcattgaacttgagaggcagttttcagagctagatattggtgttttctgtacctcaaactcattaggatgtataaggacctcatatcctaatttctcatagtagtcttttttggctttcattcccaggaattttgtgattttttttttttttgagacggagtcttgctctgtcacccaggctagagtacagtggtgcgatctcggctcagtgcaagctctgcctcctgggttcatgcgattctcctgcctcagccctcccgagtagctgggactacaggcacctgccaccacgcctggctaatttttttttttttttttttgtatttttagtagagatgaggtttcactgtgttagccaggatggtctcgatctcctgaccttgtgatccacctgtcttggcctcccaaagtgctgggattataggtgtgagccaccgcgcccggccagattttgtgatttttatataataatatatgattccacttcttttaaaatatacatatatatttttattatactttaagttctagggtacatgtgcacaacgtgcaggtttgttacatatgtatacatgtgccatgttggtgtgctgcacccattaacttgtcatttacattaggtatatctcctaatgctatgattccactttttatccctactcctacattgttggttttgccaaggatgttcttagaagactccaaccctcttttatgtggggaggaggtgctaaagccccctagtgagttggtattgttttttttctcttttgatttggggggttttcatctttcatggagtggactggccttggagacttcgcctgttgaaaggagaacttaaaagactggagtgcataaggagcttggcaatggaccgccaagacattcatggttgtgcactcttgcctcagtacccataaatctaatgattggaagtgctgggtgtaagtggaggttaaagccctagaatttgttttctgtaactggggacagttcattgtatgaggtcatggtgcacattgagtgcccattccgggcacatcttttatcccagagtcaaattcgttaggattttataccactttctggcgttctccaagtttcagcttagttgaagaaccagtaaaagaatgacaatagactgggtgcggtggctcatgcctgtaattccagcactttgggaagccgaggcgggcggatcacttgaggtcaggagttcgagatcagcctggccaacctggtgaaatcctgtctctactaaaaatacaaaaaattaggtgggtgtagtggcatgcacctgtaattccggctactggggagctgaggcaggagaattgcttgaactgggaggcggaggttgcagtgagcagagatggcgccactgtactccagcctaggtgacggagcaagaccctgtctcaaaaaaaaataaaaaaaataaaaaaaataaacgaagacctcacagttatgtttcaacactatgaattctgagaatctgaattttctgatctagttaccagtagaatgtacgtaaaatactttgagaaaatttaaattagcatctccaccaaaaagccccagcacatttagcccatgatttgacctgcccaatgggagtcttccaaatcatttaagaacaagtaagtactattaattaaatgaacttggaagaaacatatcaggatgtgcttccaaatctgaaggtatttgtgctgaaagaatcatctgttgtgttccatgagttttatgggggactctgtctggtttggctcaaaagcatttgtcaggtttatactcctgagggtggggtatacacagtgtgaactgggcaggcagtgaataagggaatttctggagaacagacccttaaggaaaagaaagcctccgctttgcgggttagaatggccagtgtatgttgggggcaagtcttttcagggccttctgtggtttttgtcctggtgagcttactgctttctgatgtaatagcaaagctgaaatcttgcagtaatgtgcagagaggaatttttgtcctttggattagcttctaagatataaatatatagcaaaagacccagggctacttaatttgatacagaaatgaaatggtgagttatctagataagggcttgattgatttatgaaatgtatcagactcaattcaggagtgttccgggagtcacgaagttcggaactagattcttacccttaaaatcaaaaacaaacctcccctgcttccctcctcctggtcttaagtcactagtttttattctggaatccagcggcatttgtttcttttttttttttttgaaacggagtctcactctgtcgcccagcctggatggagtgcagtggcacgatcttggctcactgcaagctccgcctcccgggttcatgccgttctcctacctcagcctcccagtagctgggactacaggcatccaccaccacgcccggctaattttttgtatttttagtagagacggggtttcacagtattagccaggatggtctcgatctcttgacctcgtgatccgcccgcctcagcctcccaaagtgctgggattacaggcgtgagccaccattcccggccaaagcatttgtttcttaataattgctgaagaagccaagagtttcctgttaattaaaaagagaaatcactgaagcaatgtataaagacacttttttcttgaaagagaacttaaaggaagatttgaaagtgtccctaagctaagaacattcttaccaaaccaccagtatgttttaggcagcctgctttgctttgtgttttcttgtcacttgttgctgttgctacattttcataatggtgaaagcagatgagaaatgtctcctcacagaagatacgatttgtgaagctgtttctctctgaagaattggcactcagggcttgaatttgagcaagtaaagggcatcaataatgtgatgggcccctttccttggaagagacccgtcctcaaaaaaaaaaaaataaagaaagaaaaaaaggggaaaagctgtgttttgcttgggtgacttttcagcttggttaaatttgccagtttatctctatcagaaaataaatcctaatactcctgacatgattttgtcattttaggatcgtttaggaaaagcatcaagttagtttttgctgattgggttggtacctccgccatccttaactgtttatttaatagtcataaattgagagtttggtgtttcctaccaccaccctctttggaatttttggtcaagatcatctccagccaccaagtttgcatagcagtgaaaggagcccgacaatgacttaaatgtgacgggaaccaatgatgtgacttgtaaaaagtacacagagaaaaccacatgccacatgcaaagcagatatggttttgatttcggcctcagtggttctcttatcgtttctttcgccctgagagtggatttttatctttcgatctgacttctgttttggtcatggtttgtggtttccttttgccatcacagctcttacatttggctgcatgggaaccaaagtgaccaggactcctggtcggtggaagtctcaggcaaggcagccccagcatgccagcccccaggaatattgagactgctgtggcttcagaattattgctcctgtcctgctaactcacaggctccccacctggggattcttatccctctgtctttgcttcttatgtaatacgtctgtggactattttggaaacatctagatgaacttgtgatcgatcttcccattctatgtatttctcctggttccctgcttttctatcatctcctttgggagggaatatttttcctcattaactagtttccaggtcaaaatttctccatgaagtatgaacttttctctatcccagtatttaatttccaccacttttttttttaaaaaataacataaggctgaaactttttaattgggcaggttacttaattgctatgtggctctattttctcatctgtgaaaagcaggtttactgagaagactggcctatcacggggattcatgtgaggctctgtcacaggggcctagtccagtacctggcacataagaaaggtttattgggtttatgactattcccagtggggtgtttctgggcaaactgggatagctgatcaccctaacacagttgttattaaaactcttgccaagcttacaagtggtgatatattgtggcgcatatctctttttttccccgcttgcttagtacctcatagcggaatctggacttgagttatttctcctgaataagagtagtccagaataccctttatttttgttttcttctttgagatggagtctcactctgttgcccagactggagtgcagtggtgcgatcttggctcattgcagcctccatccacctcccggattcaaacaattctcctgcctcagcctcccgagtagctgggactacaggcacgcactaccacgcccggctaatttttgtatttttagtagagacagggttttgccatgttggcctggctgctcttgaactcctgacctcaagtgatctgcccaccttggcctcccaaagtgctgggattacaggtgtgagccactgcccctggccccagaataccctttgaagagagttagggtgaaagagtccatgttgtgatatcatttgtctccccatggagggaaaccaaaaagcctgggggtgagatgggacttataattattatttagcttctgatgggcatgaaattagtgacagcaaggcaggaatttgtggccttttggttgtaacgtctgctctgtttttgttttttgtttttttgttttttttttgtcagatttctgttgcttaatacttcattaaaaaaataaatttaggccgggcacggtggctcatgcctgtaatcccagcactttgggaggccgaggcgggcagatcatgaggtcaggagatcgaaaccatcctggctaacacggtgaaaccccgtctctactaaaaatacaaaaaattagcagggcatggtggtgggcgcctgtagtcccagctactccggaggctgaggcaggggaatggtgtaagtaaacctgggaggtggagcttgcagtgagccgagatcgcgccactgcactccagcctgggcgacagagcgagactctgtctcaaataaataaataaatwaattaattaattaaaaagtcatccttttcagttctcaaatggcagaggtctgcatcctgccttgcgaacctattaacactcctttctttctttatgtggggtttcccttgggcctctgtggtcaggctattgtttgtctgagtttgtaataagcgtgtaacagcctccaatttgcctcaaagacaagtggtgttagttggttactagggacaggagacctttggaaattgtgattggaagctaactgttccagggtccctgggtgcctgtgtcgtatgggagaaggcactggtgtttcactgcaggtgagtctgtgcacacagcataggtcagcttgttggaactttcttgtgtgtctctcctgaggaagcaatcagttagtggccacgaacccaggcctgttcacacataaacttagatgacagtggtgcagtagggagcttgtccagaatgatttattctcaagagtggtgaagacataacttcgattctcccagtcgacttgaaaacaaccgttgttttctttacaccttctgattccagaaggtacagtttaaacctccctcatttgcagcaggctgaattaaaacacagtgctttgggatctatttattgctatctgtctttaagctttcagaagccaaaatgaaaagagaaatcagaaagcagtgttggtcaatagactttccccccgtacttacctccttttgacttggggagctgtaaaacagtaggttataccttcccacccttccccagcccccttcagaagacttgtgtttcagcaggctttgtgaatcagaaagctatgtttttgtttttgtttttttttggcatttgccagaactctatagctgttcagtggccttaggctgcggaaggcctgttttcctcccctcctttactctaatttgtcccgggcattctggctgatggcatggctttttagcaagagcagtgccttacctctttaattggttagttcctctaagtgatgatttattccctacctatcagaaatgtcttaatttacttaattgcatagccccccaccccttttaagtcccctccctctaaaaaaaaattaataccaacaataaaactatttccccaggcagtgcattgtgagatgaggcatttttctctggggagaaccttgtctttgtgtatggcagtggggaagaattaattaagggagaggakgaagcttagtaattgaagttaggggcycaggagctctgaacactcctaggtctgctattaaattatctggctgcagatagctggttctctgggtcttggtttgctcatctgtgaaatgcccccacaggatggatgcagtggtaagaccaattaattagaagccataaaagtgttgttttatctgaagttaagcatttttgttgtgataaggaggcgttctgggatgatggataaaacgctttggcactgaagtcagacgtagctggggactcaagtcagcagtgtccgtttattgcctgtgggaccgccctgagccttagttttatctataaaatggggataaaacctctctccgaggattaaatgggataacatgtacagcgccacagtgctgacacaatggcccatgctaaggaaagagcaacggtgattactttattggaaaggaaatgatacctgtgatcctggcaggctctagctgttgctggggtactttggttcctttcacttctagggaaggcaagtggctactttgtggttggttttcttgtcttttcaaacttccatctcttctggttaaatttcttctgcttctcagaagctgtaagagatgaaccctattctccttgtcagatggatatcaaaatagggctttcaaatggacttcaggatccttccatgggaattcatttgctacccattttcactcttattttagtgaccccctcccccaagacatataatatataaacacatacattgattttctttcttttttcttgtattactacaaggatcagtttcttctggcctaagtccagaaacaacatgcctgtcttttttcattgttgaggaaaaacagtctgaaggcaccataattccttaaattggatttcaattcttgatccccttatgttcggtaaacagagtgttatatgaaacatcattgtttaggagcaagaggctggcagccttgcttttttttgggtggaagggtcctcgattggagcctcctggggcgaggctgtgggtggggtcccctagaggtgaatgccccccccttcacttgggatggaggcattaatccctttccaaaaaatgctggtagaagttgggagggctgcctgttagtgagcagagtttagcttggaaagaagcctgtagtttgtgtgtgtgtgtgtgtgtgtgtgtgtgtgtgcattcttgttaactctattagtgccatgggcagccgctacttcacttgaaagctttggagtttctatattcaaatcaaagtcacccagaagcaaagatgaaggggacagtgtgatcttcaaagacgagggagtaaagaagtagtggggaatattttcctgggtaattctgcacccccgctcccacctttacagaaacactaagagccttagccacttcctctttcttggtggttatgtgggtactcaggctctggtcaagtcattggctgtttatggagcaggagacagatgacttgggaaagcaacatgaaaatgtcttgggttggttttgagcttgcatggggggagtgagtcagtagatgtttctcgggttctctctcttcctctcttgcctttcctcctttctttgagcttgtttcgctctgagagtacaggcttggcacccacttacccaagaactgattagttcctaaaagaagcagtgagttgattgcttacagagatgatgtaagctttgctctggggtacatcaacttggatttctcatgctttatcttataaagcctaaattaacagctggtttggtttgagttctctgggatctgactaagggattagagtccattctcaagtgagtcaatctagtttaatttatttcaggtctatcaaaaaagatcaatcaaagctcttttgaaagtaaagctataatcggtctgcacacttataagtcactgttgttgcacttggtgtttctctctggtggaaaaatgctcaggctgtggttaagaggatgtattagagcattttctgtgtacctccctttcttgcagcctccacacctccctgggaagattttgaggaagtgtcatgtttgagaaccccacttaagtgggagctgcactcacctccgtctcctttttctctgggsatactggatccctgttttggaagtttctagttcagtataattttaatacctggacctgaacaagtccagcctgttttatgtcactgtttttgctcctgggctttttcttgcagatattggtgggtgaagacatgcaytgaattctttccagaatgtctgctgtgaagaattactcatgtcatttgcaaggcttaagctgaagcattcgctgctatggtcgatctaggcttttgtgggcactggaaacgacaacccgagttgttcatttcttttgtttctattttaaaaatacttaccgagcatcttctggtagctaagaactattcgagatacacttgatgtgccaagagaaacatcaagataaaggaggtagttaagagcttgactgtagagttagacctgtctttgaatcctagctttgctactttgtgactttatatgacctgcagcaaataaatctcagtttccttgtctgtaaaataggcatagtaaaactgtctccctccaaggattgttgtgataatgaaatgaaatgatactgtatcttttgctttttaaataagccacttctggggagcttccaggaagcagaagttttttttttttttttttcccccaaatgcattcaaaataaacaaatctccttttactaccataacggtgtatgtgaatgtcctggcggatgctctcaagagcrtcaacaatgtgggaaagagaagcaaacaccaggttcttctcaggtggagctccagagtcgtccagtttctaagtgtgatgatgaagcatgggtgcattgacgaatttgaaattaccgatcatcacgaagcagggaagattgtgatgaacctcacaggcaggttatcaagtgtgaagtggtcagctggagatttgatgtgcagctcaaagatctaaaaagatggcagaatcatctgctcctgtcccagcagctggcctgcattgtgctgacctcagctggcatcatggaccacaaagagatgagatgaaaacacacaggaggaaaaagcctgggattctttttctaggggtgtaatacacccatgaaaaaataaataaataaataaataaaaataaaataaaaatgcctcaatgggggaaaaaaaacrcaccagagacaaatacttatttaggatctgtaatgtacccattgccatacctaggcatcctagatacagcaacatatccctgccctttaggaatgtacagtttactgggaaaaagataacacttatcagaggagggtgtttgggactgtgaatcccgtgtgtgtgtgtgttttgagacagagtcttgctcttgttgcccaggctggagtacagtggctctcagctcacggcaacctctgtctcctgggttcaagcaattctcttgcctcagcctcccgagtagctgggattacaggtgcctgccaccaggctgggctgatttttagtatttttagtagtgatggggttttgccatgttggccaggctggtctcgaactcctgacctcaggtgatccacccgccttagcctcccaaagtgctgggattacaggcgtgagccactgcacctggcccgtgtgttgttttgagcttctgtcttatgtaccacttcccttggctcaaggcgtcctttttatctttcttccacttgactaaatgagaatagtgtgggtcactctctacctgcctcccatctgtggttccttttggagataggccgagtgggccactcaccctttaattttctcttagtttcctttctgtacaccagtttgaaccttagtattatcactaatgcaaatatgagcctaggctcaatttttccagttatgaaatggggctggcattattccgtgatgtgcatgttaagagaggggaaagctcacatttttgaggtcctcttgtggttctatyttgtgtaggaactcacgctttgtttattcagcaatcattcctccagaaataaccttaatarcaacaagaaaaaagaataggtgttttttgagctctatctgccagtttctctatatatgracattatatattgcaacataacactcacaatgcctttaaacatcatccccgttatacagataagaaaacagaatttcaaagaaggtaggggacttgcccagggatacatagctagcaagtggcagcgctggattgagtctgggccttgtctgaggctcgggtcctgtcatgctctgcggttgctatgttgacatgcaaagggagaggcagctgctgggagtctaggtgggtttctctttgagaatgctaacgtgaaccctcaaggtgaatcagaatccttttgcaagtgaataatcagatgtaggttcctgtgtctccctgtaaaatgaaagcctcttttttccaaggtccagtatagacctgaagctgggttactctggaatttccctctctggctggagtgactgaggccttgcacgtgacattggtgaggactcgcagcctcaggtctggcttcccttagcaacccccctttcctgtctctgcctctggagttcaccattaaaaaaaaaaaaagaaaaaaagccaaaacactttataaagttacatgctgggtttcttctatgtcctagaaactgtcttaattcatcttcccctttactcttatatgagcaggaagaaaaaaaaattgctagtcaatgctaataattatggcatgtaatgtaattggaagtgtttcactgacatgctcatgagagtttgcggcttcatcttcaggctgggatgtagcactagacttgccttgagtgtctgcacaagcctttgatgcaggtagaccatattataaataggcgcgttgctatggtgaggatggcagtccttgcttgctgtgggtaaccttttctaccttctcggacactgttttaaaacacagcagcgtgatagcatttcatttaatttggaccaaggtggggtagatgaaatgttgagatttagatctaaaatgttgttgtggtgtttcagggggttctggctcacctagtactatggaagattttgcagattgggcttcctcatgatttatttagaaatagattttctaatagatggggtgaggggagggtggtgggcagaaggctgggctttcttctcttccccctcctcctttcattgagcgcttctgcgaatgtgttggctttgatgccccaggagctcatacagtgaaatggaagttcaggttggcacgttgcagaaatgattattcctggtagtacgtttcccattactgttaataatataaagacaattgcctgcctctcaggactcctgcacgtggctacagtcatttcttcatggaattagacacatagcagtggggaccaggagtgttttattagtgattgtcctcctgcaagtttccagggtatctcagcttagacacatgaattattttttcctgttgcttggagggtatacttttaattatattcattcaataacagagcagttcaggtttgtaaaatattttttctcccccaaccttttccccagcatacatccccgtcccgtaagtttctgggcagagacaatctcaggaacctaaaggttgctaaaaaattakctagttggccaggcgcatgactcatgccagtaatcccagcactttgggaggctgaggtgggtggatcgcttgagcccagaaattcgagaccagcctaracaacatggcaaaaccctgtctctacaaacaaaacaaaatctagctgggcatggtggtgcatgcctgtagtcccagctactggggaggctgaggtgggcgggcgattgagctcaggaggtccaggctgcagtgagccgtgattgtgccactgcactgcagcctggatgactgagtgggaccctgtctcaataataaataaataaataaataaaaaataaaaaaaattagctagccaagctgcttataggtcttttacatggccaagccactttctcacctttaaaatggtaataacgtttccgtactcatctcaatgggttttgagtgccaagacagaccgtttgatggaagccctctggggagaaaaatgctacccaagacaggcttttcaattggagactgatccattggtgttttggtcagttggtgttgaaatccctatttttccagctcaggactgcctctctccctggaactcttcccgaggtgagttctgcagccttccttgggaactctcagcctctggatcccttcttgccaggtggagtggacatgccaaagttgtgggccagactcggactgcctggcttgtctcagcacctttggggacccacttcccctctctgggaactggggaagctaacagagatcttgctaggggggtggaatcctgtatccatgtgaggttgtacccccaggctcctgagtggtttgaaagtggggaaccctggccgggcgcggtggctcatgcctataatcccagcactttgggaggctgaggcgggcggatcacaaggtcaggagatcgaaaccatcctggctaacacgatgaaaccccgtctctatgtgcgtggtggctggcacctgtagtcccagctgctcgggagtctgaggcaggagaatggcgtgaacccgggaggcggagcttgcagtgagccgagatcgccccactgcactccagcctgggcgacagagcgagactccatctcaaaaaaaaaaagaaagaaaaaaaaagaaagtggggaacccctcccccaggatgagaagagccatggggtgagtctctgccaccgccaaggggagtcaggctcagaggctgctacagggacagccagctctctttagatggtccccaccatctagtcagggcttgttacatatggagcagagacagcgcaggctgctgctgttttcctggagaaggcccctgtcggtctgttcagctgtagctgacctttcctccttgtgctttttggggagggagccttggaaggagtagggcacgtggggcactctgcttcccggccccacactggcgaacctatggattctgcctctgattcctgaggaaacatcactgtgaaggtggaatgagccacatacagaggtggctgttggggccggggaggggtgaaacgcccccagggtgtacattgcaccaaaagccaggctgcatatagacctcaggatgggctggcttttctatttatttagaagtatttccagagggtaacctcattggctacaaagcatgtctgaacaagagctccgttgttcattcccagccctgttaccctggcaggatgcagactccaggcggcctgttggtcaggccttggactcagagagcagtgaagcctgaggaggggtggggggcagaggcgtgagtggtctagggcctcagtccctccaggacaccccttgccaagcgcagagaaagctctgcccatccgtcccctcaggcagtgggattgggcaacctgggaagcagtgaatgtgcgtcggtagcatagattccattccgcacgccaccctcgcctccgccccccagccctgggagggatgcatgccctccgggagacacccagacccgacagagaggcctttgttggagctggaggtgagaatctgtgggcgttgggattcctgggttcgagttccagctcactgccaattgcccgagtgctgggcgaacatttctggaatcaaaaggagtgcagcctgcccagcagggcctacgggagccggaggctgcagggtgctaagattgcgttatctttaccaagtgcccggagctcctgggagggaagagagagtcctaggactcaggataggaggtggttggagtttctcgaggaagactccatgctttggttctggcccctggaaacccctcctgaggactggacctccaagcagaccccctctgtgactccggaatgcagtgttactctcttatatttttctttctttttttttttttgagacggagtctcactctgtcacccaggctggagtgcagtggcacgatctcggctcactgcaacctccgccctccgagttcaagcgattctcctgcctcagcctcccaagtagctgggattacaggtgcctgacaccgcgcctggctaattttttgtatttttagtagagatggggttttaccatcttggccaggctggtcttgaactcctgacctcataatccacccgcctcggcctccraaagtgctgggatcacaggcgtgagccaccgcacccggccactgtcttgtatttctaacgtccccctgacttttctgatcatgtaattcttaactttctcaaaactgagatttgtcacgtgtcctctccccactccattttgtgaatcagagtcttccaggggcaggacctggagaatgggtctttattaacacacatgtgaaaatgcttttgccagcaaggcgcggtggctcatgcatgtaatcccggcactttgggaggccgaggcaggcggatcacttgaggtcagcctggccaacatggtaaaaccctgtctctactaaaaatacaaaaattagctgggtgtggtcgtgggcacctgtagtcccacctactcgagaggctgaggcatgagaatcactggaacccaggaggtagaagttgcagtgagccgagatcacaccactggactccagcttgggtgatagagtgagactctgtctcaaaaaaagaaaaaaaaaagaaaatgcttttgccatgggctgtctcctgcttctgctttgcattgggcctctgtacctaggttgcaagattcctcagggtgcacctgggcttatcgttatctgtaagttatcccagcaagcacttaaaacacagtgttggacgatgaatcccctctacaagagagggacagggcaaaaacgacacctcttgcctcgcaagctgtcttgggccaaacctcaggtctattctttcttttttttgaaagtagtggctgggcacggtggcttacgcctgtaatcctagcactttgggaggccaaggcgggcggatcttgaggtcaggagttcgagaccagcttggccaacatggtaaaactccatctctactaaaaatacaaaaattagctgggcgtggtggcgcatgcctgtagacccagctactcaggaggctgaggcaggagaatcacttgaacctgagaggcagaggttgcagttagctgagaccatgccattgcactccagcctgggcggcagagygagactctgtctcaaaaaaaaaaaaaaagaaagtagcagctctactgagatatttagaaaccataaaatccacctatttgaggtgtacaattgagtgattttctgtatagtcacagatctgtgcagtcatccacaccctctaactccaggacattttcctcacccccgaggagaaacctcccttacccattagcagtcactcctcatttcctctccccccagcccctggcaatcactgtggatttgcctgttcttgacatttcatataaayggtatcataaaatctaygggcttttgtgtctgtctgctttcacttagcatacggttctcaaggttcatccagtattgtagcatctatcagtatgtcattcctttttatggccaaataatattttattgtatggatagacattttgtttattcatttatctgtttttggttattatgagtaacactactatgaacattttgcacaaatttttgtattgacatgttttcatttctcctgggtatagtcctatgagtggaattgctgggtcatataataaataactgtttaacattttggggagctgccaaacttttaaaaccttgggttctgtgatgtaccagttgtgttaggcagcacagcaaaatgtgacttttgattgccagaaacaatatttaaaaagtggttataaaaagtggtttgggaggctgaggcaggaggatcacttgagcccaggagtttgagaccagcctgggcaacatagtgagaccctgttaaaaaaaaagaaggccaggcacagtggctcatgcctgtaatcccagcactttgggagactgaggcgagcagatcacctaaggtcaggagttccagaccagcctggccaacatggcgaaaccccatctctactaaaaatacaaaaattagccaggcctggtggtgggcgcctgtaatcccagctactcaggaggcttgaggcaggagaatcgcttgaaccygggagactgaggttgcagtgagcggagatcatgccattgcactccagcctgggcaacaagagcgaaactgtgtctcaaaacaaatgaaaagaaaaggctgtcatgttagatccaccctcctcctcaggggaacccctgggctgctctctgggtagagatgggaacccaggcctcgggccagtgagtggaaggaaactttgggatgattgacttgggactgggctagaggtgaagaatctcccagtaggcaaagttcggccttacgtttttttgtttcaagcaaaccacatcattacccacagaggccattggtgagatatttgtaagtctcctgacagtggctggagttcgttgcttggttgttgtttctctgtctcagccctggagatgggagtgaccacctgctctctctggacagaggctgtccacgttcatgcaattccttggacaccggtggtgcagcgggaggcgtaactgggagtgggagaccctgaactgtgccggttcttgcagagtatcactgtgacttcaggcgagtcaccccacatcaggcagctcagaacaagggattgatctagaaggacctttcacctgggctattctgtgactcaaattatcttctcctaagcccactactgcctggtgtgttggttaaattagcctaaaggtcattccctcggagaggccctctgggaaacctccctttcctgakagtcactgcttgctggcgcctgcccctggggttccttcagagtcgtgatcatgccctggcctcttcctttatttggcagtcccttcccttccccatccctgatgagggtagggagcatctgtctgcagcttcatcttcattgtctaggggctccagaaatatctgtgagtaaataagttatttaatctttgcctcaaatttccagtgactgtagggatatagctgtgagcctctaggagctgagattttttaaatttcccacttaaacatttatttaaaaattttgtgctcagcatggactaaggactttacattcattaactcatttacagcttgatcctatgcggtgggcattcatttacagaggatcccattttacaggtgaggaagaggccagctaggggtgcagcctaggttagtattctagagctcatcaggctgtgttgtccccagtgaaagaataagcaaagaagtgaatgttgtgcattgagaaaaatgactctcggaggaggatgagcctctcggatatggcgaccgaagtgatwtggggcccttgtcaagggtctctattatggcatcaagaaaagatgctgctttcggtgatgcccgaggagagcctcaatattttacatgggaaacctaaaaaaggggccatgttgtggtctctgcacctaagatactaaaggaaatattttatggagagatgcaacatgtcaggccttggagggaaaccccaggatccagatggttgcactctcaaaycagggcccccctcaccttggccttcascatttagtgttggaaccaatagcataagctttggtcaggacctttgatggaagccacagtgctcattagtgaccacggttgactaccttctctctcctaagctgacttctggagggcacctgggatttccggccagtgatcagtgctggtgaagcctgaaggccaatgtgtaggtttagctgttcagtcagaacccaaaaggggccaaagagatggtttccttcaacctccactgagggaagtgaaagtcatggttcgttaaaaggctgagctgggaccagagtctagggttctagaggtgggaatttctacagctttgggggaccttgcaagggcatttgctcttctgggactgcagggagactgtgcttctcagagatgttagcatttggcttggggagagagaggaaaggagaggttcatgctccgccatgatggtggaaagtgatgttggtgtggtgaggagctgagctgaattctaagtggttccagggaattaacaatgttcctgcccaagtgtcctgttcccccacaaactaatgaggcagcaggtgtctgaagagaaacattgcagaatgtctgccaggggttttatggttaattttcctccattatgagggttgactcagccttgggtattagatgtctttgagaatccagggttcaaataccacagctggtagaatgtttctcaacttggagccaatctccatctactgaaggtacgctggtttagacagacaacagggacatcagcattttaaaaagcggtggaaaaagtttgcttgtcttgattggagccatgacattttattttgaaatttcaaataacatgaagggaggtttggagcggtttttggtttatccaaagggcagtggattgaaggctgagaaacaccaggctgaatgggagaggggttggggtccccctgtgagatagtgaaacaatggtagtgccatccaatgataggcacttttctgtcattcagaagcagaaagggggccagaggcccattggccttactgggmagtaagctgtagagctgctgccttttcgtgaaagggttgacaccaaccttctcccccaggaagagtgaccagggacctgaggggcatggtcgagcagatgacagcctttgtaaaacatctccctggtctcatcagcgatattcrtcctgccttccttctgagtaatttccatcttaggactggagtcaggtggagcaagattccatgttggtttctgttggscctagagtgtcacactgagacctaatttcatactttatgaattctagtactgctctcgaaggtaagagccgtcctctttggctgaaggtttttgcctgcaaccttgcattgtaatccagtgacacctgacgtatctgtaaatttcttcaaatttctaagtgtattacaaccccgtgtgcaaaagatgattaattaattgccttgacagtaaaacaaaaaacaaaaaaaaggtgtgggggtatatggtatccctgatttactatagaagatgcagagagtgaagggagatgaggtggggaggaggggcccaggttctggtcctacttttttttttttttttctaaagagatggagtcttaccatgttggccagtctaggcttgaactcctggcctcaagaggtgctctcacctcagcctcccaaagtgctgggattataggcgtgagccaccgagtttagcccaggttctgtttcttgcttagtcactttctgtttgaacaaaattggaatttcctttttggatctgtttctttaattgtaaattgaatcggactaaaacctttccaattttttcacatgtgaagacatacacaaaagttttattggagggttgcacatgtgaaagaaaaagggagaaagcaggattgagcagggggagccgtcagatggtaatgcagatgtgatgagatctctgccggaccaaagagaagattcctttttaaatggtgacaaattcatgggctttctctgcctcaaaacctagcacagctgttatttactgaacaattagagagctaagcactttttagataytatataatttaattgccgtatgaggcacccttagttttcagacgagaaaccacagttacagggaaggcaagtaacttagtcaatgtcagataactaggaaaaggttagaggggccctggacacaggcctgtgtgactgagaagcttgggcacttcactgctacatttcatctcttcgctataaacattttagctttttgtgtttgctgactggcaacaatacatagtgaaagttctaataatttgtaatgcttttgcatgtctttgtatttttcttggttatcacatcacatcaaattaagatactgatcagcagtgtgagaggttatttttccatgtcctcttcattagtgttagcttgtggatggatttgaggctctctgtgctttccccccagcaaagtgaataccagactttcctattaaaaaaaktattttatttttcagagacagggtctcattctgtctcccaggctggagtgcagtggcacaatcatagcccactgcagcctccaactcttgggttcaaatgatcctcctgcctcagcctctcttaagcagtgcctttccccattctcatgggactttccaatccatgagatactttgctgcagggaagccctgtctgtccaggcctgtgtaatagacgacttcacatggtcctgtgttgttgtttgccttctgtgtggctaagtttccatgacctggtggcttggaagccccatccctgatttgtgggagaggcagggaggcaccttgtagcgcactaggcgttgggcctgaacaagtctgtgtgcttccaatgtctttgtggggaggtttacgagtccttcttattatataatagtatcttgtcttagcttggtgcctttcttctcagaagcttgaggcactctgcagataccatctcaatttgctttctgggaggaggagaggaagctacccaaaagatgaagttctctgtgaggggcttgaacacaggttgatagcgttgctggttagttattctcatggtgtggatgaaaaatggaatacgctgaaatttcagttactcgtcacaaaaataaggcgtatgtagaaaacatcctgggctaaggrtttgcatgcttctagaacttcctgttacttaatggctgttgagtataaacctcgggaacagtggggatccttggagaccccaaataacttgtatttgtggttactcctgtcttgtctatcaatacccctgtctatatcgtgttagaactaggacacacagactggattcagaagctggcctggggtttaggagaacatgggacctaatcctggccatctcgatttacctcctggatcttgttttctcatctgtaaaatgaattggggtgtggactgtttatggcctgtaggatgctagccctgagaattttctccagatattctacggttaagtaattttaggggacactgtctaagcagttgcctcttggagaatgaagatgttcattaggatattgaaggctctgagaagtcctaaagttaaagaaaatctgcaatgttctttgtgggaccgaataatgcaacctgggaaatgagggattagatgacacttgagtagccttccagatctgagacgagtctcactctgtttgtttactccatctgtgatgggtgtaggcaccatcttggggagcaagctgtgatagagagggaacaataccttgttaatgtttgtctaattcactacccaggtgcatggtagtgaattagacactactttgtaggttctggagggaagaagaaaagacgagacctgcctggactggggcttgagaccactgtcaaatacaagtacagttgtacaactggtagggagtgggtcatagtatggccggtctttttaaaggtgaggaattcttaggcccagaaaggcaaagtgacagatcctggatttaacyagcagcccagatttgaggcctagcacatagcaaagcaccatagctattcaatagctgccaagtgggagtttggatgatggctttcctggacagcgaaagcagtgatgtttgcttaggatggcctttggcagtgctgctgttatccttaccactggcaagccatctcacgggcccggaggggagggcaaggaatcctaattctgtgagaaggctctgggtacatgagtgtgagatatggataccctaggctctgcccctgaagacagtggcatcggatttactgcactattccagtcggacaggcaccttaatttttctctttctgggtgtttgatatggttgggtcctatttcttctcctccaaaccccgctagggccattcccccacccttcacttcccggccttccactgcagtctctaaggattctgcttcatctttatgtgtgaacagggttttgacaaacatgattaactgggtatttttggaaggctcaggaggaacgcagagtgctccggagggcaggcctggagtcaggaatgcttcctgcaacctgttcgtgcagtgagcgtgtcttcctcgccctgcccttggctggggaatgtgctggcttggagggcaggagagtgacaggcggtttgagaactccrggctctcccgtcttcggatggctcctgtgaaagcagggcctgaaacttttatcgtcactgctgcaggtgaaagactttcatttggctgtagtggtccaacaaagagtattttatttatgtgtttccaagcccttaaaaattcttttagggcacatcagtggggagttaatagaaactttgaaataagaaaaatgcctgcagggtaagtagaaccccagccagccagctccgagttctgtgctgttagctggtaggttggttctcagagaagtggctggctggctgggttacggagcccacatctctaatgccttagtgttcaatcattaagtggatttttttttttcccttctcttcttttggtttggagggaggactactctaaactttactcagggcagggtagctcctgaaagggctccctaacctttctggtttatgacacaaagaaagtttggaggtactgggataagagatggcttgggtgacccccctatcatgccccctaacacatacacagcaaaccaaaccaactcacccttgatcatactcgttgtttacacgaagggaatttttattgtcttgtgagtgttgagtgatgattaaacagaagagatgtgactccaagcctggcttcactaagatagtcttgtttgtttcttttcctccaaagtaatttcctaaagaattaaaagcccctttgaaacccagcactaccttgtctctgattatcagcataggcaggaagggcttttaaggtctgagcccagctgtttagaggctacgagacgtgaggcaaatcctggtatctctctttgggcctcagtttcttcatctgtgaaatggcacagtactaccctccaccaaggatgatgatgagaattaaatgggatgacaggtttcatccccagctcctgttcttaggaaggaaaaactgtgacttatgaagcctgtaggttgtgttcaggtttgtatgaggcctcggacttcatacaaaggtatcaaagtggcaaaccctgatccagatgttttcagttcagtcagctggtccttgagcctgttgtgtgccagatatcctgaccaaagaagctagatgggagctgctgtgttgttccttggggctgctggatkcaagttgtttaggtcggcggttttcaaatgctggtgattttgctcaccagaggacatttggcaatgtctagagacatttagcatggccagtcattgggaggtactcctggcatctcgtgggcagaggctaaggatgctattgaacatcctgcaatgcccaggacagccccctrtgacaggagtcatccagcccaacatgtcactagtgctgcagtggagaagccctggctgtgtgtgggggtgtgtgtgtgtcctcttctacatttgataaggtaactcacacttgctgcccccatgatcgctgtgggggatgcttatctatgccccagtcctggtgttggttgatgggaacatcaagattcaggcaagatggaaaatagcccttagaactagcaggaaaagaatctcctttcatttgtctagaggttctgttaaagtgcctttgcttctattttgagacttgttcttaaaaaaaatgcggatatgaaagaaaataaaaaccacattatccctccactttttcttggaggaggatgtgttgaagaagtcaaagttcascatccctttagatagaatcattttgaacaatttcatatgtcaatacattttgctcatctctaaatttcattttagagcctgtggtgttctgtgcatggatatgtgtgcgtgtatgcacacaaaaataaaaggaaatatttattcttatgaataagtatagaaataaattaatttttggaatctcaaactatcagagacttatgtaataaccagaggcaggcctgattatgtatgggcaaagcatttgtgaacaatgtctccattgtataacatacaaaacaagcttttcttccacattggatatgcaagtcggccttctccaataagggcctgtctctttccaactccccccacctcccacctttgagcaaacattatttattgtggctgatgtgtgatcaggtcttgatttggggcctctttttgatgccttctctttgtgggatctcacccacgtgcccctggagaccctttggctgccagggcctttgtttcccagccacccatgtggtgccagtagtgtctgctttgtagcgagctgtccccagagcctcagcatggcttggggatggtctctgaggttgggcttggatccctcccacttttgggctcagaaagaatgactgccctctatttccctgtccctgccctctcttatcctgtttcccagcccgcatcatgttatctttgcttcttgtaacttaccaaacgatttatgggcaagtaggggaggtgaagagggaactcatctatcaagataacctactttgtgccaaccactgagcatagcaattgtcccttctccagccctctgaggaccgtggatgggattctcatgaaatgaaacaggtgaggaacttttcttttagggaacttgcttgaggtcccacaggcagcgagtatcaatcaacgtcaggatctgagccctgttctgttcggctgaaaatatactccctgagatggtgtaggccaccatggctttcagcaggctctgtgcttggtggaaggaagctggaagctgtgtacacacccacggggaacagggaccatagaggagcaccttttgagtgcagaacctggcgaaacatacacctttagagggattttaggtacccttgaggctgggagaatcaagcagagctaagtttcccattggggtgtcacagactgaagaaacagagccctaggtagcacagggaagttgattgcccagtatcagttagtttggctttaatgactgagaagagattccaccagttcattgaagagagggcggactttttattggaggaaagaagagtgcctgtaagtagagaagtctccggggtgtagtgctgtttggggcaggaagaacagtgtgagccactgtggagagaaagcccaaagagtcttggcagggcagggagtaggatggatttgaagccagaggaagtatggggtctctgtagactccaggcaagccatgttaatattttaggaagccgtgatggagctgcagatgggtgtggaagttaaagtttaactgttcattcaccagtccttcccctggagaatgtgcagcacgtggacagtggaactttaaggtccttggcttgtatttcacacccaagagatgaataggtccaggtatgtcatagaccagactaatgaaataacaaatttcttttcaaaaattttactttttgtaggaaagcttctctgtctggcatttttcttctcccagttgtgactcaatcttaaacgtcttcagacaattagcataaaatttcccacagtgaattgacgtatacttttgagggttccatttcttttttattttttttttcttttgagatggagtttctcgtcacccaggttggagtgcaatggtgccatcttggctcgctgcaacctccgcctcccgggttcaagcgattctcctgcctcagcctcctgagtagctgggatgtcaggcacccgccaccatgcccggctaattttcgtgtgttttagtagagatggggttccaccgtgttggccaggctggtcacaaactcccrmcctcaggcaatccgcccgcctcggcctcccaaaggctgtgattacaggtgtgagccactgtgcccagcctagggttccatttcttaacccctccttctgatgcctcagaaagtcttgctctgtaagcctcttgtagctgcctcggttcaggggaagggggaggcttttgttttaggaccgtccagaccatagacacatttcctggcacctagcacgtgttgggtcaaacaggaatgatgaatgcatgcatgaatgaggttcttagcgctgaagacggtgtcataggtggtctaccasgccgcctgatcattccaatggcccattatgaatgtgtgtgctgcagggccctcccacgatcccgtcagcactgtgcatgttgtggggaggtgctgggagaaagactgggtctcagaagatgggttagaggtgggtccttctctgctgctggctagcagggtagctgtggaggggtgccccatcttgctggtcttaaattttctcactgtagrcagggagcatgacctggctgaattctaagtccttttctactctgaggttcattgtgggtgtgacctgctgggctcagctctggctttgggagacaccctctccccttgatctcgacaaccccttagcagagcccagtggctcctacagtgccctgagctgcttgcccgaaggatgcggttgtggttatctcaccccctgccaccctgtttgcgcaagggtttgagattgtgtggcccctccttgtacttcggggtgaggcttgctccagaaaggtggtctgcaaaggggttggctgggggggaggaggaagtcattctccaagtgtttgtcctcatcgttatcccaaattgcttgcctggaataaggaaggaaagaaaaaaaaatactcttgagtggtttgggccaggattttagctgatggatctggtagttccctctgtcagatttgttttctttgaactgtctgggccggtcacagtgtcattgtttaaatgtggaatgtaggtgttctgtgttctgggaaataaaaaccaaaactggtccaggggatccacagaggtaagaaaagaacattmcaataggaatgtttcagaaccaggaggggaggagagaaaaacggctctgttggtctcctagaggaagaacttgttagatttggggagagtcaggataaatttgaccctaagagtctctgattccttttagagacttttcttataagaaataaaatggaacttgggagaggcggcaacttgggaaacagcacattctgccgtaatgaaagtcgtcccataagaatttctctatccctttagccaaatttctgtttctaaaaggggaaaaggggctagagataggcttgtttgttttcttagttgaatcttactttttgtatttccagcccattctgcagggtaagaacaagcacagcccgagggctcactcagtgtgatgttctagagcctggctctgcctcaatccctcacgctggaggatcaggcagcaggggccagtgatggatttttttttcttcctttcctcccctattaatatttactgaggtataaattacagcaaagtgcgcagacctaggtatctaggactgtgaggttttcctgtgttacctgtgtaaccacgacccagatcaagataaggaacttttctggcatctcagaggctcttcctgctccctttcagactccgtctcccagaaggaactacttctgattcctatagccatagactgaattttcttttccaacttcatatgcataggatcatcatgggtgttttaattttaatttcatgtctgcttgccactcccaaatggaaatgtgttggcatctctggatgtttcttcataagaaacatgccctgtggggcaaagcccaggacagggctgtgctgctgctggaagtcctgtgcagctggccagcctctgctcacccctccggccacgctggcactttcagcttctccagcctcctgcccttcccacttccagtcctgcacctgctgtcctcactgatgcacctgcccttttcyttccgtcctttatgtggcacacccttaagggagacatcttcctgtctgtgttttgcaccctcttaaaactacattcctttcccttcagcattggcatctctgtccttgtgtattacctgggatgactattcagttaacaaatgctttcttcctaggctgtgagcccaagtttgttggatgattggatgggggcacgttgtgtgagagaaggatcatggggtagcatctggctctcttagaggtgtgtgggggcgtgtgatgcctgccaaggcgctttcgttctggggggttctgtgtgtttgaagcacttgggttgtgtgtccctgaggcctccgtcacgggcaacctcattccttctctagcctccatcccctgccccctgcccaccccaggcctctggagctggctccctttcctgctcactctcttttggccaggattttaacatatatcacaggctggtaggctaagagcttgggacttcccctcaccacactcaaagcctttgatcttttgctttggaggtaacatcaaaaggaaggctgaggaagacagccaggctgtgaagttcaacgttcaagttaatagcttgactgaaggttgtgctgcgttgtggcagcatcaccgaggctggagtaaacagagtgattctgccacattttcctggaaatgcaccccaatattggaagagggcttcttttacattcggaatgaattcaggctgtagtcagagctgcttttccctttccccattttccttggaagtgtgaaaacttgggggagaagatgtttgtaggagggcatgatgaggggtagaggaagcccaaagagaggatctggggaggggaagccccatgggatgagactctgaagttatccttgccccgattccgggacttgctatctgcctgccttttggcgtggtgtctctgtgcccctgactgttcctgatttagcgaggtgtttctgaattctgatggaattcaaagaagcctgggcaggcaggcagcttgacttggggcttggggaagygtgcagcccagacatagcagcratgagagggcctcagggctgagggctgagatgagaatttcatcacatgcaaaagtgaaagcgacccatcgtcttctccacttgatctcttgctgagctttgcagacactttggttgttgtttaatttaacattttctgcaatgctccttttttcagattttcatccaaagctctgtatgagaggttttcaaacccattttggccctgattctatttggcatacgattcaactctggggatggtcatcttccccacacctgcgttgggtacctttttggtgtatgctcagagcatccttggacatcttcctggtcagtgtccagcatcgtgaagctgccctttagcctctcagtgcccccagatacacctgtctctctgcgtagcggcactcagcgtcacctttctgtggggtcttgagaccctgatgatatcagcactatgctgccagaattccccttggattctttagtgtggcttctcaagcatcccttatcgctataacgccttcatggtttttggcataactgtatactacctgtgctattatttatttgatgcattcaaacatttgattcatttatttaaactcagtctcactgtaatccttaattaacacctgtgaaattataggtttgatgtgctacttatttatttattttttaatacacattagtataatcccgtaacggctaaagtaacactttgtactgcctaaaaccatgcttgggagcgccacagtttgagaaagtgcttagccttcctttccctcctttagtgacttgtggtttggggcatctgttgactcctagggctcccttgttcatctttctgttcctargctcagggattagttgctcaacccaggtgtggcctcaaaattctgctcatggaatagcctcaggcttctataaatctcatcttttttgttttgttttgtttttgtttttgagactgagtcttgctctgttgcccaggctggagcacagtggcgcaatccactgtaaccattgcattctgggttcaagcgatcctcccatctcagactcccaagtagctgggactgtaggctggtaccaccaggcccgactaatttttaaattttttgaagagatggggtctcactatattgcccatgccggaagtctagttttatagtgatgagaattcatctggggtccaaggggccctcctgtgttgcttcctgtgctcccctctaaataaagatactccttccaagttgtcctgattttcaggtcatcaccattttttgagctggatggggaagttggcctggagcagccttccctgtctccgagttgcattacctcctgagaggtctcagcaaatcactgccatctcttgatcagagttgctggcaagagtcctctgtggttctaggttttcagccctggagactctcgcctgcattcattatacatgtccttttggtgccttgttgaaaggcatctcctgccaccgaagggtgtgggcttctggaaattctcagaaaacacaatatgccagcctccagggatgggtctccaaagcttcaggaacatatcctggggtgttgaggaaacacccaccttaaaatgttcctcaagggggaatgttactgcttgccctaaccctctkgagctgatgctcacatgacgtccctgagatgggcttcttttttgcccgtacttaaagctgtaaagggccattgtcaaatttgtttagcttctcaattcatgttccttagaggatggtaaattaaagttagcattcctggacagagcctttcatacattgaagacaacccggtgagtctcaaggggagaggtaagggagagatgaaaggttttctccaggcctgttcggcagcatggactgttcttttaggtaattaagggagaccataaaagacaattgtgtgagtccatttacctttcacttgggggtcttaagtctttggttgggcttctttaaccctgtgtgtcacccacgggctcctatgggtgctgttttcattgttccgttatctagttggctggaacacacctttggggattggagaatggagttctgggggctttgggaactttgagttttcctgcaatgtcctatagaagcttgagtctgtgattcctgggcagggccttctcctagttgagtgagattggtggggcagggcagccagttagggggtcatgggagcaggtgtggaaaaggttatatgtcttagtaattctttgtgacaatcaccctcattcattgatatcttcttcctatcatgtattagggcagtggttcccccaatgtgctgcacattaggttcacctggagagcttttataaaaatgccaatgcccggggcccactttgggaggagccaggcatcagtaatttcaaaggtctctaaatgatttacagtttgggaatcaccgtatgaggatagtaagctctgagtcctatgcgttctgtgccgaacacccatgaagcagtcttccaagcattttacctgcatcatctcaattctcacactgttaaggagatagacagtatcatctccattttgtagacaagacaactgaatctcagagaggtttaagtctcaggacaccaaggtcattattaatcagggggactgtgattgctccctttataaaatgtaggagatattgtggagtacggttgagaaaccattgcaatagttttcttactttgttaagaaattaggctgggcgtggtggctcaggcctataatcccagcacattgggaatccgaggtggacagatctcttgagctcgggagttccagaccagcttgggcaacagggtgaaaccccatctcgactaaaaatacaaaaatattagccgggcctggtggtgtgcacctgtagtctcagctacttgagaggctgaggtgggaggatcacctgagtccggctgcagtgagctggcattgtgccactgtactccagcctgggcaatgagagtgagatcctgtctcaaaaaaaagaaaaaaaaggaaattagtggtggaaggtgactttgcatctgggcgtatctgcctgcagagttggtgtccttaccttgaagaaaccctgctttagttggagtatccttaatggttagtggcaggaggggaggagtggttcctgggagactggaacaaaatatggtacctgaatgcttaaggcttggcagatgagcagtcattttcttacacagagcttaggaaagggcatccaggtagaggaatcagcatgaacaaaagcacagggccatagagttctcagaaggaaagatggggttaaccggagccaagccagagatctggtggtagtggggggtttccaagctagaatggttgtgtggtattctgtcctcaggggctttgaactstgtgtgctaatgaggcctcaaattctctggggctctggttaaaatgtagattctgatatcagttggcttgggtggggccttgcatttctgtaagcccttagcagttgcactgctgctactaccgtgagtattgctgttgagcattactaccttgagtattgctgtcaagtgttactaccttgagtattgctgttgagtattactgtcgaattttactaccttgagtgttgctgttgagtattactaccttgagtgttgctgttgaatattactactttgagtattactgttgagcataaccactttgagtattgctcttgagtattaccaccttgagtattgcttttgagtgctactgccttgagtatcgctgttgagtattgctaccttgaatattactgttgagtattaccaccttgagtattgctcttgagtattaccaccttgagttttgttcttgagtattgctaccttgagtattgctgttgagcattactaccttgagtattgctgttgagcattactaccttgagtattgctgttgagcattactacctcaaggattgctcttgagctttaccgcctcaagtattgctcttgagcgttactgcctcgagtattgccgttgagtattactcccttgagtattgccattgagtttagtcctgtgagtattgctgctactgcgccttggcaatggttttcaaactttgcaacacatcagaatcacttgggaaacctttaaaattctaacgcccaggtcacatcccattccaactagatcagaacatctggggaatgcragccatgcaccagtagttataaaacctgcccaggtgattccaaagtgtgggaacctttgagaagcactgctttaggggttggaatagtcctggctgaattttaatcagggaagactgactgctccgtttatgaaacgtaggagagtggagcagggttgagaaaccatcgggatagtgttcttactttgttacgtgagcaatatttgttgagtctctgtggtgggttctaggggttcagaggacagcagtgtgctgctaggatggtggtctgaactagtggaaaggcactcaaaggaagaaagacagaattctaagaggagaggaattttaggaaggagatacccaggacttttgaattacaggtaatttgatcagaacccaaaactgaaatgtctctgctctgtgatgaaagggtttgctggcattgagtaaggagctgcaggaaggcctttaacttgtctccaggtctcttaacagctttgtcatttacatacaagcacctgcctggctaaaccattcatttctgtagcttccttctggatctgtctagggaatatttgctttgcatattttggggttatcttaagtgtttgaaggaaccaaaatatttttcttaaaaataacactcaaatgtagttcacatgattaattttgactgatttgtgagaatcagtaagtgctgactgactgaggcgccccacacatccggcttccttctgttactctacgcgtgttgctgaaacttaacgaacccatctggggtcttctcgcctggtgcagtccggcccagtattcatactgaggtttgcagtgggagaaaggaaggtatttatttgtaggtcaccaagcagggcaaatccagcagctcacgcttaagacctgacctctcccatggtttataagcaagtggttttttttttttttttttttttcagactgagtcttgctctgtcacccaggctggagtgcagtggcgtgatctcagctcactgcaacctccgcctcccaggttcaagcgattctcctgcctcagcctcctgaatagctgggactacaggcgtgcgcccccacacctggctaagttttgtctttttagtagagatggggtttcaccatgttgcccaggctagtttccagctcctgacctcaagtgatcctcctgccttgacctcccagagtgctgggattacgggcatgagccacagtgcctggcctgtaagcaagtgtttttaaagaaaggggtaaattttagggaaacagaagttctaggcaaaatggtaaattaatacagggaggtaagacattggtttggcctaaaaagatgggatattttgaagtgggggctcataggtcataagtggatttaaagatttttttggtttgtaattggttaaggaagataagctttgattaaagatttggggtcagcagaaagaaatgttaggtctggctcgtgggcatgtctttttmtaggcccctccttggaaagaactttagagcaaagaaaggcagttggagcttagtccccactttctcctgatctgaggtctacggaccactggatccatttggtggggtccatctttctgaaaaacaagtcagggacatgtattgagatgatattattggtatttatagggaaccaaacaacgccccatgactcttttttggctattgttttaagccactgtttttttttgtttattgagttgttaacttattttttaaagctagctagctgcctggaatttctttagaaggaactgaagtttttaaaaatttttatgttggggggtattgccctgcaggcccctaaaaggggtccctgcgctgtctcaaaacttggatgcaaaaagaagttgagttaacacaggaggacaggggtagacgcaccaagggcatgtgcctcgagtgcgtggtccttattaagaagggtggttagacagggaatgggttagttccyrggtcggcattcagctgaaacagtgatggttaaaattctgaaaaatgtccacgctctgcattctcttcctaacacccaggacccagtaactataaagccccctaccctggggcatagcagggggcttcagggacccatgagaaggtcatctgctgctagttacactccttctgggacctgatttagacagtttggtggtagttttgcgagggttaatttcagggccaaggatgcttctagaatggaaataccttcttgacattgggagctttattggttgattatgtcaatgtgagaattcaggaagcccagtgctaatcctccatcctaaaaggagtagattggctgggcgtggtggcgcatgcctgtaatcccagcactttgggaggccgagggggcgcggatcacctgaggtcaggagttcaagaccaacatggcgaaaccccgtctctactaaaaatacataaattagccaggtgtggtggtgggcgcctgtaatgccacctmctcgggaggctgaggcagggagaattgcttgatcccaggaggcggaggctgcagtgagccaagattgtgccactgccctccagcctgggcgacagagcgagacttcatctcacaaaaacaaacaaacaaacaaacaaaaactaaaaggagatttcctccttctgtcctttatgggagacttcaaccttgggaaagtctggaatccttggacattagaaattctgaagttttggctggctgtagtggctcatgcctataatcccagcacgctgggaggccgaggcaggtggtcacttaggccaggagtttgagaccagcctggccaacatggtgaaaccccatctctactaaaaatacaaaaattagctgggcgtggtagcggacgcctgtaagcccagctacttgggaggctgaggcaggagaatctccagaacctatgaggtggaggttgcagtgagctgagatcacaccattgcactccagcctgggcaacagaacaagattccgtttcaagaaakcagaaactctgaaatttttgcctgtccaggccacatcaatcccattcctctgctgtctctgcaggattctgtgaggaataattagttaatgtttgcagagcactttgaaatcctcagatgaaaggcaccggagaagcacaaagtattattatttattattagcttgccccagaatggaggcgcatgaggccctggcagctccctgcctcgtgccaggtgtgatcctcctgctgggcttttcctgcctgatgagctttttttttttttttttttttgagatcaggttcagctctgtcgcccaggctggagtgcagtggcatgaaaacagttcactgcacacagctcactgcactgcagcctcaaacacctgggctcaagcaatccccctgcctcagcctcccaggtaactgggactatatactacaggcatgcgccaccactcctggctaattaaaaaaaatttttttttgtagagatgggggtctcactatgttgcccaggctggtctcaaactcctgggcctcaaagatgccaaaggttcacaccttggcctctcaaagtgctgagatgacaggcgtgagccactgtgcctgtgctcaattgattttctttattaaagaaacatggaagaaagtgaaggatgagaatcagtaacgtaacgtgtgcttcagattgtggacaagtgatgtgaaggaaacacattggtcccactgtggtgacagagcaggggtttccttacctggcaaggttgcggctgccattccttggggtctggggttaagaccatctgcctgagggtaacgcagtaataaatcagtactaaagggcgtactaaagtactgtattgctaggctaggccatgcttggtgtatttttttttttttttaattgagacggagtcttgctttgttgcccaggctggagtgcagtggtgtgatctcggctcactacaacctctgctgcccagtttcaagtgattctcctgccttagcctcctgagtagctgggattacaggcacgtgctaccatgcttggctagttttaaaatatttttagtagagattgggttttgccgtgttgtccaagctggtctcaaactcctgacctcaagggatcagcccacctcggcctcccgaagtgctgggattacaggcatgagcctggctggtgtatttgttttaaatttaaagtttactaaatttaatgatatctggggaatcagcttgcttcctggggatctggatgtacttgaggtgagagggtggggattcagaattatcctttctatcgcagcatgttctggattgattcatgtaggtctcaagtgtgtgtaatatttcatttctttgtgcaattttggcatgccgaggcgggcaccctgaagctccggcagagcctggagacagagtggggagctctccgctctttcccttccttcatcccagctgacttcgactggaattgaattcatcagctgctggagagttgttttatttgccctgctggtggagagggaggaaaggaacatcatggggccaggctttttttttttaaaggaaagatttgatttactttcccccttagtagcatgatgggcacctgcacccgccagctaatcagaagccactgtcccctgaatgcctccgctgcccaccagatcctgacagcatcccacgcgggagcactctcgtgtgcccctggcagcttctgctgcctggcagttctctaaacttgctggtgtctctctgcccggaggctcagaaacccagaggactgaccacttcttgaggctcatgtccagtttgcaaagagcccccagcaagcagagaaggggatttttgtaccagcgatatctcttctccactcctcaacacactcctttccactctgtctcctataaacatggaacagccaggaatactcaaatcctagcctgtcatgaagccaaaaattgatagagatctactgtccagaatgatttcttatagtgaccctgtgtttagttggtaagactttcttaaaccatgagggattctggtcccacagggcagtaatatctggggcagagcctgagacttttctcattgatttcctctgtgagccaggagtgactgctctgatgcagggtgctgtgtggttggtagaagctggcgttatcccattttacccacgaggaaacaaatgaccagcgggagctcagcatcccatgtgcccacttcctcctcgggtggacttttcacctgcccatgccgtcttctttgcaaactttactgcagtgacggagacatctttaaatacaaattcttgggggaaccctgtgttccttggctggagcctggctgggaaggaggagggagcagagggctctcttgggtgtggcctattgcagttgagccagggaaaggctggtccactggagacaccctctctggtcacygcagacttcctgccctccatccagtgtccttctacttgcaggatgtgtgcccagcagagagaatctctgaagccatgtcattattgggataacattcctgtcccagtcaccttatttctcagaaaaaggacaatgggaaacaagtttttattgaatcctatgctgggcctattaatggggtctcttacttttcatagcagcactgcaaacagagttacgtttctattcattttatggattagaaagctgagatccagagcgggcagatgtaaayctggggtctttaaaatgcatcctttttgcaaacaaataaacttagtgtattaaragggctggagagagcagagtaaggtaacatttgggtggtcagcatgtagttctgggtccccacagtggagatggcacagtgctgggtgctgggggaactatggtcactaagagacactgaataatttaatgcatgcccctgattccatcactgactgttgaggtaacacatacatttatattgtcagtggtggtgatgattacatgagctgcgtaaagcgtttgaccagtgcctgcacataacatagtaggtgctcaataaagatcacccactcttaagaggtgggaggaggtgaagtcatctttctggggagtgttgccctgttgttctctgctgcattctttctgtcctttgggctccgagaatgctgggttgggcagtgtgagtggtcttctcaggcctctgtgacatgttgctttcatgaaaggttcccctctagccaaagactgagtggtccttgcaggctttctcctgagtcctttttttttttttttttttttttttaaagacagagactctgttgccagrttggagtgcagtgacgcggtctcggctcactgcaaccgctgcctcccaggttcaagcaatctacaaaatgcatctataaaatgatgcatcagcctcctgagtatttgggatcacaggtgcccactaccatgcctgggtatttttttgtatttttagtagagacagggtttcaccctgttgaccagtttggtctcaaactcctgacctcgagtgatccgcctgtcttgacctcccaaagtgctgggattacaggcgtgagccactgcacctggcctctctcctgagtccttttgtttgtgcctgctttggggattccctctggctggggtggactgccgggatctgtttgtccagtgtacatttcctggtcacctagcaccggccagctgcggtgctgggaggaacagggcctggctctgggaggcagctgggagagtcaggaagtgaagaaagttcttgtgggtgtgatggtggaaacccaagcagcgtccagagggagcacaagagggagggacaaatcttgggagggtcccgggccaatgggacccagtgtaagaaattgcacctgtcctggcagatagagaaggtggaagcagtgaatggtagagcatcctcactcttctctctgccagcaagcacctttggggaagtcctcacggacaggaatgtcgtgtgtcttggcttgagatgtcaaagaaacatgttggacacaccatggtgacagagcaggagtctcttaaccccggcgtggttgaggctgycgttctggtgggatctggggtcagtcaggggttaacagtcgctcctgcttgcctgattgacacagtaataaaggcagtgacaccaaactaggtctcaggaatgtgtcctcgttagaaagactcactaatggttgtgggggggtggcccatgagtccttctgggtggtggcgagaagtaggggaccctttgggctttgccctttttggtcataggacttcactccacagacataattgaaccgttgggtttctgcagccaaattcaaatgtcaccaatcttggtcacccctttcatctcttgggtcctctgtaagttatagctatctgatagtttactgaaaaataaactgaaaatatgttttaaattgtactttcgatttaaaataatgtttagagacaaaaaaaaagggtccaatccacttggagaaaagcattgtcaaaggtggttgatttttttcttttgctgttttaaagtggtaagtggatgagtgttttggatatattgatttttcaggtgtgcaggcggtcacatgaacagctgacatttttttttttttcatgtggacttcagccagtcttgacacctgccccttaacgaaaagtaaaccatcgccttgtttgacagtttaagtgcagtgatacggatggaggcaggtttacgttatgttaaaggcttgacaacccagaacccccctgttggtttctttgttgtaacctttgagccggtggcctgctgaaatgtcacctttgcccttctttaaaagcaggaataataggtggtgagtgggtggatgcctcttaaaatactggaaagtgctgtggcccgagggtaagctttttagaagtgagtgtgtgtgttgtgttgttttaattaatgaatcttctgggcctgaagataatgaggtcagtgagggcagccatgctgcctcacagctcaccttagggtccttgttgtccagaacgtgcctgacctactggaggggcctgggaatgcttctttgattgacgtgggtaggaagacagatgtggcggcctccatgctgatgggaggcagctgggaagaaggtmatgggcaccatctcaggagtggcagagccacctccccctctcctcaccccgtgtgtctggattcttccagctgtgtggtccttcttcctgcctggaaatgagcatcctgcagagctcggctcctgttcacaccctcctcctaaccccctactctccctctccctttcatccagggctggaggaccagatgggctttacctgatggagtgtgctttgctgacatggtgcaaagagccaattcctggttgcaaagaggcagctgggtgcagaggcggggtgcattcctgtaataataataacttgtgtttttataatactttacagtctaagtacttttcaaatacttgacctcatttagttctcaccacagccctctgaagggatattactattaccttcattttatagatgcgttaaccagggcttgttttgggaggtagagggggtgtgagggggacagaggggagggaaccagtgttgaatgaattctgaggccctgccaaagcagccagctagctaggtgttgtttaatggactctttgcatctacagcatgagggaggtgggatgaggggaaattatttcacaataactgaaggtcggagagactaactctctgctcattgtcacacagcagttgagtgccagctgggatttgtcacccaggtcacctgactcctaagccctgtgatcgttctcttctgtctctagtatacccagcataatgcccggcaaagtgctggcatcaataaatatttgtcgaatgttaaatgaggcttaaagagaaccattcatgcttggcacaggggcacagtgagacaaacatgtttcctgccctcgtaaccttcgcttccaaattctgtgaccttgggcgggttgcctgagctcttttccagctcagtttcctgaaaactcatccggaaaatgggtaaaatatcagagtgcattctgtatggtaagactgcaaatgttagatgattctgctacttattattgttttctttttctcaccacacaccttccctttttatgtacacctcctaggaagtaagtttctgataacatactgcattgttggataacagcaacaaaaagcacttcctgacattattgcccaaatcaccaaatgaggcaattaccaactttggaataagaatagcaacggtggtaagagctgacatttcttgagcgcttgccatatgctgggtgtactactmtaagctgctgcctgcaattatgatttgggaacaactctgaaagtagttacctcccattttatagaagagtaaactgaggttcagagaggttaagtaacccccccagggtctctcaggaagtagttggtggcctgggattcaaacaccagaattggtctgacttcccactctttaaaccacactcaaaactgaactctccacgtgtgtgtgttctgggcattttcgcatctcccttggcttgttgacagcgtggacttttgctttcccattctcatagaacatggccagtgcaggaggaggaaatccacactggtctttggactgaaccagaggctggcgatggtcccgaaacagggtgccaagtggctgacccttgtttttatgccttgcgctggtaagcytggggcaccaggagttctttgaatttctctttcttgactgtccacgccttctttaggcaatcttttaacaggctatgttttaaatcttattgacatctctgaagaaagaggaggaaaaaaaaatcaagacatggccttagagaagtgacaggttttctttgagaktttgttttctgttttcctttttattttgtgcacattgcaaaacctctttgggatgatgatttcgtgtggtttcttggtagcccttgggcagctgctgccaggtttcacccaaatgcattgtgaccccctgtttcgtgggacggctttgcctccacatggctgattgtgctctgtgtgtccgctgtgggcagagtgtgattgtaagaatcagaattctgctgggcttgcaagcatttaaaaaatctctataagtttgagaactggttggaagggagagatgcagcgacttagaacacccggcctgcagctgagcttccgtgtgcctgggaggagcccatatggagaaacaggaaaattccacttcaccagaaagctggggaaatgagtgggagtaggggccaggctggttaactaggaagacttktggtcactctgctttacttagcctaaagtgttcatttcccccttaagcggtggttaatacgcgtatctgcagatttactttttggatgatttaaaatcttgcaacatctcaagggattgtatcctgatgatactgattatattaataacaagataatagcttataatataatagctagcaattaccaagcacttaccttacaccaggtacaatgccaggcatttgatccttacacgaactctgagagatggctgtttgtattcccattttacagatgagggaagctgtgctgagagaggtgagttcatttgcccaagctcacccactttgagatggtctgcttttatatcctcttagcccaattcttttggatgtcagcacttggcatgtattaggcactggataagtgttttgttgaatgaacaaaatgatggaacttggatttgaacccaggtctgagctggctttgagtcttcagaatagtaggtccaattagtggagtgggggctcagtagyccaaagggaaaggagcaaggagacattgtgggggccgagaagagggcttctggggtgtttcctgggcacattggcattaaaggcatagtgtgaagtgccattcaagaccatgtgctggattagtgtttttcctctccacttgaggtgcttgcgattggctttgtgccccggtgtctgcaaagtgagttgggctgaactcaggaagaccttttggttgggatgactgtgtattcacctgcacctgagtagggactgagtttcacttgccagttttaccgcagcaagacctcgttaagttggcttcctctcatttaggcatttgggaaactttaggcggctggagtttaattctcaaggcaaagccccttttcaagggacatgaagaaaggcagagggatatatttaaaatacctgaatgaactgtttctttttctttttattttttgagatggagtctccctctgtcacccaagctggagtgcagtggcacgatctcagctcactgcaaccttcacctcccaggttcaagygattctcctgcctcagcctccccagtagctgggactgcaggtgtgcaccaccacacccagctaatttttstattgttttattttattttatttattttttaattttttttttgagacggagtctcgctctgttgcccaggctggagtgcaatggcgtgatctcggctcactgcaagctccacctcccgggttcatgccattctcctgaatcagcctcccaagtagctgggactacaggcacctgccaccacasccggctcattttttgtatttttagtagagatggggtttcaccatgttggccaggtctcttgaccttgtgatccgcccgcctcggcctcccaaagtgctgggattacaggcgtgagccactgcgacttgcatgtagacagtaatggcaggtcactatcagtgggtctgttaatcaggtgtccaacctggtgctgggcttggtggctcatgcctgtaatcctagcactctgggaggccaaggcgagtggatcatctgaggtcaggagtacaagaccagcctggccaacatagtaaaaccccatctctactaaaaatacaaaaattagctaggcatggtgggatgcatctgtagtcccagctactcaagaagatgaggcaggagaatggcttgaacctgggaggcggagattgcagtgagccaagatcatgccactgcactccatccagcctggacaacaaagcgagactctcacaacaaaacaaaacaaacaaacaaacaaacaaaaagtcacttgcttctttttttgcttgcttatggacataaaccctgtaaactatctcatacatcatgggagtgagtttgcagtgggtagactgctattcacaaactcatatacatcctatgaaggagtacaggttaaataaccattatccaaaatgcttggggctgaaagtgttttggatttttaatttttttcagattttggaatattcgcatatacataatgagatatcctggggatgggacccaaatctgaacaggaaattcatttatgttttatataaacccttttttttttttttttttttgagacagagtttcacgcttgttccccaggctggaatgcagtggtgtgatctcggctcactgcaacctctacctcccaggtcgaaacgattctcctgcctcagcctcctgagtagctgagattacaggggcttcccaccacgcacagctaatttttgtatttttagtagagatgaggtttcaccctgttagccaggctggtctcgaactcctgacctcaagtgatccacccgctttggcctcccaaagtgctgggattacaatgtgagccactgtgcatggccttatataaaccttaggtaattttatacaatattttaaataatttttgtgcatgaaacagagttttgactgcattttgactgtgactcctcacttgaggtcaggtgtagacttttccacttgtggtgtcaaatttcagattttgaagctttatataatgagatagggtcttgctctgttgcccaggctgaagtacggtggcacaatcacagctcactgcaaccatgacctcctgggctcaagtgatcctcccatctcagccacctgagtagctgggactacaggcatgcactgtgactggatttttttttttttttttttttttgagacggagtctggaatctcaagtctcgctctggtgcccaggctggagtgcaagtggcgcgttcttggctcactgcaatctccgcctcctgggttcaagtgattctcctgtctcagcctcctgagtagctgggattataggcgtgtgccaccacttctggctaatttttgtagttttagtagggtcggagtttcactgtgttggccaggttggtcttgaactcctgaactgaagtgatctgcccaccttggcctcccagagtgatgggattataggcrtgagccaccgtgcccagccttggctaattttttatattttttgtagagacagggtttcgctatgttgcccaggttggtcttgaattcctggactcaagcaatctgcccaccttggcctcgcaaagtgctgggattacaggtgtgartcaccgctcctggcctgaagcattttggatttttgggttagagttgcacagcctttactgttattatcctgatgttattatccacattttacaggcaaggatctggaggcgtagagaggtaaaatcattttttcaaagccccagaagtactaagccgcagattctgaatttgaactcaggcattctgggtcagaattagtgaggttttaagttaattttttttttttttttagatagagtcttgctctgttacccagggtggagtgacagtggtgctatctcggctcactgcaacctctgcctcccgggttcaagtgattctcctgcctcagcttctagagtagctgggactacagacatgtgccaccacgcctggctaatttttgtatttttattagagatggtgtttcgccacgttggccaggctggtcttgaactcctgacctcaggtgatctaaccacctcggcctccagaagtgctgggattacaggcgtgagccactgcgcctggcctrccccctgtcgcccaggctggagtgcaagtggcacagtctcggctcactgcaacctctgcctcccaggttcaagcgattctcctgcctcagcctcctgagtagctgggattacagatacccaccaccatgcctggctaattttttttttttaagtatttttagtagagacagagtttcaacaagttggtcaggctcctcttgaacttctgacctcrtgatctgcctgcctcggcctcccaaagtgctgggattacaggcatgagccaccatgcctggcctaagtttggtttttaaccatgctgctttttctagacccttctgtcagccagctccacaatggtgaatcagggagttaggtccgtctgtaagagagggcccaggagctgggtcagataggtaaagagacattccttagttcttatcctctgctaccaagccatttcttgggatcaagccctctttggcctgtgtcattccacctccattaagttcagccttctttccttctttccacatctttccactgctgttgaaaacttgagacctgaaatcccatctcctgaattcctgggagctctagaagtggagatggccaggttctgtggtcagagctggttgggattacaaataaaccaaagcctgggaaactttcttgctattaatagcgcagaccttttggggagggaatacccaaactcgatgctgttggaattgattttgcctgtctagatgacatactaatgagctaagtggttagcttcggatcattattgctctttcccaagccaagttcttttaaagactaaaaccacaaaagcagagaacgagttgggttagagaggcatagtggctgggtccagagaagggagagtggtcagccctggccttaaacatgagaaaataaaggtggtccttgctttggaatgagttagtggtgctgactaattcaactggtttttctttttctttttggaagtggaatttgatttggtgtctggattttgatagggccatttatatttcttcagcactttttggttcttgcagaaagttacattcctagttcctcaacygcttatttctttttggtttttgaagcaggaatttgatttggtgtctgggttttgataggggtgtttatgtttcatcartgtcttttggttctttcagcgtttctctccttgtctgtcatgtgtcagagagggtgcctgtcaacgattctctctctccagggagaaagtctttcttaaaacagccctaagatccttatctcctcaaatcacccactttgatgataatatccattgttctcttctctgcttcttggcatattctagtcagtctatgtatacaattaaaaaaacaaaacagccctctgtgtccaaagtgcttggaatatcccagtgtttcacaggagactttggaagtggacaaaactgtatttccttccccaaatgaggttattgtgctcgaaatatctcctggtagtttattaaaggaaaccgcaggcaggggtaagagaggcagtttctacagcctgcaaccctattatcttgcctcttcttttcgaccctccttcctccctctcctcttctctccccccctcaccctattcaacccagccccacatgtcatgccgtccccaggaggtagccctgcagccctgcttctctgggatggtctgttcttgccacccgtcccatggaacgtgaagaaggaatttggggtgtggacttccttgagtgactaggattagacccgtcgggtctgcagtcagacgagaagcgtgtgggcaaagggaactattgtgtgaggcttctctggacagaaagcctgccttcatcttttactgtgcctaatggacaattgagacattcagcttatgtctgaaaggaaagtgggccgggatggtctagcagacctcccagatgaaggcttgtaggaggagcaaatagagacaaggattaccaacagggggaacaactggggcagagtcctgggagagaatgtttatttccttgctctctaggagggatttggaaagagccataatcctgggttaggagtaatttgttacagcaagatgatacttgagtgacaggctgcttctggctgaggcagcaagacttgcatgcaggggggtcgtggggcctccagaaggtcagcctcccgtaaatcttcaccctggctttggggtttgttcctccccaagcaaaattaaccagaggcactgctgacctttgggcttcctgggtgtagcgttacgaagcatctccacatgtttgtcacagctagaatttgacaataaaaatttggacagggagaccctgccagagccactgacctctttccaatgtgacaaggggaaaaaaaacaaaaggaaaacgcagcacggggtgcggtttcagttgaagttggaggacacggagcccagcctgtctcgcatttgctgtctatgtagactcactaaagcaagttaattcattgctctttgaccgccaagtctttcgttgtcttttgttgttgtggaatgggggaaagaaatacagaatggggaggagaacctaattagaaaaatcaagccttgagagctcccagccatggagaaagaaagggattttttagaagttgtgattttaatatctgctgcaatctgatgattcatggatttaaaataacccttccaggtcaccaggaccctgttacttgctggctttgtacctctcaaaggtcatttgttggcttcgtctcttaacaatttccatggtagacctaaaatttctggctgtgaaatcccctgtgtagtgggaagaagaaatagcaaatcttagctgccttggacctgatataattatttgtcttcatttacatggttyatccttcaaggttgaataaatgatgtgggagctagtcaaggggctttaggtatgtgatttcatgcctacttttttttaggtagagaaactgaggtcacagggtactagagaatggactctaagattcaggtttctgaattgcctgtggttttgttgactcaactgctcttctgttgttttttagccacatgccttgaaacagtcctctttcccatgtttcttcatcagcaccattaacccaaggtatactgtcctctcttayctttcacaaggtcttggagttcccatgcctttgtaagcatccctccccgagattcagcaccaaccaaaatcacatttggaaaaattgcttgtttcccaagaagctttggaggatatgattttgtatagaacgggttcacaggttttctgttcattcttctatggtggagtgtgtgtgtatgtgactctgtcttctctccattcctctttttttttttttttttttgagatggaatttcgcttttgtggcccaggcttgagtgcaatggcgtgatctcggctcactgcaacctccacctcctgggttcaagcgattctcctgtctcagcctcgcaagtagctaggattacaggcatgcgccaccacgtccagctaatttttgtatttttagtagagatggagtttcatcactttggtcagtctggtcacacaaactcctgacctcaggtgatccaaccgcctcggcctcccaaagtgctgggattacaggtgtgagccaccgcgccaagcctccccatccccttttatctcttaaatgaatgtggtcaccatcaaagatggtgcctgactcttttttgttttcagttcatcttaaattcacatataattcacacgtcataaaatgtacccatttaaggtgtacagttcagtggttttttagtctatttagtatatttacaagattgtacaaacataccagtatcttaatatttttatcatccccaaaagaaacactgtaaccctagcagccagtctctacccgccttccccatagctcctggcaatcactaatttacttcctgtctctatgaatttgcctattttggttatttcatataaaaagaatcatacaccatgaaactttcttcatctgccttgaagttagcatattttcaagggctaccatgttgtggcatgtgtcagtactccatttgtttttattactgaatagtattccattttatggctgtaccgcattttagttatccagctatcggttgagacttggtgcattcttatcccagaacataccatattcagctcccagtgacacccacattcattcctgggctgctccttgtcttccagctattttcctggtctcctgttgcctctgcctacttcagcatgctgtagagacatgggtagtaactaaaacattccaattaactgcattgtacttggcctttttataagaagcagtaattagaaaatatggtggccacaagattgatattaaagtgaaagattgtaaatacttttctgcctgaaggtagatggcctctggcctgcctcttagtgggaggttcttccaggagcttgcaagcatccattatttgttagtcatcagcttagcggccaaggagcattagcctgtcttgctctgtctgctgaagactctgagagacatgggagggcaagggctgctccttttgaattcttccaatgtcttcatgtcctttaacctcctggcttagggacttgtgtgctggtggtggagctgacatttgtttggaatccacagccctttgggtgggactcaatcttggggttgcctgaagactttgagatggctaggtctgggcctcttttggtcactatggaacaagactgtctcagaggccagagtctgtctcaccagctccctgtcttgggactgcaccattgcagggtctttgccctcccctggagatttctcttcctgcctgggcacccattggccattctgcccgtaagctcagtagggtgtaggcaaaagagttctggcctggaagtaccaaagtcctgcgttctggtttcagtccctcataactgtgtataactaagtcacttagttttctgtgcctcactttcttctgttttaagatggatttggagattattggctttgaccacctaaaaaggatgtagtgacaatcaatttagaggtctaaaagagcctttgaggaagtaaaatggaatcttcaaatggactacatgctgattattgacactgccctagcactgatagttgatgttgactgatggtcagaattgcttggcaagttggaaaaaagtacgtacagatcctgggccactaccaagtttcatttaacagatctggagtgcatcaggaaaaaagtccctctaaacaagccagcaaggtttggatactgtgcaacctttttttttttttttttttccttttgagatggagtctggctctgttgcccaagctggagtgcagttgcacaatcttggctcactataacctctgcctcccaggttcaagcaattctcctgctttagcctcccgagtagctggcataacrggcgcctgccaccacacccagctaatttttatattttttggagagatggggtctcaccatgttggccaggctggtctcgaactactgacctcaaagtgatcygcccacctctgcctcttaaagtgctgggattacaggcatgagccactgtgtctggccctacttaccttctttgtgttaattcctgcaccattgattagcttattgtcccattgactgtgtctttagatgacttctctgggcctcagaatatctagtccatagctgacacagagcatctgtttaatggtaaatgctgcaggaatccatgcattggagtagaaagagttttagatcatgttcctcatttcttgctacagacttaggcaaagcgtggagaagaggttgtccaatgaagaaatgaagtgacatgccaggtcagtggcagagctaggcctggaaaataggtttccagactcttccctttctaccatacttttcctgggagtacgcactcgtaatttgaagagcgacttttgggagagggtggaaggaaggcctgggcctcagcctaaggggcccattggttgtgagaggagggtctggtgaaattccataccgattgtccgtgtgtgagctgctgtaccatagcctccctgcagaaccactaacctgtcaaatgcagaaatagttcagggacagagctgttaaaggattggcgggttaaagaaaacagtgaatcccaagttttgttaattggatttttttgtttgttagttatttgttttgcttcattgtcttcatcacaccaggggcctccttaaatctggtggaaaaatttccttggaaaacaattcagtgtttgtccatagacttgggagggagagatgctagatgctggaaagtcttgcttattactttggggacactgagatgttcccttcaccatgtactttgagacacacatcctggttgagttcaggcaaggatgcctaacagttgataagaaaactgggaaagatagaagggatttgtaaggtaagtcagggtgagtgaaaacacatccggtatgctggagacctagatgcttgactgccactcgctcctgtcacctcagtcaatctgggtcttgctctgttggccttagtttcctccttgctaacaggttagttccacctttctgcccatttattttgtagggttattgtggatgtcattctgaactctaaaataccctctaaatatgaagtgatattagtgctctttacattgttatgattaaaaatatttatgagaaaaaggttaactgtaaggatttcattgaaaatcttataacaaccaactgatagagatagaagataaggctattaaattgttcacacagatgccttgatatcctacctttttccccctatattccttttatgtgagaaatgagatagtgatttaagggaaaaacttaaaagagttccgactatgttggttttttttcccccaagtcaaccttaatatcttacttaaatctttttcttttttatcttttcttttctttttttcttttccctccctccctcctttcctcctcctccttcccttcctcctcctccttctgctgcttctctctctctctctcgtttccttttcttttctattcttcctttttcttttgagaccaggtcttgctctgttgctcaggctggagtgcagtggcaccttcttggcttattgcaacctctgcctcctgggctcaagtgatcctcccacctcagcctcccaagtagctgggaccacaggcacgcgccaccacactcagctaattttttttttttggtagagatggggtctcctaggctggtcttgaactcctggrctcaagcaatcttcctgcctcagccttccaaagtactgggattactggcgtgggccaccatgcctggcttgaaatttttctatggctttattctttctccaagtacagagtctacccaaccttctgagatctttggttttcttttcctaggtaactatagtacatacttatttatgttaaacaacagcaatcacacatttctttttctatacartcatgctttataggcaaataaagcctccgtcttaggctttctggattttttcaaaagatgcaattcctggagtatgtttttacttagagcaaagcagcctagtctcctataccttctgcatctgcagaaaagttggttaaacagactttgtaatgatgccccttacaattctgaagggacttgtgaaatagtttcacagagtttcagtgttaggtatatttgatcaatgctaacttttggaaaactttggtgcctgtatgattcagagggtagggcagaatattaaattaatcacaacttcttgtattttaaccattctgggtaaattgggattccgtgacgcccaggcaaaattatttgtttatagaagawgggctgaattttccatcgtccatttctgagaaatgaggtaggtttagaaagagacaatcaggcctcttctttaacagaaatgtttgtgtctactaggtgtgtgtcacaatatgagttcctgaagaaataagtgtccgctattgggttgtatacttgtacttcctattttcttattttgcacatttttctggtatttccctttctatggtgagtggcttctgatcgtctttccttttgtaaagtgtaatgatatgagaatcataatcgtggtgcggtcttttgtgttgcatatttgtagggggtcagtatgaatggcccgtggtgaggctgcactgaaagattaggagcagccaccttgatgcggaggaggcttagtgactttggacatgatgggctatggctggctatactctcagctttgggcgcataagcagagtattgattttgtatttggttaaaaccagaagtacaactttctggcaccagaggattaggaaaatttaacagcggaaagccatcatgaggatagtaaccaattaattcgatttttttggtcagacatggctcccacctgtaatcccagcactttgggaggctgaggtgggagggtcatctgaggtcaggagtttgagaccagcctgaccaacatggtaaaacccgatctctactaaaaatacaaaaattagcctggcgtggtgatacgcgcctgtaatcccagctactcgggaggctgaggcaggagaatcacttgaagctggaaggtagaggttgcagtgagtcgagcttgcgtcactgcactccagcctaggcaacagagtaagactgtatctcaaaaataccataattcgttttgtcttttctttacttttttctttccttttccttcccctctcccytcccctccttccctttcctcccctttccttccctttccatctctttccttcctttcttttctctctttctctctttctttcaacagggtctcgctctgaaccttttccagtcagaattgctcagggatttttagacttccattctggaaaagagggggtagttattttggtgagattgtggtcttgtggttagaccttgtgatgggggcctcagccaaagggttcaggatttttttccaagcttttccctcacaacttgagttaatccgaaacgttgctattaggccaccggacatgcttttctgcatgcctgtgttgggctgtttggattgaaggcccagcaagggaaggcaccctcgcccatctgacacaggcaggcctctacaattttattccctaaccagggcatgacaaactatggcccatagaccaaaattggcttgccacgtgcttttttctggccagtgagttaagaatgactttttattatcattattattaatattttttgagccaggttctcattttgtcacccaggctggagtgcagtggtgcaatcacggctcctgcagcgtgaaactcctgggctctagcaatcctcctgctaactttttttatttttgtacagtcttgctgttgttgcccaggctggtctggaactcctggccttaagcaatcttccggccttggccttccaaaatgttgggactacaggcctgagccgctgcatccagcacttttattatttttaaatggttgaaacacatcaagagaggaataatattttctgacacaggaaaatgatatgaaattcacatttcagtatctgtaaataagcttttattggagcacagccatgatacaagacatatactgactgcctgtggctgctttcgagttacaatggctgagtcgagtagttatgacagagattgtgtgggccgcaaagcctaagatatttgctgtctggcactttgcagaaaaagtttgccaaccctgccctgaacaaataaagggacaaattccacttgccccgtccatctgtggagcagagtcactgaaaggaaatactggaaatactggaagccacttggtgttttatcaaggatgtgaggtttcctggcaactttgtcgccatatcatcatcatcatcaccatcatcatcatcatcatcatcatcatcatcatcatcatcatctgccctttaagttttctgcttgtttagaaaagaaatttatacagagcccccagtagcagctgtaagggggcaggttcttggagcagcccatcctcaacattcttgctgctgatggaagattctcaaggatgaaggcccctctatgggagcaggatcagtctggctttagtagatgccaatttctgctaagactatttcctaaaggagcctctcctcatttgccttttctccctgttttcattgggggaggtggaagaggagaaaaataattagagatgctcacctttttctttttgctggcaatttaacagtcttttcagctgctttgattcctttcaggccattggtgttgtatatatttcaagatttgctcacaggtccaaagcttaacttaagctccctgagacatatcataaaatatgatttggggaaaaaccctaatgggccatgatcagaacattattattcaacaaaggatgaaatgcttaagccaagatggccttctttctttctttctttctttctttttttttaatgaaagttgagcagactcccgtccaacagttttcaatgtaggaattcccacagccccatttgattgcagtttgttgaaaagtttaatgtttttgtaggcaattcataatttccacattgaacagcctgagaggaagagagctggagcccactgttgtttttgtagtgggatggtgggaactttttttttccctcccccaaaaggatataaaactaagtcagatggttgggaaaacgtggcacagggttccagcccttttgtaaatctgagatgccccctcctttaggtcttcctttaggacccaacagaatagaaattcctgctgcttaatgtctccaggaaggaaaaaaattttcctctaggctgtaatagtacctaatttcctttttcttctctttatttatttattttccctattaataagcaccaattgtagaagatgaaggaagctgggaaacccatcacttttggagaaggttaatagcttcctttagaaaatcctgacataatacttatttccccaaaaggcacttcatcagcctgaatgccagttaagattcaaggaatgggcttggatttgtgtgtacccagcggttctgtggcatcaagttgcactgggaaggagagtttggggctgtcactgtggagtccctgcaagtcagcaggaccagggctgtcttcctgcaccatctggatttggttagctctctctgggcagtggggccgagtctcatttcctccaacaataatgttatataggcaatgatcctgggctgccctaacataattgaaaattatgtgtattgtaggcttggagtgctgaaatgtgggctcataaaaatatgtggtgcaggtagcctatggagattggatgtggcacacaatgaagcttttatgtaaagtaagaattataagtctccatgttaatattgtattatgagtatgacagttcttgggtgggtcctcagggcaggtctgtcaccttcaacaaagcccgagtttcctaattctacagagctggtatttggatgtaatcaaatcggttttgcaggtggccaaagatgaaaacttgtccaccaatccagctctccccactgagggatagcatgggatgtagatgggtttgactccatttggcatttttgttcacgggtttttatgagatggagaggtgagtgttggtgggtgtccattttggttggcctcaaggaaatgactctattgagtggttttgaccaatgcagctcatatagttatgtggtaagtgagaatgggaagaagttgggatgagatggggcagtttagattcccagagccctctggcctgggttacagatggagactggaaatatttactttagtggttctcaacttgagatgatactgctcccagagaaggtatttggaagtgatgagatggtaaggataaccaagrgggttcctgttggtatttactgtctgggggcttggagtcctacaagtccttcagtgtttggggcagactccccacctaataccctgtcgcagataggacaactcattcagtacacagatgaaaaaaacagagatcactgaagcaaggggagtcgatgcagggtcttgtggcaagatgcagacacaaccggactaataactaggttgctcaccacgggaggcctctaggtgaaagctctgaatttgtagcagacacacccacctcgtatagatcctagacgtcatgggaaaatcgactgtgtactttggcaagtagttcttgggcaatgatcttccagctttaggtataaccaaatttggtttgaatttgccaagcagtcgtatcttcgaggaactccgtcggctggcttgtggatggctttggcacttctgtctctcgtgggatttgtgcaaacccttctttctgtattatcctttcctgtcttttttctttctattgaaattgttctgaccatcaagacctaactctgtgcagccttccccagtctattgtcccagaaattctgtcatctttcttggcatttcctgagtccctgagtctctgtcacagtgtcaccatgttctgtcttgatttacctgtgtctgtaaggctcctcatgctggcaaaactccccgagagcggacatctttgtctctcctagtgcttgtcacagcctgtacacaaagcaagtagtactcagtgttcattgagtaaagttttctatagaattaatattaaaaccagccatttattttgcttgaggaggtctccgaaatgaccaaggtgtctccttatatcttatatcccctccaagcattcattaactgatggattagtgagttggccttgagaagcataaaggctcgtctccatgtgcttctaagcattgtgtctaagttctgtttggtttcctgagtgaaactgtcttaatgttaccaacagaagttaaatgcctaagagwttcttatacatgggctgagtacctctgtgactgggcaagccacctcacctcattttaccttgtctgcaaaatgaggaactgggtcaactcatygttcaaatctcactgaaagctaattgatcgcttttgacagaagtagctcccttgggccgtatatttatttcctagcttggaggaaggtggggacagacagaattratgtacacctttatttttatctctatggtaaacctgtgcatactaaagcattcctctggtcttttgagatgagtgtatacrttgtgtctggccctgtgcattttttaccaagaagtaagttttgttgagtaaacttgggttgtatgaagaactgcatgctcaccgtactcaagtagcttttgctacctaaaggacagctgctcatatgtacttgacttcctttaaagtgaaggatgatgacatttgaaaaacggaggttgaaaaggagcagatttggaattgatggtttcctaggacacttctggcttgagatttgtgttttactttcttcctttggaatagctctatattctttcctctccctccccacctctcccactcccctccagcccccaccaagttaaggtagtagtaatgaaatcattttttctgaagctaccctgtactttgaatgcaaagacaaaaaatacagttgctagtaacattaatcttctatatgtgtacttactgaacttgagctctgaggaagaccctattggaattgcatgcttttttatttttttaatgattatttgcatgcttgtatgtttttcagtttctgacccatgtcacagttatttcttgggctagttgttctgcatttactttctgaattcattgtttttcatttcacttttgtttcctctcgccagtatctccagatgaaatggccactgcttgatgtccaggcagggagcctccagagtagacaagccctcaaggatgcccggtccccatcaccggcacacattgtcgtaagtaacctcccagagatgatggcttcctttattgagggggtgaaaaagaaaatgcttttttgatgataacaggccttatttgtcatttttttctttctttaaacacattttctttggaaatattgttgggtatagtttatatctataaggtattcattttctgctattggaccttaatgattgtaacctacctggaaattttacaaacctttcctccactcttttccatgtatttggttaaaatctagccttgtgggctctagtttataggacacaatcaccatggtatggaggagactagaggtggtatcaaagcagttataaaaatacattcagggcaggtgaagtgaagaagagggaattagaaaactcaaaagggggtcctggatttgaaacttgcctattatcctctcccccaatttatcttaatatttgttggcaacattctacactaacattagaaaaatttcatctgggctggctgacttgtaaacctagagtagaaatgaactttgaaaggctaaaatggaatttaatctatacatccatggctttgaaagtatgtaggtttgatagagaaagcatttgtttttagtactaagagactacaagtgtgtgtctacatatatttttaatgtattttcttagggttttgtaggctctaagagtggaatttataaattaacctcttgagaagatagctcagccttatttgaagattcccttctatgtatttatatcatgagctggacttcatacttttgaaataattaatggaaggcatatttttataatgaatccatccatgacaggtagaattatgcaaagcatgaatcaatcatgggtttttcatttgagtatcacaaaatgttaatcataaatacattttgcctctatattgtaatttctaaaaattgcaaaataagtttcttaagtagaaaaatcttaagatgcattctgccattttgggctaactgcctccttattttggagcttgctgtaattgagcatgtgttatttaatgagttatacctctgtcatatgtgtgtgtttatatcacaaaataacttatttttataaaaccatattttgagtcatcatttgtgacaatgtcttcttttctctggtataaatgaggcatgtagaaagaagattgacatttgctagaagcttcccctttcctctaactccacaataaaatggatgctcataattacatctgctcctataaggtcaagatttcagggctggaagtgaccttagatcatttaggcccaacttgccctcaggaaaggaaactgaggcccagagatgccttaagtgaattgcccaatgtcacacgctgagtcagtggccagagcaaggcttggatccagttctctgctccctttccagagccttgtgatgtcttctctcctacaggaggtgaaaataactgctgtggctggttctgttttgctgactgtaaattgggtcatggtcagggacagtgcataggtgtaaagaagttgctggttgggggttctaatgcaggtttctccaaaagtgaatgccctgttaaaaaaaaattcttaacaaatatacagagattttttttttaaaaaagtgtgacagttctagacacctagagagtaaartgaagaagcctgttttcaggtttcccgcctccctgaatttcccagcatggtccaggctttgaaatttatttatctgcttttggcaatggttgatgggaatttcccacatttattttttagctacagagaaaggacattatctttaaaatctcttcgttgttctctctctttgagtgaggagagaagatgtgaatcctggcagtggttcagagtggacacagcccctgtgtttgtggcataggctctgtgggccccatgccagggagcagtacccccgtgtaaaggagtgggggtttgtccatttggatagagcaaagatcctccacctcaaatcccacaagaacagttgccacaacctgggccctaagcatctcattttcctatgtagaaattaatgatctggaggagatggsaaaacattccttccagagcctgtgtggattttggccaggggtgcagcaagggggcttaggcacctttttcctctgctgtgtcttagcaggcgtgttgaccatagcaactcccctggggcatacacaccctcttgtagatggagacctttgtccaaagcagccacagctggcaactgtctacaatcttttgggctttctgctgtgctcaaggggatctgggaatggccattgcctagaggggatgggctggtggaggaaggtgggctctgggagccggggagaagggaaaagccatgaatttggacaaaaggacaaatgtggtttacatttgtgaaatacttgaaygcttgtcatgaatggtgactttggttctatgagtcagccctgtgatggggtatttctgcagtcttcacctgacaccaggggtgagaaggaggatttctggggaggaggaaagagttgagggagataggaaagtagagtggaagaaaggccttgcgttgttgacctctatccacctggtcacctatagtttttgggattgaggatgcatacaccttgagactacaaatttatgattatatttttgctgaacataaggcaatgtgccaaccaaaaccagctgttctttggctggtacagtgtgtctttgtttgtaaagggtgcattctgaatggtggctgatacatcatttgggtctttgtacagttaaacattggccagagggtctggttcgtgtttagagtcgccgatgaagggctaacttttctccagacacttggggctcttgttcacactttgcttttcactcttttaagtaagacatagtcacatcacagtgtttcatcagacatgtttcaaaataattgtctaaggattgcttcttaatttccccgaaatttggaattgttgtaacttttgggccaagctatttcataattatttctaatgtctcgcttgaagaatagggatgtattcagtgttgattattaatcattcgaaactacaactttacagattgctaagaagaataacttcttccagtacccatatggggcagaatcttcacgtgggaattcagagcattttgttggactattttaatctgattggattattttcatgtggtatgtgggttaccacattagaaacgattgatgtgtagaataaatgttcttaacaagtggaggtcaacttatcaaatgatatttacattaagaatagactccacaaattttagttcctgtagctgatatagcatctcatttgttatataatccagtgattcctaatctgtgttcagaggagagaggaaatcgattgcaacagggacgatgccttcattggctggcccaaaactgggagtttwtacaaggcgtcagtctttgccttcctcctccctgccttccctcttccttcttccttccccatactccccaacaaattcatggacttcttaacaactcagagacattagccacaagttccaagacacccccaccccccagcctccccagtcctattttcgcattcatataactaaactctttttctttcttggtggagttttgaaatttatatttttaattctttgctcccttttttcctcttacaaaatgagtgccaagcagctaagttgtgctgagtggtagagtttgagtcagtcttggctggtaagctgtggggttaggagccgctccctggataccacctctggtgtctttgctatacaaagactttcatttagcctcctttgtatccagcaaaaaaagattcagtacccaaaatggtggtattttggtatagtatgtatcttacaaaacggcaaaagacttcaaaagttcctacaattttatcttgggggtttccttttgaagtcgatgtagaattttaccttggggtggattttttgtacttcttggtctggtgtgttttgttgtgtaatgagcatggaggtgtgggataagaaagcagactgaatcccgaggaacaaagcctgccagactgtggtggtgtacttttcttgttgttattgcttaaatgctgcaagagagtggaaaactcttacgaaataatgcacgatgggtagaacttcagagaaaatctctgccgtctaccctgtgcattttcgaggaagctcagagggcatgctgaacctttgctttttgtttctgaagagttcaggggaacctacccataattaattttttaaaacactacctagagagcaccctcttggttattaaacacatgcgctgtttcgatgggatgtttgacctggattgtggatgcttgctgggacgtggcatgtgttgggaggctctgtgctgcctgctgagcaccagcaaagccacagtggcccctacctctgtgggaggccctgtgccaggtgccctcaaagagtagggggcccatgagggtatgaccagggggacctgatttcggctgagaagttggcggggattacaggcctgggcggctccctgaggaaattgcattaaaaatgagatctgaaggcttgattggggttggcccaatgaagggataggagaagggatggggagtgggcagaaggaaacacatgtgtgaaggtcctcaagggaaaagtgcttggcttggacagaggcaggaaatcaggtaggaggctagaggtcgggcagggctccgggagagtgacttggggtgcagcatatggtgaggatctgacactggggagtcatttgagcaggttggctgtttctgtaggagcgtgtgttaagctgctggcagtggggatggtgaaaatagagatgtggaggaaacagcagcggaacttgctgacaggttagatattggcattgagggagaaaggagagtcaaaggtaggtagatggagatgcttcactgagtggggagtattggaggaggagcaggtttggggtggaagcgttgtccttttagagagattgtatttgccattgattgattcattcattgtttctgcaaatatttagtgtgggaaaaagcatgctagacaccaagagagagtggagtcaatgaagaacgataacagcaacaaagactgtagcgcttcctatgcgaggcttgttccagttgcttcagaggctgtgttacccctgttctagagaggaggaactaggcccaggkaggtggggatttgcccagtcgtgggagtcaggatgtgaaacaaggcaccctggctccagagcacaccgtcctctcaaccactgcagagaagctgggaaagagacaaataagtgggtgcttagagcacaatgtgtgtggtgtgccaagagcagctgggagccctgggacccccagggaaccccagccccacctgggcatggtgggcatggctggaggaggcctgctggctttgctggagagtgggacatgcatcaaggtggccagagactgggcttctgggtgtcgtgctgtgactgctgcaaagggctcattgacatatggtggggagggccagcgtattttctgcgggcaggacatttgggggatatggggtgtgaccctgtactatctaaaatcttttacttctggattatctccactttctctactgcatatatactttgtttttatttattttattcatttatctatgactcagccagactctctaaaagagttgacttgtgtttcctagcagccactgagtcagaactttcccatttcgcagtcagggctgtggtcagggtgtctgtgttgtctaaggatataaagcaagccttcgggcactaccaaaacattattttataaggagaactatgagtacctaataggaagaaccaggcaatcaggttatcttttggtgaggaagaagtggtagatgggatcattggtgctttgaagggagtgggtggtgtagactccaaagtgtacatggggccatgatagagtctatgtcagatgtccaaagcttccttctctcctcccagaaactctgtcctctggtgaagagttttgaagtttcctgaggtttgggttcatggtgtggcaggtgataccatggcaatagaaaatatcccatcaagaaggattgtgtgacctcagttgtagcccctgcatgttggaatcacaacaatttgcagggccttaaaatcaaatgccatttcaccaactgccctcccccgtttttttcagcactgtttggtagctatctgtttcccctgatattcttggacacttccagagatgggggctctatctcctggtggtagactgtttctttttggtacaatatgaactcttaagagagttctacctttagggagctgcagtctctctcctggaaatgctcaactccttaattcatgttttgctgttaaattctgctaatgcctcaccttacatgtcttgacaatttgaaggtagctattgtattccccgcaaccccaagtcttctcttcaaaatgattattaattgtaattcaaatcatcagtgactggtatcttagactacttaaggatgggaattgctaattttgtatttaaaagttgtacctctaaagtaagtgaaatttatttttaaacgtagctttcttcattcataaagtttatgttcattgtaggcagtttggaaaacagcccataatctcaccactcggagattacattgtgaataatttggtatatttccttttagaaatataccaaattatccttttttcctctgagtgtatgaatatttatatttgtttttaacatacttgagctcatagtgctcagtatttccaacgttctgtttatttaagatgaaaattgctgtagttaataagcacttccccatgtcattaaaatgcttaaggatttttaatgaccacataacagtccataatatgattaaaccccaatttactgaatcaatgccatattgttgggtctttagattgtctccttttgtttctgctactgtgaatgatcctgtgatgatcatctttgtgtgtaaatctttgtcccctcgccccctccccttttattattttcttgggatagaccccaggacaaaaggtagaaaagaacaaagtgttaaaaaatttcttgatacatagccacagattattttcctgaaagttctcaacatttataactacsagcagtatgtaagagagttatggttggaatgattttaatgtctctggggaatttaacaacaaaaaaactttaggcttctttggagagagacatgcccttaactccaccccgccctagaacagagacccagcccatccaagtcagcctccccaggtcctccaccttcaaaacaggcaaacgaaatcatttcttgaataattggtaggcttcaaggtcagatgtttattttagataattcacagcataaatttatatgttttaggtaccttagcccctgaatatactcagttcatttaggactattttagaggtcttgagtttactcttataacctcacatttttttgtgaatttttagttctattatctttgttttcatggcatattattgggcaaagatactatttattcgatgctatgtgtgagctgggtcaggattatgaccctgagttatgtttctgggaaaatgtacccacttgtcaaagatgccgttggctcctgtgattaaggtcagcccacaatgaatgtggggagggctggcagcctctcaaatcagctcttgaccatttctcaagctggggcctgttgtgcttgggggaagagtctttggcagctcagctcggggctagcgtttcctgacatttgtttcgctgaatgttaacaaggttactggaaaaaagggttctctcctaaaataggtttagggaagcactgggatatgcgaagtgaatgagtttctttagggcaggatcttgactctgcagggggcttggaggccttccctagagtggggcttcctaacactgcagagctcttcccaggacgaggggcaagattgggacctactttggaaggttgtttttgtttcggcacctgctctgtttacgaagcgtgggagcctgttttaaattaatgtgcgcctacttagagctacactcatggttttgactatgtttatctttccagtaaataaaacaaaattgttcatttggcacccagcctgtcctgcttgtcatttcttgtctygctgattaactctatggatggggcatgtttctccaaccagattgtaagtttcttgaagccaaggagccctgtggttgatttcttcacatgtggctctctctcctcccacaatggtgcttcgttaattaagcagaaaacccatctctggttagggactggagttgatttcgtttggaatgagtgtgacttcatcatgacctgaaagtgttcagaaccatcttggttagcacaagggcgtggacgtgtgtctactttctacctgatgggatagcatgtttaatttggggttatgacactgaatggtttgccagtaacttgctaatccaaccttatacattccagctcacagtggagcgtgtctaattgccacagcagcatttatgtggaacgtggttgcacaaaagctccagaaagtcaggctgagggctcctatctctcctcaatcttggtttacgatgtctgtttctgaggaatcctgggatggggccactggctctttaagagagagcccgatttggaaatctaggacttgattgttgattatgggcaatagatacattttaagaatgatgttgtaggctgtatgaagtcatttgatgattgttttgttaatggcttgcaggtcagattttcatctttttaaattaattatcatagaaggagaaaacaactggatttcagaattgtcccttgaggtgtactggaaactaaggcgtgagggactcataggggtctggcttggaaagtgtattgctatgtccagtttacacataaggatgtgcaaatccagcaggttagctgagctgcccaggaatatccaggcaagaatkaccatattctgataattactcaggcctctgcctcatctccgctgcccccccgccccctgactctcttctgagtgccagattcagcctccatttgaatgccaaatagacaggaaattagcatgcccagaatccacgtctttagtgcactctctccccagctccaaacctgttactgcttgtgttcaacatctcagtaaagctcaacaacatcgacccattacttaggcctcaaaccttgggtggcatcgtcgattgctcttttctttcataccccacattcaacccatcagcccatcccacaggcccaagtgtgtcctctctaccttcaaagcgtgtgtggcatccaccgcttatcaccacctctgccattaccactggagtccagtgccatcatctctcacttggatgtggccagagtgtctttgctggtctccttcttgcttcctacctttgtaacagcctatcatctatctctggtctccatagctcactcccatactttgagagggcctttgaaagccttagacagatcatatcacagacctctatactgaaagtcgggataaattttatctctggaaagagtcccaaagcagcgatgaacagatattttgtcctgtcacttgatgaagaggtggggctttgagacccaagagcttagaatggagagcctagatgccactaagcccaggcactggccatgcttcgagtggagcttttgtgctggtggaggagagatggctgggggacacctgtaggctgagcaagtccccgttcatcagaccctggctcatccagcagggcgtggctgatgttttcaatgttgtatcctgagtgggacccagatgcttcccaactgtgccacatctgagccctgcatgccatctgtccagttgcagcctgactgcaatgtgaggctgctgaagagctctggatggtgtgaagcaatctgttttctagcccgagcctgcatagctggtggatcctggaccgtgattaagtgcatcacctaggcttcaatgagatggagtcactgtgtgtccaaacagtgggataaaggctttactctttgtcttcctgctctgagggcacaagctgcttgtttctctcacaaggacaccgtctgtgttgctcaggtgctggggtgaaaaaaacagcaagcatttgaaaaggctgaagaaggaaagaaagctgagagcggtacagccttggggactgagccatcccattgtcccagaggtgggggtgttatcaagacctgtttttgagccatacctctgactcttcctggaaagttagacccaactcaagaacacactaagagaagtgtttcccccyagccctttcagattgaaaggagacgccaaccttgatgggtggaggtagaaaataaagtcccaaaacagtgtcttgtaagcgaaggggaacatggctgggcagagggcttctggtgaaacttttgggagtattcagttggaactcaggaaaaaaaaattgtttttttggaaagaggtagcagcccccttcagccaaagctcataaatgaaggaatgtctgagactcagaattacagtgaccaaggcaagacattgtcaaaggctgaataagtgagtttgactgacagaggccatctccatttttagtatatggccaagcatctttcccacagtcttccttgagccccttcccatcccacttctgaaaagcactgagttggccattattatgcttttttcttaaattatgaagttgttttcaggtattgagaataacacccaggtgctgaactcccagcataagaaatcaaacattcaaaatggagtaaggttctgaagctgacatctgtctctacacatttttttttttctgataatggcatttcctatctccaccctcactctttttgttgtggtgaactacacttcccttgttccactcggttctgttgcacatgtgattaggcaaggggcagatatgtgatatttattatgagtcttttccacgcagagaggatctaaatctggctctttgcaattgccttcatacatgtgcatacacaccacacacacacacacacacacacacacacacacacacacacagacacatacatatgcacacaccccgactcaatggaggaccctcatttgtagaagggtaaaatgggtgaggcggaaatgcctgtatggcaccatggagttctgtgtagccagttctaatcctgggctatttggtaaggaatgaagttggagatagtcttctgtcccttacaaccaaaggaattctaactaatagtttgccaagttttatgtttataataaaaaatgacatgctttttcttttggatttttaatgcttttgaattaaaaatgctagaacatgaactgattcttctatcgctatttagatagagccytgcaagagcagagcacgcatgctttctttaagaacaggttggtttgtggtcgtctgaggactgttttaaggagacttattatacacaatcatcccccacaaatgatttctaaagagaggctggtatgaaagaaggagtttccatgattctgtcctgtggttctggggaattctgaaaatgaactttagatatttttgtgaaattcttattttcatatttttggtatctcagagttttcttttctggcttctgtttaacatactcttctttgccctaaatctctcttatttttgctccttgggacaactgaagaatccttagataattaatagtatgaaatactgcccttttagttgaaaaatgtcacaataatgtaataagataaataaggaggtgtcgctttaacctgtatcgtgtagtctcctctacttactaacacttacttgtattactagaagcattattttttaaatcatggaaaattggtggcaagctgagcatacagttgtttatttctgtttgactgattattacaacttcattatttgatgaaggttctgtacgttttcctttaagacacatagaaattgtgagaagatcctgcagccccgaaaggctacagtgttgatccaaggactctgagccgagtgcagggtttgtacttggacctgcaggctgggtggcgtctgtgggagcagtgtgttgagagagattctgaggctgtatgtgtcagggcctccaggggaaggatgcaytgatggattaatttctgccaaggctgaaagaggagagagtaagaggctgtagaggtgtcacagctgtcattgctgttttaggcagtcaagcttttgggaaagtgtcagaaattgagccccctactggatctatcggagccctgtcaaatgtccatttagatgtcctggtgaacaaaagttctctgactcaccatttaaaaacttgttccaaatgaaattatgggagaaaggaacatttttcatccgaacccagaatgaggatgtacccaaggaaaaggacgtaggctcaggagctggactgtggctcagctggcctgatgtatcccactttgttcctcccatggctgggatgtctctttgctctccatgacccatgtatcttgaggacatgacacatggaccaagcttgaactgcggattcatttttatgcattctacctgtgaatgattgcagcggatctagtcgtatttctgagagttactcaaactggacttcagcagtgaactctacagttctcttttcctcccacctttctattagacattgcatgatacaaaaatcaagatatttctaagagggtgataacttcaatgttatctaaacttttaatttggaagaagaggggttctttgttctttttaaaaagatacaaacgaacttctttatctgattctttttttggtgcaaacccatgatgccttcttcctgattcatctgctacactgtgagttcaagcctggcgtgggacacaggcacagctctcatgccaacgatctcatggttaagttttggaacataatttgaaaaatgtaacccattgagaggcagtaaggacatacggtgagctagtgcgtgtttggacgtctgtgtggaataagtgagtgggtagagaggacatttgtcaaggagcgggagggcgggccattggcttgggggaaatgggctgagactctaggggtggccagcacygcatayggaggccagcagggttgggcttggctaagtgctgtggtgtctggatgcctatgtgagtttcctccagaagttttcagttggcaaagtagaacctgctggatatgtagcaagggtgtggattgtcgggatcctgctgggcgcaggcgtgtgataccagaggtcagaacagaagctgagggatgaggctttgggagctttttgtcatgcactgtcctggagcctcagttactacaaagtctgcaaatgatagaccggagctttggttctgcctgatgctagctcccctgttcctgatttttcttttcaatattagacttaatcccagaattcacatgttgaaagaaaacttagaggtctagtgacataaaagcctcattttgatcgttacagaactgatgccttgagaaatggagagagaagtacacgatcatggtaatactggatgttcactgagcactcactagctccaggccttttctaagtaatttatgaagttgtcaggtttaatcctcacaacgcccttatgaatgagctattgttattatcccgatttggcagatgaggaaactgaggcttgaggggaggatgacgtactcaaggtcacacagctgggaggcggcaagctggaagttgaacccaaggagtctcacatcggagccaggactctcacccttcagtgttatgctgccttaatcaggcacacatacaggcggggagaggcaggtttccggacaccagactaggctggtgccggtcaggctacaccagggaacctggaggcctgtcattcttttgtgatgctgttagttcctgttgaggaagtgaggctttgtgggttcccaggaggaaaaggtatgaactcatggcaaaagaaaggaaccaaaaaagggagatttgcatcacaatgagccttctattcatcccaaattatacctccttttataccatgtgtgtctgcaaacttgtgggtaaatcacaaatctttctggtaagttacaatggatggaaggtttttgcatttctctcaaatcaccaaccatttaatgctatgtgtagtcactccctaatctatcttttgtataaatttggatctttgagtattggggttttccatgatgtttggcagttccccttagggtgtctatctcaaagtttgtcacactgacaagctttggggagagaagttagaggtgggcttccctgtttttagtggctgtgtctgattgttctgtctgttctccaggacaggagagattgattgctttctagctttttttaaaattaaaacaacaacaacaaaaaaatacagaaaggtacaaaggataacaaacacattcatgtacctgccacctaaaataacaattactaatcttttcaccctcctagcccatgatcttccctcccaggctgttattaatatgaaaaccgagttcaggtttttatacttttcgacatctatttatattaacgtatgtattataaataatcttagtagtttttaactttgacataagtggcttcacattccacataacattctgcagcatgttttcttttatttttatttttttctttatttttaaatttttattttgcagcatgcttttcttattcaacattacatttgaattttttcaacattgtacattgaaatttagctcattctttttaactgctctgtagtatttattgtatgcatatactacagctttctatttctgtattgatggttaattaggttgcttacagttttttaagattacagattctgctgtaataaccatcctttgggcaagtgtatgtaggtacctatatatgagtttctctaggattcataccaaagtagaggaattggtagggcattggtttgctggttttaattttaattcacatgctattgtcaagctctccagaacaactggatgagttgattggatcaatgagtatttccatcaccagcatataaactctttcctcataatcacaccaatgcttgatcctgttggacttaaaatttttgccaatttgctgggtatgcaacggcatcttacctaatttgcctttatttgatgactcctgaggttgaacatctggtcatatgtttattttctcctctgtggcttgcctggtttaatgccttcttcattttaaagaatcagatagttttctgttattgatttataggaactctttatataagttgaaaacttgattatatgtgttggaaatactttttctaggctgtgatgttttaaaatattgctttagatgggttttcatttttaccttttattttagagatggagtctcactgcattgcccaggctggattgcagtggctattcacaggaaagagcatagtatgttacagcctccacctcctggtaccaagaggtcctcctgccccagcctcctgaataggtgggaccacaggtgcacatcactgtgcctagctttggatgggttttgaaagaaagaagttttaaattttaatgccctcaaattcatctgtattttcctctgtgcttttattttgtacccactctaagtagctccgaattctgcagatagttggtgcaggaattctgattttgagtggacatctgctctctaacagtcacattgaaggaaattaggtttttttggtaggaatctaagcaaggggttgatttgtaaactaggctttaaatatgattttaagcaactcacttagaacaagatacaaaaattgtggactggacctatatctggaaaacttgaaagtgctagggcaataaataattcttggtcacatacagccgagatcctgggctcctgactctgggacagaagctttctatattttatctcatcagtctttgcaacaggctccttgaagcaattttatccccattttagagataagaaaaccagagcttaaagcagttagataatttatgaagtaagtggcagagccaagattcaaatccagacctttctgaccacaaagctcgttgctgaataccgcgcctcattgccttcttgcgaattacttgggatttgtttgaatcccaaaatctttatatgttattttaaatttgaatctaattggaagtggggcagtgagggtagaggacagaaagaaggggaagagcttgagactcaataatagaaacaaaaaacccgtctccaggagggcggttcaaaaggaagaattccatatttcatgtaactgaaacgttaaaagcccaaataattgcatcatgcaagtctgatgctgagtaatcaccctcccccatattattggggagagggggcaagaagtctgggaagctgtttttgcctaaggaattacattccaggggactctgaggatttaggtaaccacaaaagccatttatttcgagtacactgagatttctaccactttgatccctaatccatagcataattaataaatgaaatgtgctgtagcatgggttttttacaaagtgtacttttaaaatggcttttggtctgacatgattcatttgccacttggaaaagcgtcatcgcctcagatgggcaggctgggagaggctgcctggtgggtagctgagggcggtttcctggggcacagttcctgccttgggcctctacagagcggtctcatccaaacatctcccagactctgcgttttccaggaagcgtgcagaaataggaggccagtactgaaatgctatctgctctgtgtatgtcagaagaccacaaaccacttataacaaatgaagatctttttatttgttcttatccctttatgtcacttgaggaaagttgctgtgagtaggtgatgatcattacagtgatcactggttgcccaaactgagaagccagacatttggcttggtttctctcccttcctcttgtctctcctaccctgtaaacacatacttggtgattacccatggggagacaagacaggctgggaatatatacttctgcamcttcagcctcctgggttccagcgattctcctgcctcagtctccagaagagctcggattacaggtgtgcaccaccaggcccagctaactttttgtatttttagtaaagatggggtttcatcatgttggccaggctggtctcgaactcctgacctcaggtgatctgcccttctcggcctcccgaagtggtgggattataggcgtgagtcaccgagcctggccccaggcrataatataccagtgggcaagaaaatattcttgctctcatgggacttctgttgggggtcagggtatagggaggaaggcatagagatgaaaaccagtaaataagtaacaggggaaaacattttaaatacattaataactaataaaatagaaataaatctgttggctacttaacaggatgtgccacattccagatacattacgttaatccttatgatctttgggggctaagtattagtattccattttacggatgaagagactgaggctcagagggaagggaggtggcttttckcaggtggaaagccagaccttttcagtggtcattcagttcatagctaaggtcttattttctgtgctctctgtcggctgaaaatgggcaaggtaatttcacatagtgacaggagccatgtcagagaaagagcaggacagtgggacagagagggaccaggctgggggctgtttgagatggagggtcaggaagaaccaaactaagatgtgaacagtgggaggtgttggagctgtggtgcttgcctagaaggaccctcatcgagcaaatagaagcttctggcaggaagaagttaatgtcttgcgtgtgccctatgtaggttcattagggcctttaaagggggaagaaggtggtggctataaatgttacaatcttacctttggcccctagggattctgtctttcaaccttggttcagtaacaacttgtgactgcccaacagggcttcctttcgggagagaatggcttgttacattcaaatatgccatgaaagtatcaccatttatttcagtgtctgatgccccagcttgggcagcctgagcaggctctgaatgggtctgaagaggccctttagagtagagatgaagagggggtggggaatcctcaattctaaacaaagagtctgcaatgggaagatggccaaatgctgtttttggagtgggtgagagggaaaagaaaggtatagatggttcgttggaaaatgtggttttataccgggttttggtgtcaggtccccgagggcaacatggactccacactgtgatcctccgggcagctcatagccccagccccttccttttgcttcctggtcagtttgtgagaaggaggggttgtgtctccaatctgagcaataaggggtctgaggggggttggatccatgtggctttcctgtgtcttgttccttgtaaaagttccaggttttgggtcgtgagctgtgtgtgtgtgtgtgcgtgtgtgtgcgctgtacgttaatatggagagatgggcttgggccagtgggaaatagagagacccgcaagcacagagtgacagggtttgatagtaagcagcaggccagcgttgctgcttttattcctcggtaaatccttgcacaatgccatatgctcttgcattccgtagctgctgcatagggtgtgatttagttaatgcccgctctgcaaacaggaaacggtgctcactgctgtgtatgcttttcatggagataaagtgtcaggagcaagaccccaaacctgcraaatcactaatgcaaccrccccccatgccccaaaaggtgggagtgggggataaaaagagtaggaaagtggtgtggggaggggaagctttagggccataactcagacaatttgtcaggcagtggcatcggttgggaggaaaatattgatgtacactttttgtttttgaacctgaagtttgggttttttcggatgcattggaggacttttaaatgttttcggagtgccagagtttggactgttaggtcaccgtaggtaccggcttgcatatcatttcagaggaatattttcaaaactccataaaaacatgcggctttcaaggctggaccacttgttcaggtcctcctcccaccccccaccctttttggcaaaaccatgcaaacattggtattcaaaaatattttgttacttttcttggcaaagtgttccaagaaggaattgcaacacagtctcagagttaggaggcaactttctggggaaaaggcgggggttggggaggtttggagtttgaatcaaaaacagacaccgaagctttaataaaataaatgaagcggagccctttcagctcacggtggactgtgttggtgcgcgggtcaggctttaacgtgcctagtggaaattgacagtctgagaactgggacataaacaaaaatgtcagtccctgggagtcttgttcactggacaatgtctcaattgttcctttggttttcaaggcagcagggagagtggaatattaactgtttactgcccaaagctggctcggaaattgcttggagaaggggagaaaaaagacagaaaatcacattttttatttagaaactattaaacatgtcagtaagagataggaaaagagcagattgttttctccttaattatctgccattcacttccatatttctgcataccatttttggggtgtgtgtgtgtgaaggaacagcagggtgtttctttttaaatttgaatgttagccttgcatattgtcagtttttaaagcttgctggcatgtagattatccgcccccggtggatatgacagtgggctttaggaaaggaagtgtgatttctgataacatttacatcttagctgttcagcggataccctgttagtgtttgttcttcagaatgctcagatagaacaaaaatcaagtggttggaattttaaaaaacaaaatgtatttggctctccataaaaatgcatttagtgataaaggggggcagcaagtaactatgtctgagagaaggaattgcaggcacagaggagatccagaattctgttcacacttgaatttacttgattcgagaaacaaacagcaaagcctggtgtattggcctttatctgggcaaagttcaaaactcaactggtaattatgtccttagaagccttaaaaggactgtgttgttacaaaagcagtgactgagcttacttcttcaggaccgaatgcactcgagttgtttgttagataaacttgttttaataaatgggggggtcaggggagaggtttctgttcttggaagattccctgataagtagctttcttctcttggagaacttcaggctttctctccaagcgaggggtttgcaggcagctaaagtcagcttcggcttctgcttcctgtcagtcaggaagtcacttccttaacccaaattacaagctagagcacaactccccagccataccgaaaagagcaggtttttcccagaagactgtgtttctagatgcggaagtgtaaattggtacgctgtgtgatcatggaatgcccaaaatacatagggaacagtgttgttggaaagaggcgctgtgtccccaaggagaagacgccgcccagaatggctggatcgcctgttgtggctgagtgcgaggcagctgtggctggctgctgtgtgacgatgacctagtagccacccatgtggagtcctggctgcctcagaaccctatcacatctaggcaaaatcttgcattttttatctgggaggcctgaggacttcagggctggtggatagtaagctccttggttatctcacagatacaagaggtcttgggaatccacgatcaaacttgatgtgtgcgtttaccctcctccctttgaatctgttattcaaatatttaagcctccaaccttgtggcccctacctgcaccacccctcacccccccgacaaaaatcaagctcttgacctcatggcttctttcagtgacccttgggggacagagtttcccaaggctggttgccagctggcatggtcccccgttggtgaagtggagacctgtgtttttttggtcattttgcaaagagcttatggatgacagcagttctctgtgcctcgctgggacagagtgtattctgaggtccagcgtctgcatggagatctgcctatccttcacttggggtgctcagtagataacgcggccactttcctatacatttccttaatttaagggaacagcgtaaactcagcccaggtggattaatctctccagtgacttttgaaacttcaatytccaatttccctcttatgtctaggtgtgagtgaggatacgtgtagtaattgtcgcaggtattagtgagaaagggtgcagatcacacaaatatttcacacgttattagttggaccagactttggaggcaagggagggccgtgtcacctaggaaatttgctcttccgtggagatgaaagggcagtgaattaagtgcctgctttttctccctttttccctctgacggttattgatcctcccctggaactgtacagttcacgttctgatctttttcttgacaaagggaattcccagtttgttcgctggtgaacgcactagcaggtgaggagttaaaagttggcaacgcctgccctctcgagagtgtcaggatttttagtctcttccttgagagctagaagatgtttctaaaagaatctctttggtgacttagaagtggagagagctttagaagcatggcacaaataaaaggaaagaggcaaacaccgtcattctacatctgtttattttgttattaacaaaaggcaaggcgattttcattaaagttttgctggggttggggktgagggtgtagagagcaaaagtgtgagttgtacaccatgactggaatcgcttggacatactcttcagcagacatcgtgtgactgtggaagaaatgagtttcatgaagatgactgatagaaggaagccactgaaccagtcctytatcacctcttccaaggctaaagtttggagccacttgcagaaggctctcctcaaacccctgtgttctttgcctacccctgctgttgccacatcatcttggagagctggctgcttccctcctcaactagaagttcctagtgcctgcttagttcttgtctcttgcttcccaagtgctcacaaaatacatccatgttcgctacgaggaaatggaccacataaggtttccgtgaaaaccttagcccttaggtctaacacagtaggaacagaagttaatgttttcctgacgtagaagtttctcttgctgcttctggtcacatttctttcttgtgtggttcttctatggctactgcacttttttttttttcttactgtctcccccttcccccacacaccaccttttggggatagggtggcaggtgagaatataaacagataatggttaagagatagtttagtctttctaggccagattatttagtttttgccatctaggtaaaattcggtccaattaagygtccattaagtgttttaatataagctggagaaggagttgaacctggaggtcagggctctgtggtctattacagtccccctggggtctctagcccaagggagactccagggtcttaataaatgactgggggtttcattttgaggcctttactaccaaagactgaataatacattgggcatgatggttttgtcctaaacattaacagccacaaaaggtagagagtgtgtctgtttayagatacacatgtatcatgaataattagttggggactstgcrtcaggtctctcattttacattcgaggaagcaatgcacggaatgaattctggacctgcgaactctgaatttcaattctctgtctcctacttttactggagtgcttgcaaacagtacagtgtttttgttgtgaagttataccgtgcctgtaatctctctgcgggtggccctcctaagccctacttcaagaaatagctctaagctcatgacacccgccccacccgatgcctacatatgtcttatatccttggagtagtgtttggggttgcaaatttgactttagggagacatactctctgatgataggctaatgcttatatttactgataaacttcctttttgacggtcatgggcttcgggggccacccaaccaaactgtgtggctgcttttatgttgggccaaaagacaggctccttgtgtcctcccagtttcttaaacaatgaagtcatggcattttacagtgctggtgaatggattgagattgtggtggccctggaatgtggcactgctctggctggagggaagatgagagtgagggatggagaggagaggagagcgggagatgggaacctggtggacacaggagggagtgtgagttctgagggccaaaggaaacttgacaccggatgggacattaatctgattctgttatctgaggctgtcaccagtcctccctgtcctcctggcgtgcttctgttgaaacccccacacccgggtgattccttgcctctcccaaggagccggagggtggagaaagcaacaagaaaaaggagccaagaaaagagcaatgaaagagttctttaggaaaaggggaaggtcccgagagatctggtaaatgttaaactgaagggccaggcatgaggaagagtaggcagtaggagaagagtgtatgtgtgtgtgcacatggatgtggcgtgtgtgtgtgtgtgtgtgtgtgtgtgtgtgtttcgttggatggatggatgatgtgtcgtcatccaagcagattcaaggaggttcctaaaaggcagtgaggttcctgaaatagacaagtctagggaactcctgcgaggaaggggaggcgtttattggtatttggagagattgttaagagcttgctggagtcaggtggagtccctgccattttgcctctcatctcctgaagaaggactgtttcttttgggatatgtaacaggcttccaatcaggcatcacaattttcttgcttgaggtgtttattctttcactcaagctagccggaaggagcctaatacctgtcaggaactgcctcctctgggagagggaggggccaggcccaaatggtggctgcagaggtatttaccagctggttccgtgctctgcagaaggttggtgaacatgtaaatgcgggtagtaggctcacatctgcttctgtttttcctttttctgtaggccaggctgaaagcttaataaattgtacgaaacccaagtaagcatggatgttaaagaacattaaataaattatataagkatgcctacctgtaacacttttataaggcaaatgcacatgggttattttgccataaacgtgcacatggaccaagatttattctaaagccctcttgtttcagccttgctgctggtgaaggtactactgttcatcagcttttcccttttttacctggcatgcactgtagctggtcttggaaaatgcgataatgatgccataagtacccttgtgcaaaagttgttttttgttccaaaacattgccagttcacrgcatataaaactaccacggatgcttcagccgggtttctttttctccaaataaggcaagcattaatgaagcagctgagggcttgggaaaatattttgtcattcccaaaatgaaatttcttcccctctctaggcctgcccattgatttttcagctgaagcacaagtgtctagccagacttggtgaacagtaggccttgcacctaaacttgtcaattgccattgtcacctctaatgaccattgatataaataatgctcagccttcatatttccatgcatattcacccagagaccagaaggctttgtgtagaggatggtgggatcatcccattccatagggaaaaaagggccaggttccctgactccacctgtcattgaattacaagctgggaagctgggccaggcagagctccagttgccagacactgtggccgctctggtaccagctactcctagtacccagtgcaggcaaggtgtttagtgtggcctatgaggatgttgtttaycaggcagcaacctcatgaataggcaaaaggcctgttttgaatgcctcctgtttagaagtctgaaatgtcacatccagacagtttggaaacattttaggtggagtcaagggcagagaccagaagacattcatagatctgcagttgcagatggagactttgttccagctacccatggtgtgagtataccttacgggtgctatttggaataggaccttatttttgttcagtatattggacaaagtaattcctgcttccaaactcacacagtatttatgtggccccggctgtctggcttatccacctgcagctgtggaattacttatgaagcgcttaatatgcagcctcggtttctttatctgttaagaatcgggataactggggcttctgaaggggtagggtcatgtagcctggtggttaggacctctggctttagagatggacaggttttggtttgggctctggctcagctgcctccttgctttatcagcttgagaagttaataatctccaagtttccttatctgtaaagtaaggaaaataataactacctccctcataggttgtagttaggaaaaagatgttgtgaggctcaggtggtctgagggatatagaattgcttctcaaacatgatatgttgctttgcccaatgcttaggagggagttgcggttaatagttgaagtgttctgcaagtaagtcttttggatcagtataaggctgtgataattcttattatttggtttgtgtccgtgcatgaaagcagaaagcagccagaggagtccatgattcaaggagcatgagaattactgtttgcaacaccatgttttctgaattccagtataccatcagttgtaakatatgcttaaggttggacgcggtggctcatgcctgtaatcccagcactttgggaggccgaggagggcggatcacttgagatcaggagtacgagaccagcctggctaacatggtgaaaccctgtctctactaaaaataaaaaaaatttagctgggcttggtggtgcatgcctgtaatcccagctactggggaggctgaggcaggagaattgcttgaacctggaaggcagaggttgcactgagctgagattgcgccattgcactctagcttgggcaacaagagcaaaagtccgtctcaaaaaaaaaaaaaagttatgcttttaatctaaaagcaaattttcagggagaaaaagagcacggctctcttaactgtatctacttaccatatgcatctgaatttcagatgcgtaaaaatgtagaaacaatgcgagtcttcaaatggaggaaataatgcctgtgtgcttatataatttgaataaaagctgtgctgtttggagccctaaacttcaaatggatgacatgttaaaagcttccaaacccacttttgatcaaaaatgggtggaacctatgtggaccagatttttcagctgtgctgaaagagtaacagcaaaccagagtcattgggcgtggttgtgccaacgatcagctcttagaagaccataccaatcacattttacaggattctattcatgaagattctgcatatctgtttccatgttgtttctgaccattaaggagagttgccggtattgacagatgaggaggctgggctgccctgcagcttgcttctccataagcacaccatcaaaaacatgtccacattccagtctcaccttagcccatctcctcattgggaggagttaggctgcagcatgaatgggaacaatgaatatggaggtttcttcagaaggcgatattagagcatttaatatactgctgttcttgtgtattctattggaaagaatgggcaactgcacattaaccttactgtaagtgtgatgcatttgaacatacagttaagaatagctcaaagaatatgcatttctgctgtgagtggttttgaataaatcaacataatagcccatggttattaacatattatgtgaattggacaatgatatatactttgaggaccttgaactaaatccaccagctaagagcaacccgtaggaggggctccagaaggaccggagttctgggtgttgaggttgtcatacaaagaaatgaacagcagacaactggcagaagaattttctggtaatactcaacccaaagtcaattttcaaatgcttggactgcagcacagaattgactaatgtcagattaattgaatttggacttctaaatgtgggtcagtttgggttggaagtgattttattatccagaaacttctgtgtacccctcttcccccacaagaaatattcagccataattttcccctgttgctgagcttctcttgcaaagtttctgagaagcagtgaatctttctgttagatttcataagaagtagtgctaggcttttgatataattacgtttagatttcaaggaaactttcagtgtgttgaaaaataaattctaaggcataaaggggaaggagtcctcggctgagacccagacagcccgagtccttagcccagttagaaacttgccatgtgaccttgagcaagtcttggcatgctctgcctcatggttgaacattttttttttttaagtggggagggttatatatgaccttctttttgtccctttagctcggacacttagaggtttagtgatctgtgggttttgtttgtttgtttttgtttgtttgtatttttggtgggagggggctagagtacaaaatggaaaagaagataagtagacaggggctcataatctttgagaaccaggattttccttaaattgctctcttttgaatctcctggtaccctttaaaaaacctctttacctgggtgcgagtcttcttccgtgacacttaatataactttatggacctcagttagactctgatgtccttttcaaaacagtgttgttttttaaagtatgaagtgcttattaaacccgcttaggagatgcagtcctaggaggccattgatcacacgtgaaaacactctagatataactctcctttcaaaaaagtggctaatgaagtatataccaccttcctattttgaataaagtgctatgactggacaaaatagaacaactttttggacaaaaaggctgctggagccgctgccgtctctattcttgcactgcttgctgttgacagcccatgtgtgaggacactttgttagtgacatttagccagtgattggcccatccaaaaggcggttacccagaagccctcgtgagcaagccaggatgctgggagagggatgggaggtggccttttggaaacaaggggacatggctgggttcttgtaagtcatgtggagagtatgatacacctctaccctgccatgccatggcagctgggcctcgcagagatggacaccagaattcacagcaccagagttcaaacactaaacacgggcagctggacattggccttgggaggcccagacgtggagcactgtcctggacctcaggctgtttcagggacctctgtggcaggaattgactacccttctctttcaggctcagccatgatgtgcttggctgttcccttgggctctctcttctggaagctcgtcccgtccgcaggcccccttgctgtacttgtaccttcattctccatctctcagcttctgcgcactctgaactttggccattcgcatgctgccagaccccttccaactcttggactcctccttacatccctttaccgttggctcccaattctttttttttttttaatttcccaattaaaacaacaaccaccaccaagaacaagagttaggccctgcctacccttctttggatggggtgtttgtgccaagtagcatcaccaactgctgttcatccttgacatgggtgtcctggggtcaggtgtttcctctggcccagttagcagggaggaatgtcatatggtttagaaaggagggcccagggctggccgtctcttggaggggcccgggatggggtacgcccccttggaaggggatggtggttgcggtgggcgctgtaaatgttgtgtccagctcagagggtgcaacagtgtctgtaactcatattctttttttttttttttagacagagtctcgctcctacacccaggctggagtgccgtggtgcaatctcagctcactgcaacctaacctcctgggttcaagcaattctcctgcctcagcctcctgagtagctgagattacaggtgctcaaccaccacgcctggctaatttttgtatttttagtagagacagggtttcaccatgttggccaggctggtctcgaactcctgacctcaagtgatccgcccacctctacctctcaaagtgctgggattacaggcgtgagctgccgtgcccagccagtatctataactgaaggctgtttatttctgcttgcctaacccgtccaggaggatgtgctggggccatctgaacaaccattgacattcagacattatttagaaatggaattgggaagtgtttaaaaggcatagactagtctggccttctgcccattcagagactgtgtatgtagtcagtgtacagtgtattcattgagggcccctcgctggatgtttcagccactccctcacaggttctcgtgtctgcttggtacagttgagatctgcaagagctgattcatcggcctgattgagattcctttgtaaaaccagatattcaagaatactagtggcaagaatgctttggtgagcgtaagatagcggctcccactggatcacatggctggtcggtgtcagggagatcaccgtgggaggtagcaggagtcagtctttaaaaaaattattgggccgggcatggtggctcacacctgtaatctcagyactttgggaggccaaggcgggtggatcatgaggtcaggagatcaagaccagcctggccaacatggtgaaaccccgtctctattaaaaatacaaaaatcagctgagtgtggtggcaagtgcctgtaatcccakctactcgggaggctgaggcaggagaatcccttgaaccagcgagtcggaggttgcagtgagccgagatggtgccactgcactccagcctggcgacagagtgagactccgtcttaaaaaaaaaaaaatttatatatatatatakatatawgaattaattaatttaatgttgcattaacgagtggtataaggttcttagccctttgtctggtatctgctgggtgttcagtattcatttcctcgctttccctgcatattttgagctaataaatgtttggggacaccactttcctgtagaatctcatgtaatcccaaacagatcctagctgcttgctatggcccatctgcgggacccrcgtcaaggctttcccataaaggagagccctgcgggaatcatcatgtgccagrcactgtgctaggctctttaggtgcatcttgaaacttaatcctcgtgacattttggagtagatactatcatccccacagaaggtactgaagtctcaagcacattaatagcttacctaaatattgctaagggtcttccagatgatctttaggaaattttcagccaggggagagtgaaagctctatttgctatagttaaagcaaggaaccctccttcttaaaaaattatacagttattgagatataattcacataccttacaattcatccatttaaagcatgcaattcagtggttgtagtagattcaggagttgtgcgagcatcgtcacagtcaattttagaacattttcatcaccttccacaaaacccccgtgtctcctagtagccactccccattttccctaagtcccacagtcctaggcaacaactaatatattttctgcatctatggatttgcctattctggacatttcatatagatgaaatcataggcccgtggtcttttgtaactgacttctttcacttagcaaatggaagggtttttgatggaatcttagctcagatgtcgccctaggcttggccttctggaactcactgttctcttgcttccttccaccctgcctccctacccgctttgctacaagaagacagaatgtagaaacccccagttgactttttgagtagaaatgagccatgttctatttagtggtagaatgtttgctgggttagcccaggacttcagatggagtgcttcctcctttttaataccttgtgactgctgtgttggcaagcagagggttaaatgctgcaggaggacatgggagagtttttgctttgagggtccactggagcaagagaagcttgagagtctgtctctgagatcycagaacagacatgaagatatggtaccgattcccttggtgctaaaaggaactccaggggaatttcaggaaacccctccttttctcrtctttattctcaccccgtccccccgccacctctctccccaagttcacactcaggagggaggaatcttttaccttttccgttctgggcagcagctgtagggaatgttatcagtgttgggactgggcacgggaccaagccttcctggtgcctggactgcaaccwagctgagagctgacatggcagggcragttgtgtgtgagttggctgcccctaggctcataggcctagcacaatagagaccctgtcaatggagggacactatcaggcaggtcactatcaatgtgacagacactatcaggcaggtcacattggtgcagatccttggaggactcccccccaccccccatgagtggattcctccaggtcaggggctggctgggactgtggatgctggagtaagtggaattgtgggtgcactctgcttcagcagtactctccaaggagaatgattgttttaataaattactgttttaataagggaggtggaagagctttttaatcacttgctttttaaaaatttttaattttattttaattaattaattagtttatttattttttgagacggagtcttgctctgtcgcccaggctggagtgcagtggcacgatctcggctcactgcacctctgcctcctggattcacaccattctcctgcctcagcctccagagtagctgggactacaggcacccgccaccacgcccgactaattttttgtatttttagcagagacggggtttcaccgtgttagccaggatggtgtagatctcctgaccttgtgatcctcccgcctcagccttccaaagggagggattactggcgtgagtcaccgcgcctggcctttattttttatttcttttgagatggagttttgctctgtcacscaggctggagtacggtggtgggatctcgcctcactgcaacttgcgcctcccgggttcaagcgattctccagcctcagcctcctgagtagctgggattacaggcgtgtgccaccgcctccagctaatttttgtatttttagtagagaccgggcttcaccatgttggccaggctggtctcgaactcctgacctcaggtgagcgtcctgccttggcctcccaaagtgctgggattacaggcgtgagccactacacccagccaatcagttgcttttaaactacttaaataaaaagagccaacccaaaatcttgtgcatgcttgggaaactggcagtggaatatgagaagtttttatttgtggtgcacacaggtgactcgggctgttgtgtattggttcttgcctcgatctgtagcaagcaatctgttgtttcttgcctgccttttgggaagaaatgaaaaaagaagcagcacgagtctccatacatcatgattgtgatggcactgggcctgagaccttttctgctgtccaggtaaaaatgtgaagaccatggttttgaggtttcttaataaattcaggtgttaagtgccaagtgatgctcccagcccctgagctagagcaactatgctgttcatgtccccaggaatggaagtggaccctagttaggtgctggtggccagccatgtgtacctagggcagggccaggtcgtgtgtgtgtgtgtgtgtgtgtgtgagagagagagagagagagagagacagagagagagatagagagaaacataaaggtgatcggcactcagacatcctgtgtggtccacctcacttctcaagcaggtgtctttccagtctacaactcgttgaccacaggtggaattcataagctctgttccctgtcctgcttgggtcctccagrgaaagaaatgttgaattatcatcttggtgatggtcaactctgaaagcctaaattttcatgatcaccaaagtgtttggatttaaaagggtggctcactccgtaattccggcactttgggaggctgaggcagaaggatcacttgagcccagaagtttcagactaggctgggcaacaaagcaagacccggtctctaccaaaaaaaaaaaaaaaaaaaaaaaaaaaaatcaaaaaaattagctgggggtggtggtgtgctcctatagctccagctactcaggaggctgaggcgggaggatcgcttgagcccaggggtttgcggctgcagtgagctgtgattgcaccactgcactccagcctgggcgactgtgagaccccgtctttaagaaaaaaaaaaaaacaaaggtcacaagacattcttggctccgccctgcagagctgcttcccgatctccttttttatttgcttcccaacctgcgggcctcagtgtgactcaccacaccggactgcctggccctgctgcctgccgcccatccttgcggcctggacgactccatgtgcgagttgctggcgcagcgtccagaaaacagaccacaccccaggaatgatgatacgttatagcatttctctgctctgtaagagaggcaccagggtcgtgtgctgggtctggggtttgtccattccacatccggtgctgctgttgactctggtgtcggccgctggtgagctggctgtagctggtcacctctgggtggtttctggggcggtcgcaggctgactaacayaccaaaggtcagccagggtgttgaagctggcacctttcttcctggagcacagacgtcatcttggatcttttagatacttggacttactttatgcagaacattctggatttgtgaattagatggactctttattattttgtatttggattatttctttaaagagatcagagataaaaatatcattgttttgccagtttgctaccaccagcccacacccctcttcccgttgtccaaaaagggggtggttagagttttcttgagtgactgggctattatgattagcagattactaaagctgtgtgattttaacaagacgtaaacacatatgggaacccctccttccatatcttgctaatgtcaattarcaacatattaatcttgctaatgtcaatcctgtcacttcatacatttataaatattagggacatttaaaagagttgtcggactgtgcgggaccttggcacactgctgacggctgcacactcatcactgcggggctcatcacacattgacaccagcaccatattttgctgggtttcctgatctcggttgagtatttggatttgaatgggatggttttaatgttgctactgactactacagtgatccaaataaactttaaagctggggcctccacgccayaggcarattttcataccagttgcctttacctcagtagttttcagctggggcaattttgttccccaggagacatctggatacagtgttggttgtaacagctgggcagggggtacttctgtcatcatctcatgggcacaggccagggatgctgctagggcaacccctcaccctcccaaagaattatcaaaaacatcaacagtgccaaagctgagaagctcagctttaatgtgttcattgagcaactaaagaatagactcagatataggaaagtatttatttatttatttatttagagacagggtctggctctgttgtccagatcataactmactgtaaccttgatctcctgggctgaagcaatcttctcaccttagtctcccaaagcatgctgggattacaggtataagccacagtgcccagcctgaaaagaatactttaaatgggcggggtaatggtggcttatgcctgtaatcccagcactttgggaggcagaggcgggcagatcacctgaggtcaggagttcgagaccagcctggccaacatggtgaaaccctatctctactaaaaatacaaaaattagccgggagtggtgatgggcacctgtaatccgagctctcctggaggctgaggcaggagaatcgcttgaacctgggaggtggagtttacagtgagctgagatcgtgccattgcactccagcctgggcgacaagagcgaaactctgtgtccaaaaaaaaaagaaaagaaaaaagaaaaaaagagtatctttaaatgaatggcaacccaatttgcaaatgtattttttttaatgttgccaattactttatgtgtttaaaaaatatctttctggtttactagggtattcttcaaaaaaagagaaaagattaaagctgcacagacatgatgatgtaaaagctagtagcttctcaagctgtgaaaggtctgtggtgcagagaatagctccctrtgagctgaattttgtttgctgtggtgcagcatgggtttagatcctacctggttagtgaaagagataatgtgaagtcattgcatttgcatttgtcaaaatcctagttttccacttacctaatagttttttgtttgtttgtttgtttcattttgtttttaaagacaggatcttacagccggggcctgtaatcctagcactctgggaggctgaggcgagttgatcacctgaggtcagragttcgagacacacctggccaacatggtgaaaccctgtctctactaaaaatacaaaaattagccaggcgtggtggcacrtgcctgtaatcccagctactggggaggctgaggcaggagaatcacttaaacccaggaggcgaaggttgtagtgagccgaaatcacgccactgcactccagcgtaggcaacagagcaagactccatctcaaaaaaaaaaaaaaaaaaaaaagacaggatcttgctctgtcacccaggctgggatatactgrcttgatcatagctcactgcaacctttagctcctrgactcaagcaatcctccagcatcagcctcctgagcagctgggactataggtgtgaattaccatgcctggctaacttttttattttttgtagagacagggtcttaccctattgcctaggctggtttcgaactcctggcctcaagtgatccttttgcctttgcctcccaaagtgctgggattacatgcgtgaaacaccacacctgaactagtctttttgttgttgttgttaaagtgagagacccagaccaaaatcatctttcttctcccaaaatgctaattattatttgttttaagttatagctccagattaccttgtaggattattcacattttctttctaaatgctgttcttgaaaggaaccatctattgacagtacatcagaaattctatggttcctttatgacatttctggggaagtaaatgaaaggtgtaaattaagaaaagcaagtgtttgcggttcccactttaaccttgtgttatgttaagtggctttgttgaagagggctgtcactgttcttgaaaacttgggaaaatccatagcaagctgtgccattagttgcctttgggagcacaggatgtttgatgtgaaaattatatggacacatctaattgggtgtattttcaccccaccagatatcaagtaaagaggtgactcttccccctcccctgcatttttagctaaattgtttaacctgaatttcatgctattaagaattacatttcagtaatccacctgccatttttcaatgccttttgtttagtagcatgtctgtatgatccacctacagaacatttctagacatctggcaagagctagttatcatcccttcctgatttggggtgctaagacctgtggtccccttcttccaccgtaatttacattyttccctgagtcctgcaggaactcagccaggcagtggaaagaaaacagaagctctgtggacctctgcttactgtaaaatgggaataataattcttatcctgcctgtttcccagagttgtatattcttttccaataaaatgtactcaaaattaaaatacaaagcagttacacagagataagatagtggtaattatgccaatttaaactccagaattaaaaaataagtttagtcacataccatgcagttcacccatttaaagtatataattcagtggttttttgtatatttgcagaactatgcaaccaatatcgccattgtagaacattttcctcaccccctaaaagaaactgtacccattagctctcactccccatttcccccactctgccttctcccccatgcccaaggcaactgtcaatctactttctgtttctatggatttgcctgttctggcattagatatatacatgaagtcataaaatttgtggtcctttgtgactgcttctttcgcttaacttaaatgttttcaaggttcgtccatgttgctgcatgtatcaggacataatttctttctttttcttttcttcttttttttttttttttgagatagagtcttgctgtgtcgcccaggctggagtgcagtggcatatctcggctcactgcaacctctgcctcccaggttcaggcgattcacctgcctyggcctcctgtgtagcaggcccatgccaccacgcctggcttgcttatttatttatttatttatttatttatttatttatttatttatwgtatttttagtagagatggggtttcaccatgttggctaggctggtgtagaactcctgacctcaagtgatctgccctccttggcctcccaaagtgctgggattacaggcatgagccactgtgcctggccaggactttattccttttatggctgaataatatttcattatatggatatcccatattttgttgacccattcatcagttgatggcaagcttcagaattaaaaaaaaaaaattaagctagttcatatttgctttaattttccaaatgatccctttccttttattgcaagttaagtgttcctatggtaatgactgttatggggcaaagatgatcaagtctatgagcggtccacacagttcaacaaatatgtacctcagcacactacctggaaccagacattgggtaaagataactttagaattcatggtccccctgagacactaaagactttttaatgaatgcaattagtaactttctacttactgttactctttttattttattttttgagcaggatctcactgtgttgcccaggctgaagtgcaatggcccaatcacagctcactgcggccttgacctcctgggatcaagtgatggctgagactacagtcatgtgccaccacatccagctctttaaaaaattttttttgcagagatggggtctcactataggctggtcttgaattcctggcctcaagggatcttcctccctcagcctctcaaagtgctgggattacaggcatgagccaccacacacacccagtttgttgctctttctgtaggttggctaaggattaagatgttatctccggtggctgaaacatgcctctgataggtgctatctcccttgtcttcattttcacgctggtggtaatcctggaagccgcagggatcagtcagatggcaacagcagattctttttttgttttttttttttctgagatggaattttgctctgtcacccaggctggagtgcagtggtgtgatttcatctcactgcaacctccgcctcctgggttcaagtgattctcctgcctcagcctcccgagtagctgggattacaggtgcctgccacaatgcctggctaatttttgtatttttaatagagacgggggtttcaccatgttggccaggctggtctcaaactcctgaccttaagtgatccacccatcctggcctcccaaagtgctgggattacaggygtgagccagtgcgctgggccagccacagcagattctgacaggtgatgcccttgccagcctggggagccttttggttttgggtttggtttttaaatttgttactgttttggtggttgtttttacctgttgtaaatattaagaagcctaggcatgatgatgctctgaagacaggaaaatttgttttgtcccgatttgccacacggactcctgcctgcatctgcgttgatgtggccacacggagagctgctctgctcaggagatccagcccgggccagcagctttataatcagttctgatcgccaccctgcagggctgtttttggcattttaatgtcccttaagtactttcagaagaaagttttcaaggaaaacctgaattttttctttattggctgcacatgttagacatatgaagatgtgtttcactttacaaagtggggggaaccctcaacaatctttaagagatccctaaaaactgagggttgtttcagaaccatctaaatccaagaacgttggacctgttatacttattctggcagatggacccatccctttttttttctgagacagagtctcgctccatcgcccaggctggagtgcaatggtgtaatctcggctcactgcaacctctgcctctcgggtacaagcgattttcgtgcctcagttacccaagtagctgggattacaggtgtgtgccaccatgcccggctaatttttgtatttttagtagagatggagtttcaccatgttggccaggctggtcttgaaatcctgacctcaggtgaaccacccccctccgcctcccaaagtgctgggattacaagtgtgagcactgtgcctgatcgccatccttttattggtgagaagaaaagggagcaagatgaggttgacccctgcatcttatgtgtgtactgtctctgcctctgtacacacacacatgcaccacagacacaccacacacacacagcccacatacacagcccacatacatgcacacacaatttagggttttcccccttctcacaaaaatcctctttaacgtgatttttactaataaagttataaatgtctggggttagaagacagccaaagttttgggtggcgcaagagataattcatcccagactccacaccccttatgccatgaaaacttcacctctccgtttcaagctgagaaaccccacatacactgcagatacattacaaggcagctaccacatcaccaaaggccaagcagaaggcattgtggatgccctgggtatatactctctgacacagaggtgactgcctaagcagtcagatttgcgacagtgtgatcctttttggaattcatatactggggcaagtattggaaccaaggttgccagcgaatggggctggcaagtcttttttcaagtttccttgtgtgttcccattctgaacaaggtggtgtcaagttgatcctgcctgtgggaatgcattgttcttgaatatttatatctttgtatgctcccattgggatttctcctttcataatatctgaaaagaacttgttttcattaaagccatttcaatttcgtacatttttatgcaataatttagtgtttatggtgtctcttaaccaacatggcttgttttcataarcacccgagaaggtttaaataacattttctcataaattagccctcgtttgcacacttattcagttattgcatcatgaagaccctctggagtttgatgttgtcaggaaacatattagcagaaaatagtgtgttattatctaatgctrataattggttagtggaaatgagaaaagaggatatgtaattggggttcctgtggctaacaagatgtgaattatgaaagcatttccaggagaaattccaggggtgttccaggaacctgttatttacattttaaaacatttgattcccattgaaaggggaggagggcgctgtttaccaacactgctttctttttcagagcaaatccatctaaatttcctgagtggtagctagatctcctaatacacctagcccctatgttgttttgactttgcagtcccattttaggctgctaacgttctttttgtaagagatatgttggcttttaaagagaggattacctagtacacatcacaagtcctgatcagaccctcttctccctcttggccccgtgattctgcccagtaatgtttacagcacacaacacgcaccaatactacttcccaaaggctgcttgggagaaggagcgtacctttagcaagaatctcagtataagcacagtataatgctttcttcattagctagattcacaaagctttctgcagcctgtgctgcttgaacccgagcttctgcttaatgttcttccatagccagtcattgctgagtaaggtggatgggcttctgtgttatgcttaaacaagtgaaatcaactcctgttctctcaaagtcattgatgagcatggtttttcatgcttgctcgctattgacttgtctggaaagattatactgttaaggacagagactctgtcagttgcatatggaaataatggatataaagattgcaaggagagttcattttccacctgcttgaggtcacattgaacctcatccctgttgcggaaaacaaatgggagtgatagctggtgccagttagtgtatggatgtcctcgaaattagatgtgccttcaaaaagacttgatttaatgttagccaggtctgtttgaacttcattattactattattattttgagatggagtgtygctctgttgcccaggctgcgcccaggctggagtgcagtggcatgatctcggctcactgcaacctctgcctcccaggttcaagcaattctcctgcctcagcctcctgagtatgtgggattacaggtgcctgccaccacgtctggctaatttttgtatttttagtagacacagggtttcaccatgttggccaggctggtctcgaactcttgacctcaagtggtctgcctgccttgacctcccaaagtgctgggattataggtgtgagccactaccattttttttttttttttgcgtgccttggttaatatctcaagttcagataatgttaaggttaaccacttcatcttattacctttcatcccagtaaagccttgaccttcacatataaaactaatttagtgtcaatacagttaaaaagtgtctcctttattcagaattacccatataatgtctttttttaataactttattccaaacttgaaaaaaattattatctttacccatttttccctgtactgtttatgatacaacaattaaaaaaatcttatttccaatttctcaatatttgataggtacactttcccccccacaggaaaaaagaaacagttgacaaaactttgttttaaccagcaaacaccttttgaaatggtgctgcaaattcctattcatgatgccatatttctaaaacactttttcttggtcatgttgaacttttattcagtaaaagaaatcttcattctgcttgtgtgtgtgtgtgtgtgtgtgcacgtgcacacgcacatgcatgtggccttttctccttgaatgtgacttattttaataaatttaccctcttattatataatggccatgtccagaaatcggggtgcatcgcttctgtacgtagagagtcaaggtcctaacaaacccgcccctctgtgttctgctagccatacagaagtggagtgtgttggaggtggacacaacccttagaagtcatccagcagccagcatcctcatatgctgtgtcaagctgagccccagaaattcagagagtacagctagtcagtgggagggtggcagtggcagtgacactgaggccccatgctctgtctgtgcgaggttaaggaggggtgagcagtgctttgtaaaggtatgtgaaaaagtggtctctttctatgctcattctgttttgccttctgtttggagccttgtctttttctcaggtgaggtctttgagggctgaggtagacttcatttctgcatgccttgagtgcagagatggtgattacattccaactcgtgccaactttgagcagagtggctgtgtgctatggaggtagtaagggaagagggaggtgccatgtgtgacctggacacttgccattcgtgactctaggacactgccctccacatatactgatagacacacacacacacacacacacacacacacacacacacgtgcaagtgtgggcccatactcacaccttgccactcacaccttgccactcacacatgctcacattaaaaaaaaataataatgagaaaaaaggattgcatacatctgccatgtgagtgatgatatcccggtctggggaggaactgggcttgtctttacgataaaaatggtagcttatctggagccctgatggcagtttctttgcctttgcagtaagttgacagtgtatttcagatgtaattagttcccatcaaagttacctcatcttcagaggtgagaattatcgatggtgcataaagctggatcagtgtgacctgtaaagaccttacctgtctccaaggttacgcgtgtgtacgtggggttggctggtttggatggttgctctttgttttttggcatccttgtgtgtgaatacatgataagaaatatgaggatgttaccttctcaccaatttttaaaaattgtcagttcagtactttgcttttttagtggaatggcccttagcaatatccttcttttaaatggatttcttattgttccaaagatgtggcatttccaaaagaaaattcttccatttatgcatagaaccttgaactctagtctttaaaaatctaggctttagtttcagctcttttttagctgtgtggtcctggacaggcccttttacatctagacttggagatttaaagaaaatcataaagaattaaatgagatgatttctaagactcatttcattttaaaactctgatctttcagagacgcacaaatccattccctcttgctgtggaggagaaaatacatgaaaatctgaatccatatgcatttgtcagggttctccagagacataaaaccaataggatgtatgtgtttatatagagagatttgtaataaggaactgrctcacccagtcatggaattccataatctgcatcatcaagtgtcatggtctgtagctgggaagctggagacccaggagagtccatggtgcagctctagtctgagtctaaaggctggaggactggtagaactgatggtgtaattccttttcaaaggccggtgggctggagcccagagatgctgctttagctcaagcccgaaggcagttactcaggaggatgccggctggtttggaggaagatcagccttgtattctgttcaggccttcagctgatgggctgaggcctgctcacatcaaggaggaccatcygccttactcagtgaatgttaaacttatctaaaaatatcctcagagaaacatccagaatagtgtataaccaaatatccgggcaccttgtgacttagtcaaactgacacataaggccaggcatggtggctcacacctgtagtaatcccagcactttgggaggccgaggtgggcggatcacttgagaccaggagttggataccagcctggccaacatggtgaaacccggtctctaccaaaaaaaatacaaacattwgccgggagtggtgttgtgcacctgtattcccagctactcgggaggctgtcacaagaatcgcttgaacccgggaggcggaggttgcagtgagctgagattgcacccctgcactccagcctgggtgacaaagtgagactctgtctcaagccacccccccccaaaaaaaaaaaacaaaaaaccctgacacataaaattaatcaccaccagagttttctgaggcaaagaggagtaaagctgttgcctttttcttcttgcctgtgaggttggttgagaktcttctaacagccaacaggtgttggccaatgttactctgattgacacctttctttttttttattcaggtttccctctgtcacccaggctggagtgcgggggcacaatcatggctcactgcagccttgatcttccaggcttaaccaaacctttcaccttggccttctgagtagctacaggcctgcaccaccacatctggctattttttttttttttttaatttttagtagagacgaggtcttgctatgttgcccagtctagtcttgaactcttgagctcaagcagtcctccagccttggcctctgacagtgctgggattataggtgtaagccaccacacccagccctgagtgacattatttcatacaaaattctcatctctggaggcctttgtatttttaggggttttgtttttcaaatgctttttacctctttctatacttgttcatttttaaatgtttcctggcagagcaattagtattttctggcttactaggtgctattcgattgcattagcgtttgaatattacccagctagttgtggagtggggcagtaagctcataaagaagcaagataatggaatacacaaatattactacgactttatgggtggcataccttgattcttgatccacgtggctgtgttcagatctggttagcacacattgacatcaggggctgagccaccagtgagagtcaaacccagcagccctgtcagtctaccttctctcttgacttgatccagcctcataacttcactttccgcaggagaaacacacctcttgaggtcctctgtcacaaataggcagtgtttctggagaaagccaggaggcagattttagtgctgttcagcatctgtggtctctactttctggatctggtgcattatggagaccatgaaatgacatgaaatagctcagtgctgccagtggcggtgacagggacactagaggtgaaggagggcccttggggcaattccagcaggtgggtggtggctgaaggtccttgtcttctttctgcagagactggccacctgcttcattctttcaagaagcaccaaatccctacttcagtactttgcccactcgtcatgtcaggagcatgaaactcacgaggccttcatttacttttatcctgtaacaccttcaatttttcccacatcctcccttgattcgtggatggacaactatggaggccaatctggctgaggtgaggactgcttgagtctaaattcctctctcctcaaacccaattcaaactggcctgagcaaaatgaatgtattgatccataactgaaaagtccagaatgatcaggcatcaggcatggttgcatccaggggcccatgtattagaaccatctccttccagttctgggctctgcttgcctcccagttggttttactgcacagaggcttattcaagtccagagagatcttatctttccctacaagtctgtgaccttgattctgaacctgcatctatgggaagggcttgcagtgtctgagtgagcttggactgtgtaaactttcccacttctgaagctgggggtggggttcactccactaagctacatggctctagagtcagggggttgccccctaagtaactggcagtattgttaccagaaaaatcatgaatggacactgagcagaaaactcagcagatgtttatttcctggtctttaggatttgttgaagagttttttatttgtttgttttttaagaaagactcaaaaggaaaaaaaaaaagaaactatagttattttctcatgatataaaaagattctgtagttgtatatacatttgaactttttgtaagacatctcctacccccctaaaattggaagtcatttattaagactttgtattctgtaagaggattggaaatgaataattaagaacattaaagaggaaagcagggggtggtgggaaagtgtggtcttgagggggtaataaacctcctacaggccacacacacacaagraaaaaaaaagggcaataagtgtagcccagtaacataaggtggggaataaggttaggggtaaggttaattctacaagttcaaagccagtagcccctgatgcgctgttggacgtgaactataaatttggctctgaggttcccaggcatggaagaayatctagatctgtacagagaggttgtgtgtgtgtttaacatttccataatgtacaatttcctctaagagtaaaggccatgaggaaatgcccgtggaagataaaggagaccatgtggtctgtggcaaccatggatacatttctttcccaacgcattctctgaggcactttggtaactctgcctctttgctctcagcattgtgttagaaaataaagccagcagacwaggattaaaccctcatgttgctgggttccttctagaaacaattggagggctaaccaagtcacctttggtggaaggcagtaaggtgagtcattgctgtggctggactgaataggatagccttagctgtaaaattgggctgatctttcaaatggactcatgcttgccgaatgactcacgctcctgtttacaaatcagctctgtgaagaaatgcagagtgggaggctctgcttgccagacggagaccttagacctccaggggtggagaacggagtacttcctctggtgctcggcttcccttcctgggggcagatctctcagcttctggttggtggctctcaaaatccagacacaaggtcagctgcagccagcgtgggccctggagtagctccagttatggggcagcaatggccccctctcattttgagagctcactttgcctgtggatggttttaatccatctggataaacttgaggcccatgggaataccatatactatggtaaccatgtacactgctctaaagatgtggctgctgttgtataactttttcctttatttttgtcaatttcctattttccagrgtcttgcatacccactatgtctactgtgatagtgaacgtaaaaacatacaagatgttggtgttatcctcaatctcttattcttaatcctgaacaaattacatgaaaaaatcgttcatggagtttttcttcatataaaactttttacaatgaacataaagggcatagctatttcttttttttwaaaaagaaacgtagaatattatttcttggttgtgaaatcgcccttcttggaccccaagttgttttttacagccctaaattctcttgtttatagagcctgtttatagagccatagacaggccaatgggtctctacagcaggcacctgcatgagttgactgggacctgagctatattccccctctgccatttactagcagtgtgaccttgggcatgctccttacagtctctgagtcagtttcctcctctgtgaaatgggcatgatactacctacctcataaggtaggggtgaggattaatggagtaagaggcacactcctgtccagggccccagacagagtaggccgtcagtaaactgtagcagctattgtgatagggtttgaaattcaaattaacgcatatttcttgagcacccaaggtgtgtgctgctggatctttcaaggggtccagaattgrtagtatagttgcttttctcaaaagactgtcgcctggcagaggaaaaggtgttaaggtatgagtgaagacagatcagccagacatggtgccgcttgcctgagatctcaacactttgggaggccgagataggaggattgcctgagcccaggagttcaagaccagcctgagcaacatagcaagattctgcctccmcaaaaaaataaaataaaaataaaaagattagctgagtgtggtggcgtgcacctgtagtcctaactgtttgggaggctgagacaggaggattgcttgagcccaggagtttaagtccagtccgggcaacatagcaagaccccatctcttagaaaaaaaaaaaaaagatcagctccccaaacagctgaagtattaagtggaaccatatgtaattgtatttttgtaggacagaaatatcagcaatttcacataactaatagattcagtaaggtaagttgagagagaaaatgctagctaactggttcttgagaggctcagaggaaggggaggccatgcccattaggagaatggtgggtaggggtgggaatacacaacaggaaggctgcctggaggaggttgcatttcagatgttcctagaagggaccctgagctggatggcagggaaataggagagttctgatttgtgctgggaactgtaatccctctatcatggagcttctatagaaatgtgggttagggcagaaaggaaggctgggggctgtgtgtgccttggtgacgtgtccccctcgctcccgagccttactctgttcccctttcttcctggcagcagagccccctcccttgctgcactcagggacatgactgtcagcacttctaccccccctcagacttcactgtcagcactcaagtcttcagggacatgaaaaggagccactccttacaaaaagttggggagccctggtgtattgaggtaggtctcggagcagaatcacggtatgagatgagctagctctaaaatgaagcygcccacccaaagtttacctctctctagggcagggcccatccactgygatccctgaattcttgttgggtcactgtcattttgggtgccatgatgtctgggtgtgctgaccgctgatagggatatcatagccataaaaacgcctgtttacaaggagagggtggagggtggtgctcgcatgactccaggatgcctggctcccagtgaaggccctcgtgatccagtgccacacgtaacttctgtgaaaatgaggagcacaacattatcccattaaacttggccccaggaagtgtctcttgggactcttcacagttcacaatggaggagaagttaccacctcaactttgccttcgttactagtaatttagaacttaaagattttcttttaaaattcagggtgctggaaaatgcccactttgcctcgacaatacctacctgaggcagccrtgaatggctttactcgcagatgttgctctccaaggacaggaagcattgttaatttcctttaaataattcaatacagtgtcaataccccacactgctcagtgcttgggagtaacagttctcttcaaattaatagtcctgaagaaaaaataacacctagaacatgcttttatcttcagaaaagcaaaagtcaatgcagatgaaaaattttcaaggaactcttaggtttaaacagcaaatgatttagtactartgttagcttttaaaaaaagaaaagtgaatatttatgaaccaaataataaagcctctgtctttaaaaacatttattgtatacctattgggtgctgtgctatgtgttacagccacagggacagaaagcagtgcctccagcaggcagagacctggagtaatacatatgtacataagtcttgctgttggagagacaaaatgtggaataagtcatctttaaaagtttgttctggcgtaggaagtgatgaatagccacataagacaactagaaactgtaaaaatacataaagaaaatgtaaatacctatactcttattacctattgataatctctctctcttttttgagatagagtctcgctctgttgcccaggccagagtgcagtggcgcaatctcagctcactgcaacttctgcctccggtttcaagcgattcgcctgcctcagcctcccgagtagctggactacaggtgcgcgccaccaagcccagctaattttttgtatttttagtaaagacagggtttcaccctgttagccaggatggtctcgatctcctgacctcgtgatccgcccgcctcggcctcccaaactgctgggattacaggcatgaacaaccatgcctggtcttttttattttttattttgagacggagtcttgctctgtcttccaggctggagtgtgtgatcttggctcactgtgacctccgcctgccagcttcaagaaattctcctgcctcagcctcccgagtagctgggattacaggcacctgttaccatacccggctaatttttgtatttttaatagagacagggttttgccatgttggtcagactgttcttgaactcctgacctcaggtgatctgcatgacttggcctcccaaagtgctaggattacaggcgtgagccaccgtgtctggccgataatctcttaatatttggatacatttccacatttctagtcattcatatgcacagaccttaaaagcgtttcgcaaaattggtattatacctcatacggttttgcaatttctttctacttttaattctaggaacactttttgacactataacatgtgcctaattctctttagtaacttcatgtactaaagtggaaatcctctggtccacctattccctgttagccagatgtgcataaaactgaagatgtggctgggtgcagtggctcacgcctgtaatcccagcactttggaaggctgaggcgggcagatcacgatatcaggagttcaagaccagtgaaaccccgtctctactaaaaatacaaaaattagccaggcgtggtggcgcgtgcccgtactcccagctactcaggaggctgaggcaggagaatcgcttgaactcagaaggaagacagaggtttcagtgagctgagatcacaccactgcactccagcctgggcaacagagtgagactccatctcaaaatgtttctggagtctttcggacttttcgctgtcttgcatgcttgcctctgatcttgcatgttcttgggccacgcctatgtcttgattacctggagctgctgtctgtgtgtttaaggagcattccctttaactggcctgggtctgatagagcagggaggcccccttttctctgcattagccatggcctggtagaagatctttttcagtagcctctcactggttcagcttttaataagcatagctgttcattctggctatttatgataagatgatatgaatatagctattctcccatcagagcctggcacatggtaactcattaatctttggttggcggcaggaggtagataaaggaaccaggcacccattttaagtatgaggaaaatgaaacagaaagactgggtttcttccttataactcaaggtctacaggagctgattagatccctggcgccagtgactgagcatttctcagccttgtcctcagaacccagaagcatctcccagggacgtgccaaaatgccacgtttccaggatgtcatctaaatctgtaaactgtgaataggtgaggtacaaagatgccacttatgggctgtgccaacttgggcaagttacccgactgatctgtgcttcaatttctccatcagtgataaaggttcacatacaggctgtatgtaaagcgggagcttgatgagagagctggtgggctcagactggtgcaggcaattggcaagattcttgaggaatcacaacctgatggtgtgtctgtgtgatgggccagtcgctgctggagtagctcagttatgtgttccatgtaggtttccatggaaattcacatgtaacattcctagtacctacttcaagaattttggtggtggctgggtgtggtgggtcatgcctgtaatcccagcacttcagaaggccgaggtgggcagatcacgaagtcaggagttcgacatggtgaaaccccgtctctactaaaaatacaaaaattaaccaggcgtggtggcacatgcctgtaatcccagctacttgggaggctgaggcaggagaattgcttgaatctgggggacggaggttgcagtgagccaagatagcaccactgctgtccagcctgggcaacagagccaagactccctcggctgggggggttggtgggggcagggtaagaattttggtgatctctgaaaatccggatcccacagcatgggtgtgatagaaatggctctgcagagtgtgatgggaacctcttgtgactggtcgtcagaactaagtttgagtccaacactcacttttttggcaaggtgcttccccgctccgtgatgcaattcttgcatctgcaaaacaggcggtggtcatgggatattcccgcagtctgctccactgggtacctacagagatcccttgacatttaacacaggcttcctgtgatccaggaactactgtacgaactactgtaactacctcctatattaacttttccaaaccttgatagcaaccttatgagggaggtggtgtgattattcccattttgcaattaaggtaactgagccagagagagagaaagcaatatccataagatcacacagctgaagggtgagagctataaaaattgctgggaatgaagggccatggttcttggccatggttcttggccatggttcagagctgtgataccaaccatcttccacttgttcagggagaaggtgtttgatccttttcttcactcagctgccttaggagttgggaggaaattttgtttcaggatacctaagttcttacaagtctcaacaattgtactttctgttccatctacatttcaaattcattgtcccttctctttctttccatgtaattcagccagattcgaaccctttagatcccttcctctagggaattaaggttggtagaccagctgagtaaatgtgactcagaaagtcaatatccacctgggcagggatgagtcatttctttctagttagctattcatgtacattttaaagctcgccacacaaagtcattacattgaggctattaacatgtttaatagtgacaataatagggtgtgacccatggcatataaccgcattcagataagaagaaagagttttcttttttcttcttcctgtaattgctcagtcaataccattttcayggaaatacttgcaaacaaacttttaaaaagttcattgtccaaagccttccctgattccttgtttccttcctcttcaggggttctataaacttttcctgatcagtggccggggattagcgagatggtgcactctgtcctgattttgtggttgacctacccttttgctggtgttgagcctgtttttattgcattttttggggtgtgtgtgcgcgtgcacgcgcatgtgtgttttttcaggagggggcacattattgctgctacttgcttattaacctctcaatctagaaatttcagggaagaagagacttccgctaaatttgccaagctagacacataaacagggagttagccattttggtgagaggaaatgaaacttttcttgggtttattagaccacatcctatgtggcttattttatgtctgatttctaaaaagcatgtcatcacggtcaaagttttatttttgcttgttagtcatttgaaacaaatatagatattgcttcatttcctgggtactgtatttttcrgtacgtggtatgtatggaaaatttgggtttacacaatgaagtgcactagaagggaagtatttgctaatttagaactctctacattataactttggattagcaagcattcggctaactaaacattttcatttatctcctacccctgattatataaagaagcagatgagacaaccaaagaaatacccctccaagacaaagtgaatattttgaaatacttcctytcagtcttttaaaaaatgtgatttaaaaatcgtaggtgggatcatactatacatgcacttgttttctgtttattttacatctctctatactagaaacactttcctatatatgccacaaaaactgtgaaagtactaatgattatccctcctgtcccttaatatgcttagctattgccccaatgaactcagactgtttccaaagttccgctgttggccgggcactgtggctcatgcctgaaatcccaacactttgagaggctgaggcaggtggatcacttgaggccaggagtttgagaccagcctggccaacatggcaaaacactgtctctactaaaaaatacaaaaattagctgggtacgtggtcccagctactcgggaggctgagacaggagaatcgcttgaacctgggaggcagagattgcagtaagctgagattgcacctttgcattccagcctgggtgacagagcaagactccatctcaaaaaataaaaacaaaaaacaaaaaaccaaaaaacaaagttccactataaatagtgcaactgcatctcatgtggcagagggtggaagttgcaaatagtgaagagagagtgattctgggacattccataatgcccccttgatgtatgtgacccatcattgcttcgcatgtatagccccggattgttctgtgtgagtgggccggcaaattcaactcctcctcaccccctctctaccccagttcatgctcactgggtaggatgggaggtgggactgccagattatttttattttttcctttcccacattgtctatctgccaatatttttttgttgaagtcttttaggctaaatgagcggacaaattttctctgctgatcaaccgccgtggtagcatcagtgggcactgcagtgcctccctgggaatttttaatgcctcagtgaggtcatattcccagtgtagagggaacatgacgtagtcccactctacttatcagatgcagagcttgctaccaggaaaacagacgcggagaagcygggatcatttctggccccatttccctcattgttcaccattccttggactgcaaagagatgtcattgtaaacgctatccttttcattttgtatactaagcaggaagcccaggcactctctgtggaggtcttccaaggagctcatccatgcagaagataggagtgttcctgcaccctgcatcctagcctcagtgagcccacttgacaccccccagggtgctgcaagctgtgcccatgtctctccacgttagtggctacctcccttttcccctttcgtcgtgagtcacgtattttctttgtgtctcgtgtgacaaaggtcactcgtagagaagatttgggcctttggtgtgtgacatgtcatccccacagttgattgttttggctcctccccttttgtaatgctgtgaggtgacaggtcagtttttaatgggctagtctgcgtcaagggagagtataaattagccttaagactttgtattccatatagggtttcccatatgagaatatgcagttagcacttagggagaggggtagacgctgcaggggtggttttgacttatctgcctatcagtcagcgtctctgttgacgtacctgtttctcagatagcaatcccttttatgacgtcagcaaggtagatgtttggaatttggaaatggagaggaaccatatttcagcccagactctggaacttaatttactcatttttattaagggcagtgattattaggcaagcagctaatagcagatctgagttcttattcttccttataaggcctgtcctatggaccttattggaaaggtatttattgcatcagctgctgctggtttagtcaggagcaccatcatctttcaccttttacttcacacccatccagtgttctctgtcacgtctctgaaaggccatttcaaaccggtttgcattaagaaaaatcagtagtttcttttttttttagtttggtggaagcgccataggaggccagatttgcttttcctggtcaatgtctggcctcttctgtgggggccaaaaatgaaagaggagcagccacacccttttagattctggccatgtcacagcacacttacagccagcttcagaggccagtgcagcagggagaaaagctcttggctgggaagatctaaattagaggcctgtttgtgctcagagtgaaagtttctgttttggaaaagccagctccctccagaggggagggtggggatgggaaagcaacgaagacaccagagaaagaagaaataagagggggacgtgaggaggcatgtagtgactgactgcaggacatgggacccccctgctcggcttctgctcctaccccaccggtcactgggtcagacaagcttagcctgagccccgcgtcaccatccctgtcctagtggtagcctcttgctgtttagaaaaacagagttgggggagatgacagtagcttgcctgtgatctacacacagggcaggttgggaggggtcctgcacactctgtcacgtagtgctcatcccagctcctgcctgctaggtttgtggcaatatttgtggtaagccttgtggttcgccaggggccagggtgacagatgagaagtccacttgttcctgagaaatgagctccactagaaagtaggagcagcttgtaaccaaccagggggaagtcctgtgtgtaggttgtcacaactctctctcaggacaaatttctttcctcttgccagttgtagaagaacccatgaggaggccgggcacggtggctcacgcctataatcccagcactttgggaagccaaggcrggtgaatcacctgaggtcaggagttcgagaccagcctggccaacatggtaaaaccccatctctactgaaaatacaaaaattagccagacatggtggcaggcacctgtaatcccagctcctcgggaggccgaggcagaagaatcacctgaacctgggaggtggaagttgcagtgagccaagactgcaccactgcagggtgacagagtaagactcttgtctcggaaaaaaaaaaaaaaaaaaaaaaaaaaaacaaccatgagaaagatatatggaggtgagagggaaaggtgtaccctggagggatttcttatggcatcttttactggcttcagaaacacaggtcatggccagacgcagtggctcacacctgtaatcctagcactttgggaggctgaggcaggcggatcgcctgaggtcaggagtcagagaccagcctggccaacatggtgaaaccctgtctttgctaaaaacagaaaaattagccaggcgtggtagtgcgcttgtaattccagctactcgggaggctgaggcaggagaatcgcttgaacctgggaggtggaggttgcagtgagccaagataatgccactacactccagcctgggtgacagagtgagactctgtctcaaaaaaaaaaaaaaaaaaaaaaaagaagaagaagaagaaacacatgtcgtacctgaagggaaggtaggtcctttccctgcccttcttccccatttccttggtaggggcagcagtgtctggcacaggctcctgacccttgtgatgtaatgatatgttggggatgtttgtttcttcttggacctttcctgtttgggacagcaaaatctacaagatccaggtctccgttggggctttccgcactgggatcttccttggtcaggtcacttgcagctgtttttcaaatctacactcaatggcatgcaattctgtgccctgatttaacgtatgagggtcaagtgtgagacgtgggatttttatttaaaaaattgtattttaggccgggctcggtggctcacgcctgtaatcccagcactttgggaggccgaggcagatggatcacaaggtcaggagttcgagaccatcctggccaatgtggtgaaacccccgtctctactaaaaatacaaaaattagccaggcatggtggcgggagcctgtagtcccagctactcaggaggctgaggcaggagaatcgcttgaacctgggaggcagtggttgcagtgagctgagatcgcgccactgcactccagcctgggcaacaaagtgagactctgtctcaaaacaaaacaaaaaacaaaaaaaatgtattttaaaatatattatgatcattgactttttcttttggtctcctgttctacgaattgtaatataaattcgtattattgccaccacgtaggacacagaacagctccatcgccctgtacatgtcctgttgctgcctttgtgtagtcactggagatgtgggttttatttttattattttctccatttgatagatagtgccgacttgattcacttcatccattccagggccaatttttcactgttgattgtcaggggctctgctctgctgtttctccagccctctccagtgaaagagatgtaactgcagtgccatagttgtcagcttgttagttattggcaagtcttggttggattttctattcttcattgtgggctgtccttgcctgtacacctagcatgctctggaaccctttgtggatttatgagaattcaagaaaaaaaaatagccagggaaatatgttattgctaaccatataggcctcagagtgaaaacggcttttggagtattctgctttgaattatttattttagtctttctcagatgtcaggacagatttttaagatttgggcataatgtttaaaatgaagatggtatgtctgtagattttattgacccaacttggtccccccaggctgtcctcayctgccccackacttagatgaaaccaggaatggcaagaggagagcatccaagccgcctgcaccagccctcagtgcatccccacccaggctctggaacragctgctacatgcacgggaagaccagagctgccgtcttcctggctgttgttcagagcttatgctttcttagggaaaagtacaatgtagggctatgtgtgtggtggggatcttctgtgtgtgcttgtcctccccctgggaaatgatgagaggtgacccccgagctsccagctcagtgtcacactcgagtgaacagtagatgatgcttctgccrtgcgttttgctggggaaggtaacagccatcgcacacatgtaaattcttgtgtaatccaattcctgtctttgtaattacttggagacttgccatcgcagccaattgagaagtgggagcagtgaccctgggcagaaagcagaaattggagaggaggggaggggcggggaggtggcatccagaacacagttgtagctctcctggctttacagcatctaaaatcacttcaggatcaggaaaaagcaaaaacattataactgccctccacgcaagtaccccagcttttctgtcccaagttcccactccctctacctctctcttagcaggctggaggaattctcagcaagcgtgatagagtcaggtcatccgtgacttagctgagaggaaggacttttactgataagaaactcccattgtctggcaacaggtttctgtagaggaatgtcttccaggtgggagaagaatggctttcatttttaacaaccacacactataaacaaagcatcccgagagcacgggtacctagcagaagaagaacgaagtagccaggaaacaagttgcttttcagcatccccactgaaatgatagggtactttagaaagcgggtggtggcattctttccacaagtacagcaagtgtcactgtggggtcttaattctctcgaatctgcctttagaaggcagaaggcagaatgatcagctctgctctgaatgtgtttgccatttgattgacgtcggaaacatgatgtcacttctgcaaacacccacgtgagaaggtgtattttttttttttcttatttgggtgacagattgcatgttagggcactaaaagatgaaagcactaaatacttgctttagaaaaacacagtggaagattctctcatcctccccgctgaaaatttatgggcttagaattccatraaccaaaatgactgtcttcagttaaacttattgcgaccctctgggcatgattaacaaatcaggtggaaagggaaggtggaggagtatacgggattcttttttcatgttgtgtggaatagggcactttagttgaaattgaggttcaagttagcaaaaagaaattccatccttcggctgggcgtggtggctcacgcctgtaatcccagcattttgggaggctgacgcaggtggatcacctgaggtcgggagttcgagaccagcctgaccaacatggagaaacctcatttccactaaaaatataaaattaggcaggcgtggtggcgtttgcctgtaatcccagctactcgggaggctgaggcaggagaattgcttgaaccagggaggaggaggttgtggtgagctgagatcgcgccattgcactccaggctgagtgacaagagcgaaactccgtctcaaggggggaaaaaatccatccttcttcaatgtgtatcttatccttctcagtgtttaataggacgttctactcaatggattggtttcctccctataaaaaggagcattttgttattccctctttcagatttaatgataaagtcataattcctgcaagccttttgaggaggatatatcttatctcataagatagctgggcacagttgttcaggcctatattgtcagggctttgggaggcctcaaggatcgcttgaaggcaggagtttgagaccagcttgggcaacatagcaagaccccatctctacaaaaaattaaaaagttatccaggcatggtggtgcatacctgtagtcccagctacttgggaggccgaggcaagagaatttcttgagtctaggagttcgaggctgcagtgagctctaattgagccactgcactccagcttgggtggcagaacgaaaccttgcctcttraaaaaagaagagaggggctgggcgcggtggctcacgcctgtaatcccagcactttgggaggttgaggtggscggatcacaaggtcaggagatcgagatcatcctggctaacacagtgaaactctgtctctactaaaaaatacaaaaaattagctgggcatggtggcggccgcctgtagtcccagctacttgggaggctgaggcaggagaatggcgtgaacccaggacggggagcttgcagtgagccgagattgtgccactgcactccagcctgggcgacagagcgagactccgtctcaaaaaaaaaaaaaaaaaaaaaaaaaagagaggtgtggtggctcatgcctataatcccagcactttgggaggccaaggcgggtggattgcctgagctcaggagtttgagaccagcctgggcaacatagtgaaaccccatctctactaaaatacaaaaaattagccgggcgtggtggtgtacgcctgtagtcccagctactcgggaggcaggaggcggaggttgcagtgagccaagattgcaccactgcactccagcctgggtgacagagcgtgactccatcaaaaaaaaaaaaaaaaaaaaaaaaaaaagtgagaaagaatgtggttttggtactcagtgtctaggacgtctgtttaatgggatggttaggagcgtgtgctctgtactctgagctcaaaccttggctttgcctctgaccagctgaatgaccatgtgcaactcactgtttatgcctaagttttcacatcataaaaccaggacattattttgcctatctttacttattagtagatttgaatgaattacagtatataaggcaagtgacatacatggaaactggcaaacatctgttttttgttgttgttgtttgtttgtttttttttttttttgagacagagtctcgctctgtcgccgaggctggagtgcattggtgcaatctctgctcactgcaacctccacctcctgggttcaagtgattctcctgcctcagcctcccgagtagctaggattacacgtgcccaccatcatgcccagctaattttttgtatttttagtagagatggggtttcaccgtgttggccagggtggtcttgaactcccgacctcaggtgatctgtcttcctcggcccctctaagtactgggattacaggcatgagcacctggccatatctgtattttttaattcacttctttgatttgggaggaaagaaacctgaaccctcttcttagtgggagtgggataggctttaatgttaatactatgcatcatgtattaaaaatccactatccttctggcactggattaagcttttcataagtattattgtttcacccttacagctgccacagaagagaaaaaccaatattatttaaagtttatgtataaataagctagtcgctaacatgtactcagcacttactgtataccaggctctgccttaagyggttttcatatattaactcatttaatctgctcaatttgtgggaaccattttttctcattttatagagaggaaactggtgcagactttttttttctttttaataatttgtccttggttccactgaaagtaattgttaggactgggatttgaaggctgggtcttcaaatgttgtccaaacgaggctgcccacctccccatcaatgacaaccttctgtcctgtaatgtggaagtgggcccagctgtatgagaagctcagagcacacagatgctgtccagatatgctggcttctgatccttgcagagaaaaaatctttattaccggaagttgtggcttctgagcctctctgcaattggcaacatagatttttgttttgttttgttttgtgtgtgtggttttgttttttaaataattagaaacagttctacaattgttaccacccacagtaaaaaattgcttggatcccgcgaagtaagaaagaaaaaaaaataggccatttggtagaatgattaacagggggctttaaagaggaaagtctgctttggagggtgagctttggatgtacagatgctgggaccctcgtgtttttcaagtcccccatttgcctgcattgagaatcaaatgtgaatggtggttgccagtgataggaggggttacaatgcgtgagatggctctgggaggaaactcacattttttcgtacttattaatggtatgtcttttgtgcgagtgggtgtgagtactgagagcatcaagtgtatatttgcacagtgtgtggtccttgctgctgtgttccactccccatgatggtgggctacactaggaggagaagcaagccttagcacagcttgacagtttccattatatggacagagtcactgaggcaggagcaagccaggcctttttccaggtcaagggagctgggtcagtgtagctgggactcttggtttcttagcactgtgctctgactatcaaagctacgcccccacttttgtgggaataaaatcggtgcccttgcatataagttgttcgcttcactcccagccccctcctgagaattaggatgggccaggatctgagttcagtgcctttggtccagtaagatgtgctattcattggcgatccttcccccatagtttcaagactgtaagtggtcacatgggcaaagagatgatttcctaatcctcgtgggagcttgaaggatttgcctttgttaaaggaggaacatcacgctggaggggtgtctgtctatgtgtcccacttaaaccacactgcttttgacttctcctctgtgatgattcccaggcagcctcctcttgccatcctgacttgtttaaatttatgggttgttggcaagcaattttttgatgctattcttctcatagccagaggccaagatcccttgtggagcagtgcctgaatttaatagatgtcatctggacaccagggaggggcattgagaagcactgggggaaaagtcttagaagtgagattttacccctaacgccgtctcccagcctcttatttatccttttcagggcaatgcagcctgtgatttttttggtggtaccatagtgtcatataccatactctacaattctaggacaaaggacacagtgtcctaatggtcttgcagatggcctaaaatacatatggtaagccacttatttamtttgatctcaaatatctcagcattactgagctctacacctggatgtttacaaagcctgaagatctgtacccactgctgtaacatcaggtgacactcaaggaacacaattctactcttctggctgtctggggtcttgggtcccaggctagggtctaaggcagacaagacagtaccatcccattagcttggtacatgaggcttaaacagttcctcgaagtcatggggtgaaggagggcacagttaactcagcccccgcttattcaaatatcagattgctggctgatagtctccctccctgcaatgttggcaggaagcagaaaagaagggaagattgtgacaataactgttgcaaaggccattaacttgactttgtgggacagacatgtaggtctctctttrctgcttctggacacaaattatgggaaagcctgcacaataggtctcattaacttccagagtgacatgacagggactccagcttttgggacagcttgagtccatttagtaaaatgttattgaggacttctgtgccaggcagggttctggtgttggggacaagggtgtgagtgagaggactgagttgttgcctttaggaagtgtaccgtctagccaggagtaacggcttgagtcgaagtcggctcccattgggcctcttagggagtcccagtttgctctgaggcctgctcctctctgggaagaaatcaccttgagagcttctgggatttggaactccctgcatggttggatcccttccatcttcatgtgaatygtcttggtaatgaggctgcccaggaaagccataacacagggacatttggtgggcaggtccactttcgaagttctgggagttaccgtggctattgttctgactgcagtctagatgctcccaggcccatttctctcctttttcactctttagttctgcctggtgaccagggaggtgccccgcacctcacctgtctagtggggtttcccaccacacttccaattcttgctcattcaacatcaagtctttgctctgcctttcttcgaatcacgaagatcctgtctgccagaagcatcctgtccaggytccaggcagacgacagtctctgagcattccagggtcttacagtttagaaagaggagagagcaagagaatcttaaaagcaccataagctggagctgtttagaatagagcaaacggcccttggggctctggcaattgatgtttgtaattagtatcctgatttattaagaagagtttgttgtctccaggattaaaacaaaacaaaacaaaaaaatagattctttagggagattaattgggactgtcctgtgggtaaggagatagtaagaagatagcagtaagtggaatgttacctaacaggtaaggtgcaaatgggctctgaggtactcccttgaacctgggcttctgacacaagaaaagtaaaataactcaggtcagggaaatggacctgagtgcactgagaatattaatgcaaacagaccccaaccagagtaatgtgttcactgtggttggggtgggtgggtttgtagaatctgttacagaatcttggaattgtgagagcagactgataactctaacctgaccactcttcaaatcctctcttgaacagtgaggaagcagaggctcagagaaagaagactgctgtaagatcaagcaatcgtgtgtagccagacagtgggagaatcaagactagaatccagatctcttggttttcctctttcccctcggccacctccrattcaagggagagtttaattttgtgaaccattcctgttaagtgccattaatttcaaggtctttctggattagtgtgtgaaattcagtgtgttcagtatgaattcacttattttccacttgaaatcctgatttttctcggatgccccgggtgttgatatgatgatcaggaggctcgtgatggtgatgaggatggattaatataatcatctctgctaaaggttaacgagaaagcagtgagctggaattgatacataaaaaacactgaaaacttttcaagcagtgaatgtgctttagcgatacatagacaatcagatcttaccatttatgtgtgtattttgaatgatgaatgaataactagtctttcccagaggactggtatttgggaatctttttataaagtgttgctttctgggctttcattaaaagctcaaacatagaaatgtatgaaaatgatcctttkaaaacaagtttggcaccaacactatgtgagaaaacttgaaaagtatataggttgtggatcaccagttctcgaactcaggaccaccctgactgagttgaccatgatcagaatggatgsaagagttcactggttttataatttttgcgaagagctgtcttctgcccttagcactcccatgtcctgtaaccaggaaacaagccggtgccctgggttgagttcagcaagtttgttttgacttgcagcccatcatgggagtgaaactctcattatgtaatgttaaactgggcctggaatgtcagcagagcttggcctgccaaagcttgaagggttggttgggaatggactatgtttagtatgactaatccagctcggctgggtactgggtgggtgggtggctctctgaggagggaggtatgacttgggctatttcaaatcttagcactttgtataaactctgtagtccctcccctcacccccttcccctcccacaaaagaagttaagccttactgaccaaccagtacagtcaggggctgttgactgatacccaagccttgatgtacacatttgtggtcaagacatcaagttgcggccgggcgtggtggctcatgcctataatctcagcactctgggaggccgaggcgggtggatcacgaggtcaggaaatcgagaccatcctggctaacacagtgaaaccctgtctccactaaaaatacaaaaaattagccgggcgtggtggcgagtacctgtagtcccagctacttgggaggctgaggcaggagaatggcgtgaacccgggaggcggagcttacagcgagcttgcagtgagccgagatcgcaccagtgcactccagcctgggcgaccgagcgagactccgtctaaaaaaaaaaaaaaaaaaaaaaaacaacaaaaaaatcaaggtacatcacttgcaattagggaaataatgcttttgggtcctgtgaaataatggtgtttcttaaagcagcctatattggtcaagcgttgctggcaggggcacttagtaattaaagcaattacacaaagtaaacattaggttccttaataaaaatagcagtgaaccctagtaaaaactgaatgtaaggaaagaggtgggctattttcctaataaagattccaaagtataatttagggtctgtcggctgaccttcttggtcttcctttgagagcctccagccccctttgcccccatacttccccaccaagcttcctcttggctcttcttaggggacaaaagaatcccgtttttatgcaaatgtttttagctggaggtagaataatcaggaaccatgtttgcacagtgatccttaaacacaatgtggacccccccaccccaccaggcaaaggttgcattttggtgaggatgacagagcccccagcctctgctccgcctgaggtgaagtggggaatcgcttttgtcccttccctgatgaatgggtgtaaagtgttcactgaacctggaaacacctccttttgtgtccggtgctctcctaacacaggccgttaaacttggggcaatcgctcatggtgggggattgaatggggccattgtgggggggaggggtgcacactgaagccattgtgggcatagagatgccattgttttctcagtattaagaaaaggagtaggactctagggacctccaggcatcagtgtggccgaccactgcactgactgcttttctaggtttgcattatccctgaggaaccccctagcctgagaggttgggcaaggtcagcctaggctggcagcaccgcggggcgccccctgcagtatggacgtggtattccctttccggcctctgcagggccagggcgctccatttcttcccaggactgcctgccctggtcgtggccgtcatttctgcagggaggttgctgttttcctccaggcatcggagttaaaaagcatttgttcaaaaatcacttcttccactttaggaataacatattctcccattccctgccggtgactttttcatttaattttcgttttgccatatggtctttcagaggcactctgatcttaattatagtattcagcctttgtttatttaaaaatcagaaggcagataggctattgagggtttatctgtactaattgtaccaccatacctgccaactgtccccttaaccactacaatccctgccgacagtgtgtatacacaaacacacgcgcgtgcacacatgggccacataacgtaatgtgttgatcagaaaggagcgtatttccagctttagaattgccgcactggcattttccatcatgaacccctgccatgtagtgttgacttgaaggggatttagccatgggattgggaagagcagggagttagggtcagaagacctgagctcaaatcctgattctgccacttacggtgttatcttggggaaacaattttattcctggagtctcagttttaccatctataaaatagggatagtgctatcaatgtcccagtaagggtgtgggatttattttttaatttttatttgtttatttatttttttgagacaggacaggctctggctctgtcgcccaggctggagtgcagtggtgcaatcaaggctcacagcaacctcccctcctgggttcaagtaattcttttgcctcagcctcccaagtagctgggattacaggctcctgccaccacgcccagctaatttttgtgtttttagtagaagcagggtttctccacgttggctaggctggtctcgaactcctgaccgcaggtcaaccacctgccccagcctcccaaactgctgggattacaggcatgagccactgtgctggctgggtgtgggatttaagtgagatattatgaaaggctggtggatgtgttaagcatcctgacatctggtgttcaagagttagaaagtgaagccccatacagcttttataatcaacaggcttagatgcaatggcctcagttgttttttgaaacataatgtgcatatggttcattttgctgttttacctgcctctttgataacttaaatattctaattaaatcatggcttatatcagaatgtataatattttatagatcttttaaaaagtgacttgtttgaagattataacatcatttcatacagaaaatagctttgctatgcttacattttgaaaacacctgttgaarcctctaaagaaacatgtttataaaatgttaaacacgtcagttatatttttggtttaaaacaagcatgataattcttgacttcttcctctgaatttgggaagctcttctgttagagaaatcaatttttttcctccctgatgcctgaataaagatgcattttaaaaaatattatctttgtagataataatgaacttttagttgttatactaggttctaataactttttcatcaggccatcacagtctgaataattgtaaaaaagtcaattgtagaaactgtttaaagaatttccaattctaacattttctttgaaatgtttgagattgtctactggggtttttttttttttttttttacgaatttttttcctaaaagatttttcagaagcagtgttttcacatgtaaatatctgcaacaaacagcacttaaccagtccttaattggttctatatatttatacgtgagacacagcaataaacatgtagtatacacatgtctttggtaaaggaagctcttcttctcacaagcctggctgccccaaaattatagtgaaggacaatgtcgattctaattgctggcttttgacccctacatctatatattttacctaatttatagttggaaaaggagctaaaaatgttaaaagggttcatgccagtagtttgagttgttgtagtttataaagccctaaaattaagtatggaagtacaagaaagcctatgctatgtactgggtcaaagagaagaaatccaaattaatattaattggtattcatgagcaatccctgagtgcccgtaatgtttctgtcccaatcatagactaatctggccaattgtatgggtcagacaaaatagccaacagctctgagtttagattggtatgaaaaaaggggatctgactgttaacaccatattccccaagtctgtaatgttctctgacctccagtgcaaatagctgttcatctttagatgatttgacagcataatttagcatttgggattcctttttttttttttctaagtggtgattaaaaacttgtgcttcttctctagcatataaatcaagcttttcagttatattttccggggcatagaataattgaagtgaattgaacattgggctggatggtcatagaactggtttctgttagaggttaactgactttgaggaaattataccatcaaggtactctggggtgtatctgtcagctttttgacagttgtaaataattatctccctctctagattattaattccctgagggcaggactttgattcactgatatatctatctatccctagtgcctagaacagagccaggcatgaaataggcactgaatcagtatttattgaatcagtgaatgaatctccaagtgcacctaagggaaggataccaggaagagtctactgtgtttatggaaacagcagcaataattcctcctcctcattttcatttgctgaaattactaaccaactgggtgcggtggctcacggctgtaatctcagtcctttcagaggccaaagcaggaggatcacttgagcccaggagtttgagaccagcctgggcagcatggtgaaacctcatttctacagaaaatgcaaaaattagccaggcgtggtggcatgtgcccatcacctcagccactcgggaggctgagatgggaggatcacctgagtccaggaggtggaggctgtaatgagctgtgatcacgccactgcactccagcctgggcaactgagtgacaccttttctttaaataaaawaaaataaataaataaataaaattattaaccagctratctcaaatcaattcttctaaatcctctgagcttgtttgtttttctgtctgtaaaatggggctgttttcatgtgagacttagattatgagaaatagtcacgcctaaacttccttgaggagatgctagacaaaaacaagatggttttgaaaaaaataacaccaccgtccagactgtactaagatgcctggttgcatttgaaaccagtttcacagtctgctttgggcaggtgattgcgacatgctttccatctgtgcctaatgggagtatactcccagctccacatggcagcaggaacattggcagggctcttctggagagaggagagagccaataggcgttgctatggtggaggcatgacataattcaattttactttattattcactggatgtgcccattgtatgttagcctctgggtatgtttacaaggagcttaggaaagaggtagaggctgtgttgtctgtagaggctgtgctgtcagcagaaggggccaggcatgttcacacacacacacatgcacacatgcgtgcacacgcacacttctcttccctggcatgcagcaccaatcttggggcagaggtgaaatcaccacccggctagcgactggcaaggctcagaaggacttgctttcctaaaatctcctcccctggtctcataattccctgtagcagcttggggcttgggtgtgtgcacacctaatttctctgagaacacatacgtgttgtaaagggcacagcaatttcccgtgcttacttaatagtgtttaaatcaacttactggatttgggtgcctttccttgccaacattcctaaacttcatgtgaacagcaaaagttcaaagtccaccaaaacatcatttatttgttaatgaaaaccaagcaatttcagaatgggatcgtactgtcctgtactgtcaccttctctctgatgttatggaggcatgttgtctttctccagaggcaagcaatattgtgttttaagcttatgaggcaatcatgggaggcgagtttggccagtgtttctgtgtattcagatcctcctccttttaaaaagaataaaataaaaggtagaaggcttttccctgattatgcttttctggtgggtttctatttgtcattgcggtttataaaatggcttcttctcctctgcttccaattcatttgttaatattaactcttggttgtagcagagagtcaccgttatctgaaaagcaaattcccttatttttgtcatattgatgtagtagcagtagttaattagggacctcatgagtgacaggagtttttgggttctataaccaaaaacccaaacactggccaacccggtctgccttgtcaagtcggtgaaatcctgacagcttgcagtttcttcagcctctctccctgcacttcagtacaggagcagcccagtaatagtcccgatcgctaataagagcacaaacacccgtaagcaggtgaattggaaatattgtcattttgactacatcaacaacttataacttaccaaagcaacttgatgtccttacttaattcttcccccgcacctccccaccagtgcttgattaacaaactggtcagtggctatttagacatgaatcacagggcataggacatcctcataggatgagctgcctgggctggacacactggccaggttgatgacttctcttgaaaggggggttctgtgttgctcgcaccttcacctagaaggagatgtgaggcatttcttagaacagtgttcaccccctttagaatttgtgaccctttgtccttgttagtcttgatggcttccagttctccaagccccaaagaactgtgtggtttctcttatttctgcagcatttaaagaaattaaattagttttcctgggctcctcaccatctaatttgtttcccattagagataaataatgacgtttggggcatcataaacccaaggatttccatgttagttttccaaggacctttttttaagagagaggggaataagaatatttgggtcagatgttttaagatgttaaatataaaaatcagccttttaagaatcaaatgcaaagccagtcacttagccttgaatttcccactgtgattccacttttcaaaacccaggatgaccatcatgatgggtttmgttgkactatcagttgttacaggtcaaatcatagtctcatgattgttaaaatcttaataaggccccctctaatcctgtgagttttcagaaggaaatccctgtgaacaatcctggaattgctttgcctggtaacatcttatttactgacaatatccccagctgagctctcttggttaatatgtttgctctggcactgtagttcctttttaatcagaaatgcttatcagtaggttgcatggttggggaaaatggcatttattttgtagcattttcccaaggaatattggatgaatattyctttagtactaaatatataatggtctttgtcttaagaacttattagcactgagatttctgtgttggaattttctttattgataccggtttgtaggttctggagagtccaactgatatttttttgcatctcgatcagaagctctgactttttggtccttagcagagaatacatcccttgatatcttggaggcgcccttagtggagtcaatggtgtgtgggcttaaggagaagtcagggcattagcaggtctgtattttcctccagcgtggagttttgtcatttctaatgatgacaatctatcagtccacatggttcaaaatgaagataaattgaattaatatatgtgagttaacygactcattgatataattatactgtgaggatttctttagtgtaacctaacacatttagtagtgttaattgtaatggctttgcacgggagcacttaatttcctaagcaaacagaataatttattaattctcaaaaagcgatttcaaggcctagactgagagagaaagagtatgtgttttactgtagtctcagtttgctttggcttatcagattgaaaattgctaagaatttttttccagattccaacttgttattgctacatttccatgtgtgcccaattcaatagcgtattgaaatgaaagtaggaaataggtaccgtccagtaaatcttaattaagttattgaaaattgaagagcactgaataataaagcagttctaattgcagttaaaactgtattsgcagcagatatgcttgaacagggatgataaaacagctgaggaagagcgttggatggcagaatcgaaaaagggtaatacacagattaaatgcaaaactcaaatgttttgtgaaatgtaggcaagctgtgtaaacctattttttgctggaaagcatgttttctgtcatgtcagaaatgatcacaggaatccttttaatattcatttaaatagtttttaattggcttcagagagtttaaagttcagcatgaaggtgagatctaagcttactaattagatcgaatgcagtttgacttaaagagcagacttgataattaaagaatttcataccaaatatacattttgaaaacatttcttttcacatccttgaggtaaaatgagttttcctgaattttttcccttcttttcaaatagaaatttctcttacagaaagatgatcaaatcttgtatcgcttgttagaaaatgacaaacctctcatttgtttgtcatttagccaacatcctgtgttcaggttattctaattttttttcccatccaagtagaattttgaattgcacggaacgttgtgatgaacacaagttgttgtgtcttgtgtttttccccccaccaagttgtttgatgctgttgaaatggaaggctgaagtagaaggggcacttaagcagtgaagggtttttctttgtaaataatagatcaagagcactggatctgtatctaatggagctgtgtgcggcctccatttcaaggacagcgcgcggttttaaaaaccacaactaccgaccatcccgtccacaacctgtggtcagttttgtgaatgtgtgtgcgtgtgtctctgcttgcctcctctaattccttagcacccttcccccttaaacaggctgctgtcacgtcatatttgatttcataaagttaaaaatagaaacctcaaacaatatgaagatgtgtatcgatatagctccttacctgtcttctaatattatggaatgatttgaggaacttcaatcctattttactcaatgtgtgaatgagcctatttgactatggtaggctttctaagaaaaggtagatgtatgtagctgacaacaatgcagaaatgtttgtcttaggagcagaaaaactggattggttatgtatagtttatcatgataatctgatgaaaaattaaatttatcattttctccctcttttcccttccccttccccttttgtaggttataaatatgttcttatatttgccagtttgaacttgtgtttgaaaatcatagatttgatactctcaagtattgtggtgttattgcatacaattcctaaaagcacaataggactttgttccctctgaatttgaattagttatattttatcacttataatctaaattagacctaattaatattttcccttgtagtgtaatagtgcaaacattgccagtatcttaaaatatgtagtctctgttaaaagcatatttgaaaacagaaaaataaacattatatgttaaatatcaagtaggagtctatgtaaataaaatagaaatgaaagtacagattaagcctggggatcctttgcttatttgtgaaatcgttgtttataagattacaaggtagttactgtaaattgaaacatttctttttttgctgcttcccccccgcccgccccaagtgcatcctacacatttgggcctattttttaaaaagggttaaatagtctttccttataaaatagatccatagataatctaggtaaatagattttaaatcatacattttaatattttttattacatacaaaaataaatgttgaaagctaatgttcctaacacactgctttcttgaaagaaaatcattaatcttctcaaatgcaagtgtaaagttgatccattttagctttcttgtccataaattgttgattattggttttgaaggaaaacgcagtatgagtgtggtttgaattttaacactgaaatcatagatgtacaacatgttcattgcagtcaaatcacaagcagagagaacccatttgaaacaatatttaaaacattcctgtcggggcattatttaatgggaatgataagtttcagattttaggttttagaaagttgaggttggctgtacatcaaatctacgatttaactgctttgaaagaacgcctttgcttgtcttcagggggaaacaaataacttaggggacatcagttcattctctaacagtctttcatccctaagtataacaaattgtttcttttattaatgtggtactcgcactatggaagcagttctttggggaaaataatcaggaagatatgctttgcttctcctagatgctacaacctgaaatatgttgctaccttccttgaagggattttctctctctctctctctctctctctctctctcyctctctctctctctctctctctctctctctctctctctctcttctccccccaacaaatatagctaacgtaatagaaattacagaacaggatacaatgagatttctttccccttctctcacagcacgttttgtttggctaggagaaggcaaggtattggaatatgattatccctatttaaggaaaaaaagaatgatataatttgtcatcttaccagttctcggcattctttgtggtgcgcgcttagtcaatgccgggaaacggcggtctgacagctaatagatatctctgccctcaattgtttagacattttttgtcttttgtgacattgaagaaaagacaaggaagggaatggaagcaactaaaaaatgtcaaaagatcaaaaaatcaatgggccgcaggaatgcaatctgtttaccggggtgtagctgctgtttctgctccgccacaagtccgaggcggttgtctggggcaggcaccgaagttgcgtcgcctccctccctgggagctgtgatacggcacacaaagcgggcacattagcttgctcgcccccaccccccgcccccataaataaataataaaataaatataagcttttctcttaagactgcaaaaaccaagttttttttggtgctgtgtttttcggtccatttccaaccatttccaggactcgctgggctcagcccagcagacggggtcgagaatttactggtggtgttttaattttctggccaggggagaacccttgatgttttttattatttatttgtttgattttggagagaaaaagtcaattaaaagcaaatgggtgataattaggtgaagcacattgggcagatgaataatggttttgtctctggcttggactatttggacgaggcttatatgtctgtcttgaggtgatcagtgggaagaggggaaattttactggaaacttgtttcttaaagaagagaaaggggtatgtggatagtaagacttatttagttttgtagggagggacagagtgttggtttttctccataaaaacatttgggttttgaatgacagactttgttgccttttctttttcattttttaaagttttcaaccaactggtcatctggggggtgtgtgtgtgtgtgtgtgtgtgtgtgtgtgtktttgttcacctacacatttgcctggagtatagtgagaacccaggaaaatggataggccctaccaggagaggctgcaatctgttggggaagtttttttgttttttttgttttttttattttattttattcccaagccttggttgctatttgatagtaagtgtggtccaggctgcatattttataaactttctattaaagttgtggcatgttatcataaaactcaattgcgatactttgtattacgctctgggattgagagatagacataggattaaaaaaacaatttctaggcatttctagatgataaatttaattttctttgctatttggaggtcttctttgaaaatgcaattgtaatgaacgcattcagaactggagaatagatttacccttggcttcaaatagtcgacgttatcaggcgctgtcattcgttccttcctattttcggsctgctaattgatgtttttgatgtcagcaagaaaattgaagaaaatgtcatgtgtgaaccagtgcggaagttaataagattgacttcgttgacagaatttacaatgagagcagagaccgcataatgggaccgctgcgaattcgtgtgctctctttggagtcaaaattgacacctcacgctaggccagtggtcgataggagagatggaacatttgggaaagttcctaatctcatttttccccccttaccttttggtctccgatggtgatttagtttcaccggcagctgtttatccagggggctattgctgcggaccacgccaggcccttagttcagactcctggtgccaccaacaatgcttattttttatgctgttttgagtttgaaagcaaaagagtcttaaaaaggttagattaagatgtgtcttaaggaaagatatactaatatcggtcagggtcattgcagatgcttaggttatgtgcaataaagccgaaacacaaatccctccctgaataaagaaaccatgttggcactaagatcagtccttgaacataacagaaggttataacttgcaagcaaaaaataataaagttcttggccacatgtctccacccccaaaagaaacattttagccatggtgtcccttaaggtgtttttttttttwaaaaaacttatcgaaggtttcaatataatagactaattttccagttatgtggcaaagtttattggatttgtgtgtataattatggattggattagttgagtttggttcagtgcatctgattatcttctggcctttagggaaatgcgctaaaaccctaatatgtccactacccccaagcggtctctttttgaaggcgccgcacaaaatgtggtctctaccagcgcttggcctccaaggatcttcagtgagagacattattcttggaatatccaattaattccacgggcagtgatcagttagcgcttcttcttcctttctcgccatttgaaatgctaacacaatgaatattttctcattggtctgtgtccctcggctaagctgttgccgcgggctgagaatttcatcgactgatgagaccagaggctccgccaataaaaggttacagtacgtgatttgcatgccaagtggggtttggtttcatgaacttaaaagttctttaacttttatttgactctttttcttttgttcaaagtagattgaggggtagtatatttgtgagtgtttaaagtatgaaaattaccagggacaggaggtcacaactgtattttggaccatcctcacacagacggagaagatggcctttgtgttagtggcttttatggagagcaaccacatcaactttctaagatcaggtcaatgggaagcagtttttcagatgttgcgatttagtgttgggtccttcagtagcttgacattttggggattggtactggtagagtatcttgtagtactaataatcaaatacagcatcatttgaaatgacaagggagccattgagtaggacattaggaggaggaaggactattctttggagtggttggtaatcagagtcttgggtacygagaaaatcataccttctagaggagtgttcagaggcagaatgtcttctgttttcaaggggacgtaggagggtgttatgaaatactgagttgcaccgagcacaagaaaatttacaacaaactaacagcaccagtgtcacaggaggataccgatagcggagtagattgtggtggattagattatggcctacaaaccctgagtttcagaacwgtttctcaaccagacaaagcctcaggaagtatgaggccaagagcagttacacatgcattaaattggctaaatgcttggctcagaaaaataatgtctgatggtgtcacctgcatctctttcatcttccagactcttccaaacttggattttattaaatcaggatgcttcttgttgatttaaaggcatgatagatgtcttctaatctaaggagtattgtagacaaaagcaaagagggagtatggtcaaatgaaggtacttctatcccttcgcaaaatggggggaaaagggattgaggcaaaaggaagagtcagccttcaaaccactgtaatcttagaggaagggtaatatgattggagacttgacatgtttcaactgaatgaaaaatcatgatacctttaccaaaattgttagcaaaagggaactggcagggataggaatggagagagccttgcccctcttctcgctctcccgccctcttccttccttcctctcctagctgtctgtgaggagcaaagcaggtggctccctgtggctgacttttcatgacaacatgccattagaaattgccgtcctgttgatcaatcctctcgacatgacagatttgccgcaaggcctggctctttgagcgccagcactgtggcttttccctccttttttcctgcactaattggtgaaagtttttttactgtgctagtggcagaggaaattcttttgaacgttgtcacaatcaagtgttgacttctttagaattgcaagtaggttaagtgagtatcaacattggggggtgaatgggaggagggaaaacactaacacaaagttactactacctaaattttatgattagagtagtgttggaaagcaaactaattggatttaccccccttctctcaatatatatattgtggggggaaatgcacacgtacgcacttgcacacgcacacatacacacaacacacacacacgtgcacgcacacatacacacaacacacacacacacacacacaaatgaaggcaagtatttattaaaatcacagccctttaaaacttccattatgttttgtcatgggggtgctgaggcagccctgacatttgcaatggggaaaacacgttgccatattgattgaagaaaatacgtccattagtttcttcctgtaatacacggattcggaacaacagtaacacaatyattacataacacactgtaaatcaaaggaatatatgaagcttctattagtcgagcacattttactctgaacttagtgacattcttctgtccaaaatcagcatacaaagaatcaaacctcttggcaaaggatatgtccttagacattgattcttctcctgaagtatcaagatacacttctgcttaaattctgacattctagtttatacataagattattttttaacctagaacataacaacctttcttaaatgatttaaatccaaacttctctatgaaactgagagttaatagggtttatctttctatttagacagaatttgaattggaaacctatttttaatattctatgattcaaaatgtttactgaaggaatttgtaaaattaatctttgcttaaacatatattccttgatgattaaaaaacttgttagattaaaagcattgtttagccagattgagacagaatatgtgtatttacatttttcatgtcacagaatctgtgtagtacattctcattcttatctatataccatttcagataattccaagttggtaagaaagtaacagagagtatgaaaccctgcaacttaaccgtgggtttgtgactatcaggaagaaattgtatgcaggaataaagattttgtactggcccatcatctaaaaatagcaaccacatgtaaaaaagaggctacttctatttagcagtaggtatttactaggaaaggagaattatagcaataaaagttactaagattattagcggaatttctagtaaattgctttagttttaggtacaaaatggaaagaagatgggaaagtgtggtccggaattacctgggcccggtatccctccttggccatcacaattgctgcaaccgttatagggaagagaagtgtagaaaccagaaacccctattgaaagaagcatcaattcrtataattaattttgccattataaaaatcatttgtaaaatttgcattattaacattatcaagtcactagttggtaagacatcagacatgacgagagtgaagggcagcttagggagaactgggctttaaaccctcagtagatcggagttaggatcaaaggcgcttgctttatgtggctgtgctagactttgaagtcatgactgcacctacagcactcatttcatcaagttcactggtgtcttaatagcagatcaataagtttcaaagtcggagagttaatttgatactagtgctgatgcggtcgtgctggggaagccgagagagaggcagagaaagctgcctattaacaactccggttcagagcgcacaaagatgcagattaaggatatatccatggccctgaaaagacaggctctggccaggaatggggaagctctggattgataaagcaaaggctctttactttagacatctcaggttatttggaagtcagtctatgcttgaaaaatctttagtcggatacacataagtatgtgtgtttacacatgtctgagttttggtctagataaacaggtgatgggggaaacgtctgcacatgcctttctaaaataaaggaacatatctgcataaggactattgtaggttatgggatgatgtgggggaaaaggtaggaaaactgtgatttttgaagggagcattgaatgtgtgctttcatcatagggattacgttgattttttttaaagtggcattgggaatatatccttaagtgaatcatatctaggcaataataatttgacacaagtccattttgatccattttttaaaaaaggagtgctagaggagaagtcttagccccaaattcctttccttctttgtagcgtaccttgacgtgcgtgtgaacaaatgggattctttattgctttcttgtattcttatctcatcctcttaaccgattttgtctcaagtcttcccacttagaaagtgatatatttttaggacctattccaaaaacttgttggatataaagagcactgaaagagagaagaagaaaagttggggcaagataggatgtttgtatgtatgtttgagatttttctttgttttcagcgattttactggggtccttctgacgggataggcataaacattatggggtgtgtggcagagatgacatcagtggctatggcaggaggggatttggaaaggctctttttttgggcaaaaggggagggtgtaaagatacagagttcaaagatgcaaatcacgagaaagtagaaaccttaaaaaaawtttttttatgagaactttgccatctgtatatacagcacaggcttcccagcatcgaaggtcagattcacacccttttcgaacaaaactctaatttagaatgttcatctaagggttgataatggtattagaaggccagtagggtggtcagtgggtgttgtagattagctcagtggccattacagctttacctagacccccacgattcattgggtagattaaccatcacatctgtcattttatcccttttaccacatttaaaatacgaaaaggggggtggaaatatcatctcgaagacaacttatatggagcaagccaatgaagcctgctattcctaaaacatctaagaaatcgccgtatatatctatgtatgcatatatgtataatatagttataagtgatataactctgcaggacatagatatagatgttgagatgatttgggtgaattcaaatatgttggttatgccaggtaagctgcaaatttttaagcttaattccttttaattagtcttctgcctatgttgtagagaaagttctgtgttttaatgatctcgtaaaacgttttctgctactgggctgattgcgcagttcgttaagcttctgttagtttaatttctgataaaacttccatttcaactttgcggcaccctaaatgagaccatcttggctccgaaggagtctagcgggcactctttcygaatggcgatttgggatctgctgcatgtatcagaggctttcgttgagttgtgttgtttcctgtgtgtttatgacagaaagatgtcatcgttaaaggaaacttaagagtttctgtaaatgtaatggttcatcctgaataaagtgagagagacagtgcttggaatctggggaataagggtggaaagagctgagctgatgaaggtgtttcttgtcaaatttgtataggaattatttactgtgctgtctttcctgagccgctacagtaaaagtgaagacatggaaaattatcccagatgggacgaatcgctcrttctctgttctttttttaaaaagaaaagatttcagaaaaaaaaaaaagtcgtctttttctttagaacagtatgaataaaatctggacagctgtcgaaaaagatatgccgtctgcatttttttttaatttctagccaccaccataactaaatagcttgaatagtacctcttttcttttttttccccttcatacataatgatctctacttcattaaaagcgtattaatctggttcccagtctcttgggagacaccttaagatgatgatattgtgggttttttccccccgaattgtttaaaaaaaaattctagcagatttggtccctgtcagtcagaaataattgtgttcttaatcttgtccctgatggatgactcggagttcagcaacgggccggctccaatgacaaatacaatattaatattcattaactgctttgacaatgctaattttgatgcagtagtaaagggccttccaaagttaccggccaaagcatcagagctgcgcaaggtggcaagataatttgtgctggtttgctgagctgaaggcttttaaagtctatagcaaaaagctaggtaccacaaacaaaaaagagaaagggaaaaaagttctgaagcattggaaggcagggctgcggaaataatacgatcacagtccgctaaaaaatttgacacctctgatgcagtttctttgagtgaaatttctacaaagttgcaacaaaaaagcatagcatggtaagtcagcacattcttgattttgtttaatctttttgatcttttcaattatcgctatttgaagatcaatagtcattttttcctactatgcttagaagacgcgcagcggtggtttaatatgtgttaggaccatttgctttaaaggaacacatccacaagtttcggtaggttttkttttttttttaagttagtcatgaaaaatgttatacagtaaattgttctgaattcttttacatatgggtgtttttaatgatctatattggtttttgtatcccyccacctccaaaaaaaagaattcagcaagataattaagctctggatgttgccaagaattttgagagtactttcagttggcagaaaactttggagtgaagtggtccctccaagtttatctaaattcagcgagtttcctcccctgccttctctgaatggcatcagatagctattaaagcgtaatttcactggagaactgcaaagcattactttcaccaacttaggtgaagttctttggactattgaaattgcctttatgtttgctaagtcggcaaacaaaatatcaggctttgttcttttgattgaatgccggggtttgggggaaaaaaagaagagtaagaaagccctgccttttttttttaaacgccccctcccttttgtgggggggtgggttgttgtggaatcgggggagatcccagttattgtgctcttccctatcaagcgagataattctgtgaatggaactgtgcgtgagcatcttgtctggcggcgctgctggtgtgtgctgctcccctgtgccgcgggtgcgcggcggcggcgcgggctgcagggcgggtgctgccctccagtggagcccgcggccggcgcgggccctgggcagcatctgggcgcaggcagcatgcccgcgagccggcagcgggaaggacagcgccgcaaccctctctagatggtaagcgcggccggcggcgggcgggcgggcaggggtgcgcggtggccggcccgctgcatcccgcgcgcctgccctgctgcgtccacggctgtccagtccgcatgcatgctctcagcctttgccatgttcgctgtcactttgcggtaactttcaggttgatgtaccttgactggtaagctgccggggtggatgcagtagatttattttttttagcctctctttaaaacaaaacaaaacaaaacaaaaaaaacgaaaaagagaaattgactatacctccccccaccccgaatttcagcttgtgactataaaaacatgcttttttattattattaacttggacgtgaatacggaggggtttcgggttttttttttttttctgtccaccaagttaaagacaccaatgctccaccctcctcgctcccctcctccccatccccaaatattttcgtaaagaatcagcattttgctacttttcgtccatccattcctccaagacccatttccccttcctcccttcttgaacctctttatttaaaacaaaacaaaastttgctgatgctgcagatgcggaccgtggratgtaaatgagcagttcctcccacctccttacttcattcctcctgcacatgattgtaatttcatgctgaaaggaaaggaagctttcgtttttgttttgttgttgttgttttgttttgttttggggaagtgtttttttgttgttgctgtctttttttttaaaccctacagaactttgcagcacttgatcaccttttgatttttttgtgggaatgttctaagcgtggtgtacttctgacaaactgggggcaccctggggatgaatttagagtagtgcgatgggatggcaaatatccggaaagagtttctgaggagcagtttttagtttgaagaaattcaagaaatttccctttactttttaaggaagagggggtctgtctagcatgagttagcttatgttgctgcgtcctttttttttttttttttttttccatttttcggtcttttgagaaagctagaaaatarattcttagtcaaagttgcccatcctgtttgccgcactttataagttattgttgctgaatgattgggagctgtccatcagcggcagagaacttgcagtttacttaagaaattgcgtgtgtgacaaaagcagctgccaggagtgtggtggtccgcgtgaatagagggagagaaggcaattagggggctgtgtggttggggctttttacttgtcaaagtggaggctcattgcttttgttaccaccatgtaaagggaatggcagggttttgttttggtattaagggccttaaagattgctgcctgacacttacacaggaaggccagataagtccagaaagagaggccacggagcagtattttaaaaaagaagaaaagaagaaatgaagaattcccacttttttgttatttttaagcctgcccagcccttgtttttgttgatttttttggtggggagcggcgagggtgattaacttgtcccgtgtcttaacagattgtttaaagacctacatcgtgaaaacagtcttgtgggcttggagataaacagatgggcaatcagttcagtaaattaaaaacatctctaccttaggtgtcctgccgccagaagaaaccaaatctttgccactggtcttgcttcaagccacacaagtccaggatcccatgtggcagcaggggtgttttcttacctgcatgcaaatcggagttgtgtgtttgcttttgaagagggtgaaatggcttaacacttggggtggsaaaagaccggaaaagcgttctggatgagttttgtcccctgcaactttttctgtctgtaatccctccatgagcagccaccctcccacactcccctccttcatgtaaaagaggacgatttctggcctgtgatgtctgagtgtctcaactcaagttaagttaaaaccacacaaatgtacccrgccctggatcccataagagccccaggaaaagtaagtcgggtttgtggaattcagctctagcctttgcatccctctgccgtttcccttccttctctctctctctctttctttctctctctstgttcctggggaaagctcacaaaactcaacagtcaaaaaagcgagttagcattctgactattggaatactagcgagcccaggaagcttcgtttcttctgcttccagggaggtcagttgaaaatctttcaggcacattctgttactctggaaggaagagagggtgtatacagggcaggcaaggccctgcaaagtgtcacttccgtgtcactgtgacaagaaaatatcctttcctcctccctcccctctcccatcgcagccctctccctaagaaatttgttttgagggatttgacaatcttgcagataaagtgcctgcctcctgcactcggttgatcattttccctcatggctgaccgtaatttctttgctactcttagcggcagctctgtccctgctgcccaaggtaacgggtgagggaggggactttgctgaggtgccctgagctggctggggaacatggaccttcccccttccttcacggattctgtagtggcaaagattagaaagtagaaggagtttttaaaatttttttwaaaaaattaaatctgcaaccagctgaactctagattattagtggacttttttgttttttatttttaagatttttttagggatgtgtgtacagggggaaggattaacaagataattctaggcaatatgagcgacaactttgagcattttgagcctactcggccaggaatctggagccatttcgatctttttagatgctttttttcagttctttaagtgaaaggtttaaagggaggggaagctgggaggaaaaagaaaagtgagaaaagcagaaagggaggaggaagaaaaactggcccagtcccatctcgaaggtacagagaaagtttttttagaggtggagagagggaaaaccaaggctgttatgtaccctagggacacaattttagtgggaatggaagatttgagtggtaagggaggcgcagtggcctccggggtctctctgttccagcagttgggcggttggcacctcaatttgaattgctgggtgagtagtggggtgtgtggtgtgtgtatggggggatgtgtgtatgttcgtgtccatgcttatggtattgaccattaaacctatgctttttccccccccttaatttagatcatgggaaggaaaaaacaaaacaagaataaatggtcaactcaakmtatgccctttctttgagtccttttcacagcagttttttggggagggggagaaagggttaaaaaaagatggggaggagagaagtctcactttcatcacagtccttacacttctatggtaaggcagaccctgttcccaaagtacgggtgagctggaatctgggaaggggtggtacggtttggaatttcttctaacaaataattgttttcttcacccaccagggtgggctccatcagaaaagagagaaggaaaaatgacattgcctcatagaggagcatactttaaaagcttgaaagttttgagtgataaggctttaacagtagcagggctgtgtaaactgtgtattttggtttcatatttaatgctaactttctgttgctccgtctttagttgtcaatctccagatttagatgctggctttttagggctatggtcttgcttgtggtgtgttttgtaaacttaatataaaatgtgttttggaaacccgagcaagagcctgatgacagctcattgtgctgttaatgattagggagaaggcccttttgcaatatgaatttgggatttaggatccattatactctcttcaactgtgtggtgatatctttttaaaaaattattattattattattattattatttttgagacggagtttcgctcttattacccaggctggagtgcagtggcgagatctcggctcactgcaacctccacctcccgggttcaagcaattcccctgcctcagcttcctgagtagctggtattacaggcacccgccaccatgcccagataatttttgtatttttagtagagacggggtttcatcacgttggccaggctagtcttgaactcctgacctcaggtgatccgcccgtctcggtctcccaaagtgctgggattacaggcgtgagccaccgtgcccggccggagtgattatcttttgccacaagctgtaagaggattctcttgaatttggaggcaattccttaattacttttattatttgtgatgttattgtatgaccaaacagaaataatctgcagtggtcgataagctcttccatccaattttggggtgagaaggaatgaaatataccatagacttatgttcatattttcaacatcatgaattaaattctgtgtgtcaaattaaaacacaagatcatagatagttctctcgttgagcgtaaaataatgatgggtgtaaatcttggttttcctttctagctgtgtgcaactctttggttcaatctaggattgtgtaaactgtcaggaatggtggtgaagagagtggaggctgtgttgcaaatgtgtatgttgtgttactgcaaatatcacacccagtacagtctcccatgttgaggttctagaccctagtttactcaaattacctgcgttacttaatagtggtcctgttggctttgatgagagtaaaccactattcttgatgtcttaggagaagggagttcctttgaaaacgtaaattcccgactccagtgatacaggtattatgatctctgtattgtcacaacagsctgctgcatcggcattttctggaagcagcagagcctgaaaccttgtattcttagggaaacctcccctttgtggtttggggttgttggggacctggctgagctgtgtaatagaattctttccttctgcaatattttggaatgtgatgaaatcctgacatgccctccagattacgtagttctgcacacatttgaggatttttgaaaaaattcaactttgcctgggtcactccctcgttaccttaaacttgcaacacatcagytggagatcagagggagcarcaattgtgtttgccctccttgtcccatggtgactctgtgtcattttcacgcgtgttatttattctggctgtagatgcccattaaaggatgcccatgtttgggatactaacaaggsaggatagaacggaacaatgcagttctgcctttgtgttcgtcttcctttctgtcggtctttgctgaatcacagggtttgagcatttgtgtttgttgagccacatgagtggaaacatttattcttcctcttggcttacctcctctttttctagggagaagatttacctgatcagtgaaggaaacagctgtttcttgagcttttctcagactccatggagtaggcatgattttcaaatgcaggctgagattcgaaagttaggcacagggtatacaagaaaaacaaaagacctttttatgcagctgttccttgtaaataaattagaaagttggtgtcagattttgttcactacttctttctttaattccccaggatgtaataaccattatgctcttaaaatttactctaaatcaaaattggtgatttcctttccattatatttaggaatccctagatttggggttgttgtatttggtggcgagggggtggtctggaaatcattattatttgttaaaagttgttttgaatttgagcttttggatttcttcatttgggataggttcgatttatttctggctcgattttgaagatctgctctcctagaaacagctgtactctcttacccaattcccaaacattctctgygaactcgggcacttaacaagattgattatgttaacgctaatcatttaatacccaagtagtagagaaatatttggcaggagggtggaggttgcaaattcctgggaaattacttaggggtgaagtggctggttcttcatccctgagacctggcagaggattaggacagagggccccgttgtgcctgtcgcactccctcactgacctccaggttgagaattttgtgacgctgccggagggaggcagaggcaggcaggaagaaaaccctggaaactcgctgatcaggggcgagcctggaccgggtgggctaagatgtaagcttgcaagtgttttaaaggttggctgggggaggcacaatgggatgttttctttttaattgcaaaataaatgagaatgaggggaaataaattatgtttaatgaacttaactggaagtaattgttcaagagcctgtgaatgcacagctttactgggtcggcccttggctgcggttttcacaaagccaagcagctggtgcacatctttattttccaggttcgaatgttcctttattcctccatctcaacaccttctttattttccaggtacgaatgttcctctattcctccatcttaacaccttctttattttccaggttcgaatgttcctctattcctccatcccaacacctccagcccacccaccacctctcaccccccagcccttccatcctccttttgaggatagagaaaaggtctttaagaagagctgagcttggtcctctagacccttcatgtttggcagtctgtttggtgtgttaccagctgggtggttatagtatagaaagggccaccccaagaaaggccaaggacttgaagtgatcgagttagttctaggtatttgcatgtgtgtgagagaatttggatgaaaactgactgcacgtttctcctctccctgcttgctctgttcagtcatttcccagcaagaagaattttaatgcctgtgtgaatccatgagaaactatgagtcggcaaaatttcacagayggcagggagaatcatctctcttcctcttcttgctgtctaaatggatttgattccagagagggagagggagagaaataaaagccagctattgataatttacaatacaaataagcagcacccttcctaggaggctctcagggattggagacgctctaactctgcagcctgcgggggtaggttctgcagcagcccggccagaggatgcaggctgtgtactgcggctggcagggtgggctttgcttttctgcatctcacaggcagatctcttttctcttaccaccttgtttctccaagtaaaactcgaaccctgtgaaaccttctgtcttttatttattatttccaacaggcagtgctgtagctatcgatagaagtcttgtccagggaaacaatccaccattagctgggagcaaggccttagacagaaaggagcaacattcaactaaggaagaccccggccacggtgatgcatgggtcctggctagctgcgaggggagaggggcacgggccagggtaaaatgctctgaggaagcccacccatttggggccacgggaggaagtcatgactgctgtttttattctgtgtatatataagaggtttgcaggatgcaaaagcaagtgttggcctgctgggttgggatgggactgtccatgcaggcctaggcctaggttgcactggctgtgtctcctgtggccatcccaccagcagaaatagttgctaactgctggggtcataggctgttggggacaggggggttaccttaactgactgttcaccaccctcacaggctggaaaaacaggactagttgagttgccaaagggtagttgatggataagaaacagcccttccttcattgtgttcccagcctgtcctcttccccaacttaccacatcttcagtgatgtgaaacttttattaacgttttagcggttgccattggtcttgctgcagccatagtaaacggcatctggaaaaatgcatagaggtggactataaaccaatttttaaatgtaaacctggagtgaatggtgtcccttcctgatgctgatttcagcccctgggagggctggtaagtgaagacccccaaagaccttccatgcccaccctgaggaggggaaaaggctgacaaatgctcctctgttgctttagttttattgtgcagagctcctaaaggcactttctggccccattttgcttctgcagaaagaggcagcaataggggcgtattgaagaggagggccaagggagacaccagggccagcaatggctctatttgttttcagtgtctgttgattaataggttgcggaggtgaatggcaagctttcattccctctaggttgcccacagttatagagccttgtggggtcggggtgagagggggactaagcagagggatcttagaagtgccttaatcagtctttcacttgccaagttccaaatgaggaacagcgtctggatgggtgtgtgggcgcttggcgatgagggtggcatggccaagttgcagagcgctatgcttaagggttcttgaaaggtcaaaggtcagccacaggggcgcctccccctccccattcccccccactgtagtcgatgaatacsatgaatactttgggtggaagggctttgtgtgccttgagggctgttaaaggaccttttctttatgatttaactattcaatgctcaaaacccatggagcctaaggaaccagacagaggaaagcttggctttgccaaagagcgttttctccaggtagaaagcataaagccctgaatgatttaaagtcagatgaggattttggttccttttaaayagatattgtttacttcatttaatggttcggctttttagtagactttttctttagtttcttgwcagcccagaactgackacataaagtgtttttatcatctgaatcctgctgggccgagatactgcatgtttgtatttgagaagcagaaacatcctattaaatgtctttaccccttccatccccagtcttcccataatcagccaaatgtgtaaaaatccctgctaaaaatattcaatgccctgtggcattgtggctaaggcagggaacactgagctccacctaatttggggtttaggggcaatatttgctgaaaatggtctaggatgcagtgattggtaggtgggagtttgaggacagatcccmccgagagtcctgaagcagctgtatccaataggaaggttggcccaggctgatctcattgggtgcatctycctagatgaacacagcaattaaccccatcccagtaatgccagtttctgcagactgggagagtgtagaagtggggtggtggaggcaggcaggtgagkctgcaaagcttagaaacaccactctctcaaggcatgtaacctggaaaaaaaatatctttacctaccgcgtggaactgataacaaatgccgactacttcataggctcgttgtgaggatttcctagaataaagcatgtsatgcactcagcacagaggcacacagmcwcagagcccaaggcaccattaaacggcggccaccctgasctgtgctggtgtggatggtagtgcttcaggggtagcagctggtcagtccccatcctaccttcatttcgtctagaaaaggtgttctaagctgatggtggtggtgtgacttcggcagctgtggtataaccgtctcgaaattatgtgagttattcatatatgagtgtttgctgtttttgtggctcggagaatccgttgtcatcatgttttcagagttcagtacagcaacgcaggctcttcacacagctctccttgaccatcactaccatgaacttgaacattggttcgctgtcactggctgtaatgattttgtatccccatgtagttttgaagatgtatttaggtgaaatagttcccgaaaggaacctggccttacgttgagctgtttcccttgcacattgggctctgtttataaagagataaaagggggagggaataagtactgcaggctaatgagcccaccagcactccaactaccccatggatagttgctgctaatttagttgccatgaatacatttctggaaggttgtctatgttgcaaccaagttacttttcatatctaaattttcttagggtggwgcagttttgaacacaattcttaaagacctcgttagagaagtgggaggtgttcaaagagaaggagaaccatccaaggggcatctttctgtttggattcttttgtgtttcatttatgacagctcttacttaaaggcccttgccctgatctggaagggaccatgatcatctccacctgcctttttttttttctttaactttcagctcctctgtggcaatctcatttattggcatagtaaagtgatgacttttctcacaagagatattaaaatatatggattaattaaataccgcattttgaagaagggtatgtgcctgaggagagtgccactaatcatctagaatgatcttgccccataaacaaacatccttacctttgaaatcaggagtggaatcatggctgtgtatcccccctgctccgtgaattaaatcagaagaggctagagggatagtgaactgtgtcatcattagtatttatcagattgcattttcaaagcatctttgtattgcacgtttagcttgtgcctgtcactgtgctaaatactttacgtgcaagttctcattcagttttcacaactctgcgaggtagacacgattctcatccagagttgacagagacagaaaggaagtcttgagggaggtcgaacagccaacctggtgaggaagaatgaaaactcgggtcttccttgaattcagttcttgaatcactgtgtgcaatgccagttgcccctaaaacccttttaaaggcacagttgtaattgagatagtgtctgcaagggtattgaactggatggtccagaaggaccactaagctctgttctgtgattctaaggagactacatttaaagagcgccaacatttacttgaagttaatctgtgattggctttgtctttccctttgaatgcttgcagttgcaatttggtggttcttctgcagtttaggagaatgtgctctccattccrcagactgggcacttgggaggacataaagttctagaagacatagtccttgtccctaagggacttaggtatagtgggaccaagaaggrtgcacacacacccccagcaatgggcatcgtgtgatgtaggaagaaagggttctggggtctgaggccggagagacataggcatttgtamgaagaaaatccctccatcatagmkgattccaggtagaggcaggttggctggagtggcaattagtccctggttttggcaggtatgaccacagagttctcctctcttgcaagggaacccatgagcttggacagagaggaagttctgttctttcacagggacctgcctggcatgcagttgaggtcagagggagtaaggctagtcctagtacaggtcccattttttccccctaaagccaggcagtacctaaaacttccagttccctgccaccccctccaccccacccccacccccatggtatagttttgactgaacaggaaaaaactagttggctaggctcaggtgtgcaaaataatacygggagaggtgttagtagccagaacacagggctccaccttttgttggaatcgccttcatatgtatatctaagaagatggagacttaatttttaaatctcacactcagttaactccattattgcccaaacgctatcttcctcttttgttgtaaagtagagaaagagggttttccccacatctccccttagtcctgcttagaagatggctgtgggatttgtgcttctttactgtagacagatcatgtcatctggacagcttcttcctaacaataaaaataatattaataataaaccactgtaatagataataaataacaaacttatcatgtgctaggttctgtgctaagccttttcctgggttccttaagaactaggatttgattcatgatcagaacccatggctctttgcctctgtgcttgcctgtgtgcrtgtggtcctcatggcggaacacaagaaccacccacaacacccagcaagcaggcccaggatgcttgggtcctgagcccagacccactgtgaatgaattagggcctactgagagatttcctaggattggggaatctgaatgagtgaaaagcatcccgggagatgcttgactaggggctgactgctgctggttctgatgcccaccactagccctttctcytcccatgtgatccttctcctggctgatggtggtcctgctcccgtggcacttgatcagtccttccaccccttagtaatcatcttcccttctctgggctatgggtggttctccccactggccctggtgtttttccacactcactttaaactgtctggagctggtctgctttctttcmtgtcagcgggtatgtatctttccaaccaaagagaaaacttctggaaggcagcaacagtcatttgccctgcctcctaacagtctccactttgtccgkgtctgwctctttccctcccttcctctccttttcccttttccttctccacctcagcacacagtgggagcttccttgttccttatttctcaagttgtcctgagcaawtcttcctcttaaggaatccttagtgcctgtccttgaggtgcccagcactggctgtgggcagcagcccttcaccctggccatggcctgccccgcccttcatggctgccccttttatggaagtgttgctggtttccaaagctccatctgctttggtggcttttagcttacttgctttgatgcaaaattggtagcacataacacaaagctcctgtaagcaacctgctagcccctttctccaagagtccagttatacataggaattggtaaaccaggctgttggaaacgttgacttctttttctgtagtttttttctggggyatctagagagaakgccttatttttctttccacacataaccacaaaaaagttaaaagcactttttaaaagacactttcccctcaattacctgtggtaagaaatgctgttcttatattacattccttcctcacccatttaaaaaaaaaaaaaaaaaaaggacaagaagagaaatagtaaagagaactaactgcttagtgatccctcagctcaacaggcactagtgggcagcactaggaccttccttcttttcttttaatgcaattccttttccttgatgttaatgcaagttgtgccttcctaaaagtaataaaaggaaatgaagacacgttctgaaatgaaacttgactctaatccattcatcatctaatacttgcctctttatcttcgctggtacctaatctggttaaatgtccctgttgtaggattttagcgaaaatcctctatggggaatagggttttttgcaattggattactctcagtaaatggcccagtagttcgcttgtttcagcttaattttttctttgtgatcttsctgggctaagttatagcacagagtagtggagtggggaggggtggactgagcgggaggtgggggaaagaggaggagaataatttgggaaagcctgggcatggcaactagaaacatttttaaaatgcttttcttccccccaccctgccctctgcttctctccactgacccacccttcccaaacacaaaaatgcctgtactttgttttttagaactgcccatttctaaaatgcataccttttattagcccaattcgtcatcatccagttaatgtattagcgttcccggatgactttctaatgaaattcctaatgaatcagggctgctgtaatctgcataaaatatgcaggtgcttgtcaggcagtttagagctttctggtaaagttcacactcccacccaaaccgtgagtggggttttgcatccatgctgtctgtgaaggattgtagcatgcccgctgtttctaagggcagggaggggataggagctgtcggggggtggctaaggaggctggctgggtgggatttgggccctgccrgtttcttgtaagtggtggttttcctagatggtcccctgtgcagcctgcgtgcctcctggmggtggggccttggggtaggaggtccccacaacatgyggaaacgcagtaggcatgggagattgaagtcyccacttctgactcacctgctaatgggaaaagtgcagactcttgggctccataatggggtaggggttgagaaggtattttaaaagccaggcttagtggggaaataaaaactaaagcagacccacccagagagctgtcttacaactatctattattttcacatggactggggggagtatgggatgggcagagttgagtgcatcttagaaaatccaggtgagaggctgtggccaagggaacccacgggcccggtgctctgaagccctgggctgctggaaccggcttgacggtgtctttctctgttctcctccccacagtctaacaaagtgccagtggtgcagcaccctcaccatgtccaccccctcacgcmtcttatcacgtacagcaatgaacacttcacgccgggaaacccacctccacacttaccagccgacgtagaccccaaaacaggtaggctgtgggctacggagccaaggtagagtgctggtcctggggttctgggggaacctttgaggcctccacaggaaccccaggggtggagyagtaggggactttgggggaacggtggtgggggkgcccctgttgcttttctgggtgttgaaaaggaagctctttggggtggttgaggcctggtgtggcagtggttttccactccctttggagaagttcatttgcagtgttaaagatctctttatggcttccagtacccctgaaggggctgtcttgggaacctggctatgagtcctcagtatgtttcaggagtggcttttaactctaagagcctcaggcagacatggatgcaggaatcatattgaaggcatttcttgggttcctcctcagcttcctgggaagatgagacagcatggctttccaagcctcggctccctcactggctaagaggctccagtcactacttgacaatgacttgttggtatagcctcaaaaagccacatcactggattctgcattttctttgctaatttatttaggttctttttcccctacaatattctaggtattgttgaacccattttacagatatgaatactgaagtccaggcaggttgcttcatttcttcgtagaacaaccaatgggtgtctgagaaaagttgccatgcttttcaacgtctttttgttgttgttgttgttgttgtttttaaacagagtcttgctctgtcatccaggctggagtgccgtggcacaattttggctccctgcaacctctgcctcccagttttaaacaattctcctgcctgagcctcccaagtagctgggactacaggcatgtgccaccatacccggctaatttttgtatttttaggagagacaggttttcaccatgctggccaggctggtctcgaactcctgaccacctcggcctcccaaagtgctgggattacaggcatgagccaccacacccagcccagcatcccctttttatcccagttgttcattgactgcttttttcccaaaggggagagggagggaaggtggggttacttgtagctctcctccaacaagatctaaatcaggcaggcagccccagcagcctggtggggtggtcttgggagaacaggtaaggttagtgtgtgtctttcaggctacccagtgtgttggtaggatttccccttcctagctcagtaattggaaggatgggtttaaagtggtgattgcacatcactttgttagaggggattggtagtgttggggtaggtaggctgcctggttaggcggccttcactgcccctgaacgaagccacacatgagctgggttttactggtctctgagcccctttgtgctggtgcaggactgagcctggcgcttggatgcctggtggcctcctccagccggccccaggctccaccagtgaatggcagcgtcaacgtctcatttaaataatggtagtacagggaatagcttttaaatggttatcgtaaaacatatgattaacgtctgtggactgtttacttttcctctgcgaacattctttcaagtgtgcaaatggctcgatgtagggtccaagcccagctaatctgtttggtttttgtaatagagagaaagcaatgtctgcatgaaaatgtcacccagggagacttaatttacagattaaaagcttcctgaatgaattttttaaaaaatgaagtcgttttcgtccacgaacatgcagcccgttccctccattactstgttttaattctgtggtattgtgccttttgcctcccacttcaatggcatacatcaattcctctctgtcagagtggactacaggatgtgctcctgtggaactggcagatgtgcggtggcacgtacttgcagaatccgctcatgtgtgccttgtgaagctcttagcccctgcgacgcacgcggtgcccattcagcaggtgggcttaatccccacagacgactctgtcctctagcggatgaagttccagaatggagtacacaagcctccaacacctccttgtctgttcagctctgwctctgccttagataagatgccagatggcatttgatcagtttctccagctcatccaaatagaggcagagacattttagaggagtcaccatttttgaaaaaaggcaagggtagtaacttttcaaatgccacagctcaaaaagtgtgttagaaatcagaggagtagctcttgtgcaggtaaggcatgaaactccgcagggtgaagggccagagttgtaagagcaacagggattaccattgcttcattctccaccaggtgctgagcctttttgatgttgtttcttttaaacttgaaacaatcacaccagtcacatgaggcacaaatacccaagatggcatatcttgagtctactcagtataccagtccatttagaaggagataaactaatttttcaaactgaggctgagggaaaatgagatgaaacctaccaacaactcaggatttataatcatgaatgaaccttgtgctaggattccagaagagatgcgtctcttcctcctttccctgttcccatcccctaatggattgctctttccttctctccctcctttgtacctaaaatgctgcttcttccctcaggaatcccacggcctccgcaccctccagatatatccccgtattacccactatcgcctggcaccgtaggacaaatcccccatccgctaggatggttagtaccacagtaaggagttccattttttaatttcctttttgtttcttacatgggcaygtttattatttattctgtgtgtgtgtctgtgtgtgtgtgtgtgtgtgtgtgtgtgtgtgtatgtgtgtgtgttaraagccagggttggggagggggctgcgggagggcacagaaaaggtgttgctgaggtgtcctgtgggaatacaggcaaatccacagccattcaggtggcttatgttactggcacttagcattccgcgaccatggtccccagaggctctgtggacagaggtgccctgcagttcctttgggaattgcagaagactactggaacttccacccaatgaagctggtcatgacccttctgctgttggctgcccaaactgcagtcatgtcattgggttgaggctgtcgagtcctccatkttaggtgttacatattttggggcacagaagcaggaacaagaacggccttgttttgaaatccagggttgggattagggcatgttcttgtatgattccaggaccccccacctcatcctgaacattactcccaaggttgacaacaacagtggaaagttttgtctgttgagaagctccatgggactgaatcagcatctctctgagagtctttgcacgttgaatgttttacctaactgtgaacggtgggaatggggcatttggaaccgtcactgcagcatgtggggccttcgtaagcatcaatcctagctcctggcagtgcccagattatttgactawcttttgcaacttaaaaaaactgtgttttaaattcagagtagaaaggcctttgatgcattagcatactgtggcaggttgtgtgtatgtatatttttgcatgagcatgtgtgtaatatgtgtttcgtgattgtttctgtggatgtatttctccttaccagtgatctgtactctgaacaacacaggacaatacattgaatgctaaaaggaataaatcctggtaaaactcaggtttgagtcttagggaagatggcctttcaaagccttaaggaagataaaattttggagtggcttaccccmcaattctacccgtatttctctagttaratagattctatgctgtttttttttttttaataaaaaacagattgcattatgtagtagctgtaccaaataccaaccctgggtatagtttctgtttctctgtctcttcttatttttattgggacggtagacatgaacatgagcttgtgacccatttcttctaaatagatggggccaaccctcgaatagttctcagtgatcatttgccccattcggctgatggggagatatttgaaggctagataaaaaggaatagccaactcagacaaccctctgtcagaaaaagttgtgtgtctttcatgaggatgctattttgcatgttgctgtattttttaattattgtaatgaggtgtgattgtctattggttacccacaattcttcttggggactctccccccggtaactcttgtcaacacttgttaatttgacaaaaggctacaaattaagctctgttaatttaatgttttctcaccgagatctaaataccgaaagaggcccaaagcgcaactgaagtcctttgattcactgtactttattttggtataaatttacattcattattgttttcctttggatgtgtagccctcaattagtgtgatggctccattaaagcaagcgagacttcgcctttaattattacaacaaaacacctagtttcagcttggggagagggtctctattgacataagcagaggttataaaatttaattagccattcctatcagatttatggcattcaaattgttctgtgtttcttccctttgatccttcctgtacaatccccaagatttttgttctgatcaaatgagaataaagcttactgtgcagagagaacttttcccttttcttctttttcttgtccccacccccacccttgtttcaagtctcttactttgtaccccttctttgtaggcaaggtcaaccagtgtacccaatcacgacaggaggattcagacacccctaccccacagctctgaccgtcaatgcttccatgtccaggtgagttccaagaaccggggccttcatccaaggccatgtgtgacttctcaagaagttctctagatggccaccaagccacccagggaccacagctacatgtagttctattagtgtaaagccaatgtggcattaggctgtactcccagaaaatcctgaaaaattgccctgaaattccaaggtaaatgatgtctttctgggtaaaatttttgagtcactcagttgaacaatgtattttaatgaattaagaaggtaagggagaaacaggacagaagcttttaaaaatgccatttctctgttgtcctgtcctcagcaagaaaggtagcggtgaaggtagttttattattataccaagaagagttcgaaaaaagattactggtgttctcaaagctcagactctgattgcaagtcaacaagaaagcatccgcctcctcccctcgaaggtagcactgtccaatagaaatatagtgtgagccmcagagggaattttaaatttcgtagtarccgtgtttttaaaaaagtttttgkttttttttttttaaaaaaaagataaagttatttttaatgacatgtttttattcaatgcaatatagccaaaatattatcattttaacatgctattcctggacaacaactattaataagatgttatgttcttttttgtgctgagctttggtacaaaatctgatgtgtatcttatacgcacagcacttctcagtttagactggccacatttcaaatattcaatagccacacgtggctggtgcatatcatagtggtctgtgcagctctaagtctttgaaagttaaaaaaaaacatgtgtgtgtgtgctgtacattcatatatatttatatttcagcrtagaaacatatttacaagatacattcctatccccatgttcttcttttcctccctctgattaattctggctaatttttcagtgactgctagtttatttacaaactggttggcagcagtatgttttagtcgctaattgtttctaatgatagttttattttctgttcatctgattttcagtcaagttaattaaatcggtggaggtttagactttgctgatggtctgaaatcaccaacccattctgatgatggcacataatgaaattagcatgcgttacatggcaggggtgctgtccccagcttctttccccagtccctgtggccaacatgggaagccaagaccrgagaagggcctggaaagacaggtcaagatgctgcttttcctacttacaaaacagtaactttagcagtgatagagagttacattcattaagaaaaacaaaccgtggcatatctagcatcggtaactatgccgtggatatcatagttgaagagatccattttctacctgcgatatatcatcaaaatttcaaaatccatgccagtattagttaggtaggaaaacgctcgtgtgttctctggcctagagagaagaggaggcgtaacacttattaaatagtgtcatcacagcctcgcaaagcatgggaatgagtagggggtctcccaggtggagagcacccagggaccacggctacatgtcattctattagtgtagcagcttatactccacagctcatcttcccaccttcccagcatttgtatattacacctggttatttttcatgtttgtttatttggtgcgttctggaggttaacagtggtaaagtaattgtaggatagggattggggttaagctgatcgattgaattatcattaggaggttagtcgatgaattataggtgggcrtgggggtggaggaaaggcagggaacgtcaggaagaaaggttagggcctcaaggtgcggggagaggcggccgactccccaggtaggccaaatgaaagatagctagttaaaaagcatatacagcaaattaaatacattattgtgataatggggcgacagaagtataggtctattatacttatggcagttatagcaaatgtaggcagcttgccctgttccagaacaccctttgatattcattctattcagcagtggggccaggacttctcagaattaagtgatgggtcattatactttaaacaccatggagaagcctagattggcaattaaacagctcttgctgacactcacttgtgccaccctgtgaccccctttagattgagatgttggagctccgggccctcagcctgctaaattggtgcaaggctcttctcctgacragagccggctctgaaatctgccggcttcaaagggagcgagatcatgtataaaccataatgtgggtgcaccgtggctcacaaaaaataaggcaggaagagatgaaatgttacaagtgcaagggggaaaatgagagaataatgacaaacctaatgcaactcaaagcaggattgttgcacaggaaaatgcatcctactgcttgtgcataaaatcaakgccggcagatgacatccggttaacagaaacgtgtcaacagtgaagtaaagtgagagtgagtaagagagaagcccctgagacagccagaaacaaaaattagttgttcttaacaagttaaggttcatcattatattctggcttggagccatgaaagcagacggkggtatataatgagctgcttasaatttttagggtgtttattgcatttcatgaaatagtagtctgcagaaaggaatttcttaagcgaaggtatgtgtatacagcccacatccatgttcacacatggtctctttctttgctgaacatttttcagatatgggaatatacgcgtaggtatgggaacttagaaatgtgccttcttcatggctgcattagaagtttgtctgcaccccaaaatgtactcagattgtggtgccttcccgtggtatttggtgtatgtacacacacgtacacacacacactcacacatgcagtgtttttctctctccccctccctctccctctcacgtctgtacacatattctcattctgcaggaagggaacatatgtatttgaggaatgtcaggccttcaaaattcacagtaaaagctgccacccaccacttcacccaagggcttccaagaacacatgttcttaacttctgtttcctctgaggccttcgagcagtgggaaggaacagggtgtcacttggagcccaagtgtctcccaagggsttttgctttttttgtttttcacattattttgagaggaaggggatgaagatgaaggttgttagcatgtttgtttccttacattttccttctctctctctttttttgatacattcgaaggacttgtattgttgttatttttaaaatcatgtcatgcagtcttcactactggcttaaatttgtaaaggcagtggcaggaaaggccacgtcagcgtgggatttttgagtgaaatgtctactgtggcttgggccttcttcaagaatcagcattaactttccttcctctgttgatctgtgtagattcagttagtactttaatcattttattatttttcaaattaatgtttgttaccttattttggctgaatggaaactatctctagcccgcttctggaaaaaactttgtaaatacatacagaatcattttggaagaattgtcgtgatcgatcctcattaggccctctagttcccaccagaattggctttgtaaagagcagattgttattccttggatggtacattggactgctttggtttggacttattaagaaagcaacagttgccatgatcttcatctgaacagcttcccatctgctcacttgaatcaccttgccaggttggagcaggaggctgccatattgtttacttttgggattctgccctttctgtccctcactattttttctatagtaggatatgttgcttgaagaggggtgagtcttccaacccagtacaaatcatggtgacaccaygcaaaatwgaaaatgagaaaggtgtttgatccagttgtcagtctgcagatgggccaagagtaggttgagattagctctttctgtcctggctaatgtacttggttgggaaatgccaattcaggtcctaaaatgtgccttagagaactgtccaaaaaatgagcagcatgagaggagaaaacacaaactgtwtctttcatttataattttgataatcatttagaagacttcttaatgatgcctagacaacatatgaagtaaaagtgatataggaatcctaaattttagaggagaaagggcatacaaatcagaatcaaaggtttattgtgtgtgtgtgcacctttcctttcctttttttttttgcatctttccataaagggatagaaacttatttaaaatgtccatgacttatgatatgaaccaaataggaactatttgaattttccctgtcttcctgcctcactctctcccattcctgtcaaatgatgggacmcagcmcaaaagaaaaataaaaattgtattgcacttcatcaacaggatgaggcctaatgaggcttgcacagcattgtcaaaaatgtatgtatatttcaaccmcgttaatattttatttagctgtcaatatacaacaaaagatttcacctttcattttagagctgattaggacttaggaaattgtcttcttagatgccactaataatgcctcaaaaaacaagtggacgtgygatttctggcaggtagtccaagcccacttttccgcccaagtacgtcagttgaatttgtcttttgctaaagatgttaaaaatcataatgtcttatgtcagtagcaataatgaattggctttaatgacattatgagaatcattatgtttaatttatcgctaattaatgctgacaggtttcatatgccttgggttgctttcatgtgagtgttacgtgctgtttttttttttctttttaattgtgtgtacacatccctcctcattcattcattttgattctgacgatttacacagctttctgtcttctaggttccctccccatatggtcccaccacatcatacgctacacacgacgggcattccgcatccggccatagtcacaccaacagtcaaacaggaatcgtcccagagtgatgtcggctcactccatagttcgtaagtgttgctgtttttctcaccttcttcgtagccgcagtgttctgcaagcctgttgcagctgctgggtggtggctttctgcctaaggttggcctcgtttggtttgactgcagccaatacccagcctgtgtgggctcttcactcccttacaaagagagagagagtgcacagtggcagaatctcactgtaccaccgygggttagaacagaactgttttttgtgtgtgtacttggatacactgggatttgcaaccacttccctgccccctaaccgcatcattgaacatttagagctttgttctgcaagcaggagaaaaccctgccgaggtgaagacagcaaccatgtgctttcccctctggcttgggaaaattgtatatttgtgaaacttgaggaagtgattgcaaaatccctctcttcccccaacccctccccaagctatttttgttccattttccggggtgcagaagaactaaaagcatgctttttaatccaaaactgctaggcttgggggttatgagacaaggagatacgttccctgccatggaggaagttggaccacgaccttgtttattgggttgcgtctgttttgtctatctccagaaagcatcaggactccaaaaaggaagaagaaaagaakaagccccacataaagaaacctcttaatgcattcatgttgtatatgaaggaaatgagagcaaaggtcgtagctgagtgcacgttgaaagaaagcgcggccatcaaccagatccttgggcggagggtaggtgacgcccttctcagggagaagckgggggcgggtggtgagggaccagagtgcagcaggtcaggtggcagaatgtctctgtccccatttctttggagaattcttgcccttcagccacattctgaatccttgaatggccttcactgagtcaggactagttattctgcactcagcgttcagaacagccacagccatgctcttcccctacccgagcgagtgagcaaatgacagaatgacatagataacaaatcaagttttgtctaaacattcctgttagtgccaggacccagccgacggtcagtatgtacagattataccatttctggayggactcacccaaaaaggcagcattatttatcccctgaccttggcgtaatgtgtgatgttctttcatgcttttctctttgttcatgtctttctcatctgtaccccacgtcccctccagtggcatgcactgtccagagaagagcaagcgaaatactacgagctggcccggaaggagcgacagcttcatatgcaactgtaccccggctggtccgcgcgggataactatgtaggtggatcattttcgttaggattggagtctgtagagctgtgttgtgcgtctatayggacaaagagaacaggacctgccacttgactagggtgggcctcaggaccatccaatctgcccgctttggggactggtagcatcttcctggatcgctaaactgcagggaggggcttcccgtgtggatggttggatcagctcacagtcattcttcagggtggagagaggaggctgcagtcccagtgttccagctcaggaccaatgaggttgatttggtgcttgtctcctttctagaggaggcaaggctcttaggatacacccaaaggaccttatgttcyggattaggttccgcaggctcctcagcagtgatcagtggtgtggccttctagggaagaccagtgggtaggtgtggaggaacagaatttaattcctcccaggcctttcagcaggccctttaccrttaagaaggaaaaacaaaactattcctttgtgccatggtgcagtagaagttagaagcctatttcatcctgagaggagcatgatgggaatatccctgaaagcagccagaggaagtcagcctttggcaggatgcatgaaccgactctggccccagcaagggcagggaaagtgtgctatgcggtgtgtgtgttcctgggctctgtgttggctacaggatctgcctagtcctctcttgggttgtaggaaacaccatgggatgattgtttttactaattgcagtggttgtgaccccacgattcctctcctcccatgagcacgctgtcttccggagacttctgtcacttctcaccattgctggttatcctccattttgcccagtaactccgctttcctctctcgagggatgaaatgcctcttgttttgcctgatactttatttcatgacatttggttccgtgaagggatttcaccatccactcttaggggaacaccaaaacttgtcttaaggccggcacaggcctctcatccccttcctgtcgatgtcttggagccatggatggttacttttccagttacttttgactctcccactggcatcatccgcggtgaagcagcttgacgtataggggtcgaggtcgttaaattattactgaattgagtgaaacatatcatggcctttgaggcttctgtggcaggggctggggacacacagctcttaactgccttggcctggaagtgtcatgggtcacttactcccatcacccattggccagagctagtcatgtgacccaacctaactgcaggagatgctgggaaatgtgcakttactgtgcacaagttattacagggattcagagttaagtcggatatctttactccctcagaacttagcatccgccaggaawtcgcaaacatctgccggcctatgtgatcctgaggaagagctgcttctgcctgctctgatgagtaatttcaggcctccttcctctttcttctcatacttttaaacccgtgcttgccatgtagatgagggaacagggaggtgcccctggccatctttctcgaggccctgcccccttagctggcagcgctagactgtgctcctcctgggagttgaatcaggaaggagtgctggcacctctgggatggcgcgtgtgctctgctgagagcccttgtcgccgacagatgggcttgcacggggtctccactgcttgggacctttctgtttgtccccagcatgtgtgcagtggggaggcctttcttctggagctgaaaggaagaggatgagaaagtgaatgctctcccacaggcttgctgttcacccccacctgaccctgaggtggagatttccagtagcaggcaggctccatagcctccacgtacacaaccatatcatttcaggacagctgctctcctggtttcgggtcagaagttcttagagttcatcttgagcttctacctgctacagacccaattctttgagtaatctagaatgataccacagagcggaattcagcttctctatagagatcatatccccaatagacattttgggtcatagtagggccttcatgtacagctgtgcagggcgtgcactgcacaactctagagtatgtcatttacactggggtctatgtgaatggtgccccctggagttgtgcagggtgaaatctctacaaaggtacaaggcagactgtgatagcttcaaaagaataccgtgtttgacttgcctgggagtcgtttagagaaagtattgctcgaggctttttgtgacatactttctcggtttcagaagggctgttaggcactcgaaatgactttagctcagttttaaatttggaagatggtttggtataataagggaactcctgagacgatttgaggtttagagatctggatttagggctctaggaactttatctcttgtaagaggtacttagattcctattacaatggctcattacacatgggtgtgaacacacacactcacactcacgccttccttttatgygctagggaacactgggactaagaaccgcagcactgaagcttttatgsatttgaatgtggtagcaacttaactagtatttttttttttttttttaactaacttgacgtgggagtttccatatattactttggtcattgtaaactccaaaagcttcttctggaaaatatttcctgagatcttctcatggctctttcacattcctgcttttccagccaactggtaacggaagcctttatatctttaccttaggacaacagaattgagtgaaacagtcacgtttggattgtcagacttggtaccttctttagagcccaagagaaaacatcttgagtcccatagtaatatgtaacccctgggattatatttgacattatttcctttttaaccctctacactgggtaaaggatagaggtcccatgccatttgctcacctgagtttcttttcttctacccatatcgtaggccctttctttcttctgttacatttaaaggggtagtagcgtggccacttccctggagatgcatcttcctcttcactaagtgtaggktttatccactttctcatgtcttctttttattaaaacacaatccctgtcctccagaagtctctagtctaaatgacaacttcttcagtagtcaacatctccgtgctatatcctaaaggcacagcttctttgtgtgtagaggaattttcagatgccttcacagtatattgcaaggaattggaaacggggatgctttttcacacatggctgagaagcccttgggtatgtggatgctgatactccttgaagttaaaacatttctgtgcccagtttttatgaatacttcaggctcctaaatgaaccgaaactaggcccgcctgcctgttccaggatagccaggtggcactttgcccctcacgtgggagaggcgcgggcatggagatggtccattgcaggcccatgagatgccagcttcatgataaagcacatgaggtccttttaaaagaaattgtacatgaaggaacatagcgcgtttcaacaagatccccgaacagaaggccaaaacaaagctcccaagttgcacaggccccttcccctcacagaaaagataggccatttctacaacagatggccctcagccctgggtggagcctaagcttggtggcatcaccaccttgaggttttcctgacagaacctaacgtgttctcgagtttctttctttctttttttttttttttttgagactgagtcttgttctgtcaccagggtggagtgcagtagcacgatctcagctcactgcaacctctgcctcccaggttcaagtgatcctcctgtctcagcctcccsagtagctgggactacagatatgtgccaccacgcccagctaattttttgtatttttagtagagatggggtttcaccatgttggccaggatggtctcgatctcttgaccttgtgatctgcccgccttggcctcccaaagtgctgggattacaggcgtgagccaccgcacctggacctcaagtttctttctgcctatcattgtctttttctcttccgagttgacatcaacatactgtgagaagctttaggcaaaggcaacttttagctgttctgaaacatatagcagtgtaagaccatttcatttcaatgtatgccaggcagctacttcatctggtagggctatgaggggagggagaactagtccaatccggaatgaggcagtcgcctctcctgaattccccccagtcccattccacatttgcaacctcgagcagatggatcaggttggagaatatgaaagactccatgcagttcatcccctaaagccctcactaaaagagcttccttggagggctgggcattaaacttgtaggcagcagagccttgtggttgagggctttggagccaagaccacctgagttctctccttgccccaccacttgctagatgtgtgaccctggcaaagttacctaactcgtcagttttctcctctgtgaaactggaatggtggtaatacctgttgaagaggattgttgtgatgattaaaatgagtccatctgcgtagcacacctagaatcatgcctggcacctggcatatgctcaacacatgtgacccattcatgggaggagtggtatcatcctcattatgtcagctagaagagaattgagggaacatcttctttcttacagatgtccactcagcaggttttttttgtttgttttttgtttttttgtttttaaacagagttttgctcttgttgcccaggctggcatgcagtagcatgatctcggctcactgcaacctccgccttctgggttcaggcgattctcctgcctcggcctcccgagtagctggggctacaggcatgcaccaccatgcccggctaattttgcatttttagtagagacggggtttcgccacgttggccaggctggtcttgaactcctgacttcaggtgatcctcccacctccgcccctcagagtgccaggattataggcgtcagccactgctcccagcccactcagcagttgtgaaaggagcccagatgattcctcgttctatttcacccttttcccctgcatctttaacagcaaactctaagagaagcctctgctaaagctttcattctcttgattcagagtgggaccctttggccttcataagtaagaactgtgagcaggtcaggcagggcagcccttgaagctggtgcggccatgaccaccttcatgtgctcctcaaagatgggctctcagactgcttgcaacgccatcatcccactcctcyctgaatcttcctcgtgccgtcccccattcccttttatggatcaaatgctgtgggtcaggtttgacaatggacataggtacatgagaaatgagagcttcccttcaccacccgccaatcccttctctgctcccaagaagcgtgtgtccctccagctggggtacaatgcaagggcatttggcttgaagcggggttggaggttggacaaataccgggggtttgtgtggatggagatggcagtatggtcacttcctcctgccttctccttccaggtgcgcccagacactcttctcacatctgtttcttgcagtaattccctgtgtttcatctcttcatctagggaaagaagaagaagaggaaaagggacaagcagccgggagagaccaatggtaagtgacaatcatcaggttagaggaaggagctgtagcctgaggaccacccttttatgttaggtttccatctgggggaggcaggagaaattcaaggccaggacattgtgggggaacccttcttagctagcctttttgtttatgcattttaattaattgcttcatgactgcccttttaaagctagtaacatccattgttgcatgaaaagcacattgtaattctagtggaatgtgttttaaaataactgcagagcctataactggagagcaagcggtaggcatgcctatgccgggatttatacagtctgcttattttgtgtgtgcctgagaagggatgaggagggggcggggcttaggggagtaggagggggtgtgtgtgagtgtttgatattaactgggctgttcctgaatgttctgatgcatgcctttacagtggtaaattacacccattttaaattaaggaggtttgtcattctctagaagaaattagaaatactgcataggcaatctcagaggtcccttggagaaggccaggcttttacaaacaaacaaaacaaaaattttgaaggctttgtataatttgttcttttttttcagaacacagcgaatgtttcctaaatccttgcctttcacttcctccgattacaggtgctaatgtcattttgagtcattaaaatagttgataaactgttttttaatttttcttgccattatagttttattaacatttaaacacgtatgacatttgaacattctttaaaatgaccatcaacacggtttcgtatgtttcagtagattttttttttcagttgcttctgttttttttttttaatttaacctttgttttgtttatttatttttcccataacagttgtttaagcagtgatgacagtgatttagagttgaactaactgtgcaaattgaatatgcagtatttctttaaaagagactggttaaaaaaaaaaatggaaggaattcagtaataaacctccttaatctaatggcatttttttcattgctcccactaagttttctcacgcaagcatgcatccgcagtatgattattttttcctttgcttttttttattttagttttttctttcttttgcttttctgctcataatttgcaagtccactagcattttactgactgtgcctgcttaaatgctgctatgagcttctaactaactcctaacagctcattcacacagcctgtttacctttatcttttcctctcttaataattaatgaaaatagatttaaaaaaaagacgaacgttccaaaagctgcaatatcccagtaccacaacccttttctttctttatttctttctattttgtttcgttttgttctgtttttatttgtaatttttttctttttttaaactattgtattctgagaagaaaaaagcatgttacaaacttaattccctccttcgctttattttcttctttaagaaaaaaaattgagagaaaaaagggaaagcagaactaaaagaggaaaaatatttaagagttattccatgtctaacttccctttgtcagctcgaaccaaatctgagagacagtccttaaagaagggatactgcagctttatttgcaacagctaatttcaaaagttgaataagaatgtgacttttacttttttttttttaattaaagaaagttaaaaaacgaaagtcaatattttgcaattagtaaccaggtcattgatttattcccttttttatttttatttttttcttatttgtatctttctcttcccccccccccctccctctctctctttctctctctctctctctccctttctcccacgttctcctcctctgctcgcttctctcttgaactcattcagacctgagcgctcctaagaaatgccgagcgcgctttggccttgatcaacagaataactggtgcggcccttgcaggtgtgtatagttttccagattcgctgtgctggtttgcagctggtctattcgatcctctcccccttctctggcctgttgctttgtagctctgtgtgtggatctcaggagacacaggggagtgggacactgccaagtgtatgggttctatgagggatgtgcttgttctcctgctgctgccagccaaaatgccactgtaaaacagcatcactcgtgcctcctcgggtcagcgacagcaaaccttagcgcgccccctcccagggaatgttacctgccaacccccatcccttccttgtgacagcccaggatcggaatcctggcctaggtagaagcaaatgacrtcaccttctcccctcctcttctctctctctttttatttatttattttttcattgttgttttttggtttctggttgttgttttgtgtgtgtgtgttttattgktttattttattattttttttcttttggctcatagaagtcctttcctttcatgtccttggtgagggaagattatcaaatagaaccaaggtgatagagaagaaaaggaagctgtagctgagatttcacatccaactgagcacgacccaccattgtgttgtattttttgtgtttaccttatgctaacagatgcaaatactccaaagaagtgtcgggcactgttcgggcttgaccgacagactttatggtgcaaaccgtgcaggtatattaccactgcgaggcctttgggaaaatcaaagcattctgtccttccggtaccttagcgtgataatttattttgacctcgttccccatctacttcccctctggcatcaatgactaatgatcctcattcttcaaaatttccttgctaattttatgccatttcctctccccactttctctttctctcttttccccctgctctcatgaacaatatccctggtggcaggactgagaccacagccttaacaaacaaggaggggcacttatctttttgctttgaaagccagcatcctggagctggtccggccctatgaatgccttggtggcccgggtactgagcacagagagccaccatttccaaaggtttgaatgagttaacacttggcagcaattgcattcccgtgcacttagagtcgagacacatggagaagggttctggggtaggcttcttctttcccttttttctttttcctttttggttgttttatgtttaaaaaccacatgtctgtacggaggagcttggttagctgacattgttttacagtgctgaaaaagaagcgtggcattgaacggcatgcaccagctaaagggctgcaagcagtgagtcatgcagtctcagactgcagcgtccctaggcctgcagaattaacaaaatatatgtgtgtatatatgtagcattggttccaaaaggaatcagaacagcccagaagtgtccaaattaagcacccatgttccacctgcaggtctccatccagcctgcattctcagggaaagtgtaggtacttccttcttggtggagggataccgactagctcctgtctcatttcctttctttaatgaccacctttggttaaatgtgttgtttctttgttctgatacaagcagtctttgaatttggaatattacaatggtaggtatttcaacaccctaaacacgcttccctgtttgtagtgcctccctcgtcacgtgtccctccccttcatgactttgccatgtgctccgtgtttagacgttagatcagatgtgcatcccattacgtgcatgcccacgagtctcctgtgtctcttccccccttctctgatgccaatacgagagatcggtgaagtgcctcgtgttgaccccagcacacattagaggagagagggcctgagagtattccctgagagggagccacacagacagccctctgcctgtggaatgagggatttgggggcgagttgaacacccggcaggagaggaactccccaggcattctgtgagatggtagtgttcacagcgctgacagatgtccctttgacacagtcctggggtcttctctgcacaacagaaaggagttttgtgacaaagttgatggaggaggttaggtatttaattaggactagccagggagggcagggactctgttaagcagtgaatttgtcaaaattttacttgtaccaggtgggaagataactagctgtggaagcctgttctgagatgccctgccatggccaatgactggttaaccacaagggtcactaaaagagagggtttctcatgatctgtagaaatgtacaactgacactattgtgtgctcctcacaataaggccggttcaggtacctagtttgtttattttattaatggggtgggtggtggtttatgaatcctttttttgttttggaagcagttgctgcaagtcagacttttttttttcttgaagttattcctaacattgacccaaacatgcatcccccatttgggcatagctttagcttacaccttgcttacagcctgggtgtatcttcagagaccagaattttattgatatataaaaaaaaaatctgccaaccgaaaacctttgtagctgcttcctgtttgagcagcatggttttctaaaatgcatcttggaggggctgtcaatagggcagcatttctgctgcagacgctgagcccctggtcctaggtgccagagttccccaggtccctgtctccacctggttttctttccagtctcagcagtgttcagactttcccagcagatatttttctttgttggtgacttttccataccatggaatgattagcaaatgcatttctgctgtctttgaaggatgctattccaaaacaggatcaggaagaacccttagtttcctttcagaataaacaagaagctagaaaggggtttctaagaggccactcctctgaatcgagatgaagcctaggttgggggtgctaagagtatgggttaccttcccccttttactcaacttttccttttaacgtggctatggccacccctggcttaatgctaaaactcataggacaaaatgtacttaaaaaaaaaaaaaaaggaaaaaaagaaaagcagttgccaaccgaggcattttctgactcgtcagaaatgtgtgtgcgtgccagctgccctgtgctcagccaccttaggagacccattgctctgtcgccatagtcttcatgtcccgtgttccagatacccctctcattcctatgatctggaaacttccacgtcatgagggtgggaggggtgaggaaggtaccagaatgctcctagccaatcagggcttctagcttgccacacaaggtttctagtttcatttgacatttgtggacattttaacaagattctgttttgagcccaccaagttgcttttcccatcttttcactctgccctaatatagcatggaatgctgcttggtgctgttcccttgtcttcctggttgttctccctgcttctttctttctccctttcctttcctctctctgtttttctctgttgctttctcagttttgcttatgccctccccctccccacctcctttccttctcccatttttaaaatgcatggacatcttagttttttgagcatgttttgatctgcaggctaaggtggtttaaaactctgagaggcttaattatttatcttggtttctgggatggaagcagaacccatagtctatttactctctcccagggagaaaaaggaaccttgccaaattgagggtgagagggggtggtgcttgctcccctagagttccttctgacccagaaggaacagacagaccctgaggccactagcccccatgaatctcagcctctgggaggcagggaggactgagcatgctcccttacacccctcccctccttccctgccttcctgccatcttgctgagtccaaaccccaagcacagaggggcatgatcagacagctctggggcacagactgagaggaggaactcagcacacccttcctttccaaggccagtgacattgtctgacagtggttgccttcaagcaggcagcatcttggttgcttccagcggcagaaagctggccagtgcttacacacgtgtttccagttggagtgttatcagcyatggttctgacaatattctagggtccttagatgagcacacttcctgtatctgcattatttttatagcattagtggggttgatccccaggctcacctttccttaccaaataccatcccatcagactgggattaatgggaggagaagctttgaagtcacatgctcaatttcttgagttgattttccccgacctcatcctttgatgctaagcaagaagggctctgaaattctcattcctatttcttacatgaatgagtagtgaagaggggagatgctggttttggtgcagggcaaaattagtctttctggtttaaacacgaatcacgataacccaaacccaggaaggtccatgctgcgattccctggcacttcttctttgtagtcacttcggtgaccggcttgtgctgcaccctccattgactagccttggcatattgacaagagcaggatgcccctccatccatcccatcctcaccatctctccttccaaccttctcactacggggtgggggaggggaaagccccaaatcttaaaaaaaaaaaaaaaatcaagtttgaatcttaatttaatccacaacctgcaggccatacaaccagttattcttgttcctttgaatcattttctgtttttcttattcttccccctcccccacctttgtttatcctcttctacctgtttttggtggtttcttttttttgtttcgttttttgttttttgtttttgttttaagtttattttgttttatttttgtttcccttcctcccttctcacctgattctgacctctcttgatttggtgtggttcttaacagacaagcccgaaagctctctgggcgccagcagcctcatggtggtggtgtgttaaaacctttaagcctcttgctagcgctgccttcagctatgtgggctcaacagtgagcattttgagagtttcatattgatacgaggcggctggggaaggagctctgtctttctcttttaaacacacacacactcacactcacacactcacacacacacatcactgggggatgggggtggtagtggtgggaatgggagtgaagggccgaggaaacttgatgggaaagtgagggactgtctaagccaaaagagcttttcagttcttctcaatttggacaaagccactttttggcaaatagatgccaccatctgcaggtggccgcctccatgctgctctcgtatataatttgggcatggtggggcatgggtgtttagtaggggttgggggaagcaagtagagagttcagactcttaaataagttgtttgccagagcaggcttagatctgggcactgtgaagtaagcgacccaccctgggggggcgccactgtaattgtcctcggaccactgggcgtgccacctctgtgggacatcccttaggtgacctcagcttgggtgtgagcattaggtaactctctcccttggcatctgtgccctctattcacagataactctctcccctgtttctaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgcttygtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacsctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgcsaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccragttcatttttaatggtttggaagccatttttgtaatgaataaatgttcatgctgtacagtatctgtagcatgccgttctggattaataaaagcaacttagtatgtgcagataaaggctggtcacttgtttctgtgatttggatttttatctctagggaaactggacctaccgtaatcaagaaaaacatattcccacgttggaacttgaccatacagttagtgtgtaggtgatgacttagataccagaacgtggtcttggactcttttgaggggttgatcccctcccctccatcctcgtggcccatttggtgtatctggtttgcataatgtgtcatttgcaatggagatgatcagtatcaaaggggatccctggtgtgtgtcttctgtagtatttcaccgtgccattcccagtagtttgttgctgaaagcaaagcacagttacagagcaaatgtcacttttttgggggctataaaccagtttctctgaaatatcctactcatcctctcacagtagcaagcagaaagaatttaattctggtgaatgagacttagtccaccaagagtgcacttaagaaaccacatccttagcagttaaggatcatgggtgtgaaagcatcctaacctccaagagttgcatcctgggagagatgcaagggtatcaaactgccctttctctagcagtgagcgattattgagtaagcagctttttagaaaattggattaaggtgatgcactgaaaggtgtgtgtggaagggccttgctgtatgtgggatccaagtgttctggctgtaccctggtaagagcccaagttcatcaccatcactgagcaggggccatgatacagatcttccctaaggtttcccctggatttcatttctcttgctgactagatggatggatggacacattgttccatttatctaggacatttataccttcaaaggatgacgatttcaatgggcatggaactgttcgtgttgccgttgtggtttcttaaggtgaccacagtatcgcatcaaggacttaagagcccctcggaaactgctttgctcaagcaagtttttcttctgtaaaatctcggcattttgtttttgctttgctttgtattcccagggaggagtgtttctggttgtccttcctcattttattttgcacactgggccgagtgacctttgaaaacacaaataagaacagtatctgttattcgtggcagtgtgccaagctgtttatgtgcattttctcatttaatcctaacactaccacctaaggcagacattcttctcctccgccaccctctgcttcattttctgaaaatggatttagaaactgagggttttaggtgccttgtctaaggccacacaggaggtggtggggctgggatttaaattcagatctgactccgggcccctgctcttaaataaagacagcccttcccctccaaaacagaagtgagggaacagtcctttcagaggatttccttgattcccccacctcctctgcctcacacactcgctcactccctttcctctctggctgtactacagagttaagcttacctaaaagcatttttgctcttcctgcctggaaaacaacccctcatgcttcaggtcttgacgaagacgtccctttgttgggggaattggtccggagcccctgagggttgcctgtctccctcctgtgtggtctttcaggcctctgtcttctagtctcctttgaaagtggctgtcgtctgcttaggtcattccagcctcaccgtgtttctcaacctcagcactcgtgacattttgggccagataattgttagttgtgggggtctgacctctgcactgtaggatgttatcaacacccctggcctccacccactagataacctgtcagcgcttgccccaccgccagtcatgacagccagaaacgtctccagacatcgccagatgtcccctggggggcaaaatcaccctcagttgaaaaccatttctctagagagccctccaggatgacaggattgtggctttcgtgccactgctgtatgctagggtcttggtttagtgcggggcacacagtggggtgcttgatatacattttttgaaggaaagaaggaatgaggttggccaactcaacactcgtattgtaggaagcagcaaaatggaaactttccatgagccttccaaattttgtgttctcacaactttcagggtggtggtgaccttaatcctttcggccatgctgggatgtaacccactgcccttgttacaaaggccagaaaaagggcaggggggtcagtccctctgctgtcagccagcccgagtgccgatctctataaaaatcaaaatgggggtcaccaagtcacacgcttgcctgccttacaacacctggttggtacttggaggatccttccacccaagatggaacttcctttcccccaggcctgtgttctcagcagcccaagctctagtcttccaaatgcccagccaagtctttgcccttcggcacttcctctctctgtctgatttcttcttacctcaagagtttcttttcaaactcagcatcttctaatttcatctgtaagagtggatctgcgggtttttttgttactaagagaccctgaaacaacgtctgggaaacgataactctcactttcccagccacatcactttcggcctcttacggggcttagccaaagatgtttgcatattagtagggcgtatgtttcctgtggctgccgtaatgaatcgccacaaatgtggtggtttaaaacaacagaaatttgctcttgcacagccttgcaaaccagaagtctgaaatcaaagtggtggcagggccgagcttcctccaaggctctggaggctaatctgttccgtgtctgtttcagcttccagtggctgcctgtaatccttggcactccgtggattgaagccacatcactccaatctctgcttccatcttcacatcgctttctcctcttgtctgtccccagacaccttctgcctctctcttacaaggatacatgtttttgtattttgggcctacctagatactcctggataaatatcccttctcttcagatctttcacttaatcacatattttgctatataaagcaatacatgttttaacaggatttgcatatggacatatattttgggggggccaccattcagcccactacagaatcattctccaactgctgagtctcagcacagaacccttcagaatgggcagttgttcgttccactattggtggtggtcttggataggcccatgtggaaagcaatttttacagtacatggcatttcatttcagatattaaaaggttcgttgttttttttttttcctgatgatgtggattcacatagggtcagagagccttggacctggatgcaggatttcgagaaagtaagtagcttggagcagtggagtgaatctgagcttggaggatcccacatctgactctctcgccgtgtgtccttgggtaattccttcatctctctgagtctttgtttcttcacctaacaagtgatgatactggtgttcatctggacagatttgtatgagggctaagatgcaaagttgctagactagtaggtcatagtgtttattattaatataaaagccaaaggccagtcttctatttgttttcattatttctttttttttttttttttttttttgagacggagtctcattctgtcacccaggctggagagtgcatggagtgcagtggcacaatcttggctcactgtaatcttctccttccaagttcaaatgattctcctgcctcagcctcctgagtagctaggactacaggcgtgtgctaccacgcccggccaatttttgtatttttagtagagacggggtttcaccacgttggccgggctggtcttgaactcctgacctcaggtgatctgcccacctcggcctcccaaagtgctgggattattgttttcattatttctctttgggattctgctggttagtccagctcttcacacccaagtaagagaatcacaaagatctagatgcagaagacacatctacatgacccagggacagacattgtgactcatccacactcattcattttacctgcaacttaatggccttaggaaaatgacttctagtctctggggagccacagccctgtctgggttgctttttgtgatatagaaatgcggcatagaaacgtgttttcaattaaagccctttgcaaagaaattgaggagtagcctaaaagcctctcgtgaacggtgcctgaggcaaatgttgcaaaccagagctgggaatcacgaatgaacagggccacagattgggttttcgaaaggattcctatctgaggttggcttctttgtctcccattccatatctggttccgcactcccaggcacctggccatcggagaggcctgccgtgaactctggcctgtgtccgatgggcaacactggtgagttctggctctgaagctgggtttttaaaagctagtacctcgtggatacacttgatgggagatgtaagcactttcattcattcagtgactatttcttgggcacctgcttacaccagggactgttctaggaactggcatgtaagtctgggtgaagccagcttggtctccagttttcctgggtttatttctgcaccatcttataggctggagtttttaaggaaagggaacaccaacattcctgaggcctggacaagccgctcacctagaaagacattttatgtaaggataataacaatagaaattgctaaaaactcgacttgcatttctcttttaatactcatggggatggaaattgcttttatgttcattttacagatgtagaaagtgacactaagaggagttaagttgcttccccaaaaacacatatctgggaagcaaagagcttaagatttgaacccaggcagcctgacttaggagcctgcatagctaaataccatgttatatttcttattataaagatggctcatcggggtaactagggagaggtggagggtagagccaatttgatccacggccttgtgagagggtattgctatgggaccaccaggcattctttctccctgtcagtgcacagaagttttcttactctggtatctgtgcatgtaataataataacaacagttgataattatataaatcaagcattttggacccagcactaaaagctatatgatcctggaactggaagaaaattagaagtatatattctaatttgtatatacatattatatagtgtttttcagattgtggcttgcaatgtatccataggtcaggagatagattttgtggaataagaccaatatttttaaaaaataagattgaatgggccgggtgcagtggctcatgtctataatcccagcactttgggaggccaagctgagtggatcacttgaggtcaggagttgaagaccagcctggccaacatggtaaaaccccatatctactaaaaatgtaaaaatttagctgggcattgtggcgaatgcctgtagtcccagctacttgggagcctgaggcacaagaatcgcttgaatctggaaggtggaggttgcagtgagccgagatcacaacactgcactccagcctgggcaacatcgcaagactccatctccaaaaaaaaaaaaaaaagaaagatggaatgaaatagaaaatatggaagacagaatatattgctgtatgtgtgtactgtattttgtaaaatctttcttactgtggttagggtaagaaagtttagaagccaagtctgaacattaatattagctatcatatattgaatataatagtttcaatatataaaatgcagtatgcacggtgtataaaattcagttaatggactaaagtttattgatgggcatttattaagtgttacaccagtatttcccaaaacgggctctatggggcacttaaaccccatgacgtcttcttgggcaaatctgtttgggtaacatctcatactttgcctcctcttagagtttcagaatgctcattcatttataagcctttatgaaagtctgccaaaaaggaccctctttcactttacctatcatgtttcccaaatgtaattgaccatagaaaacttttttgagagggtaatacttattaatttccttc

SEQ ID NO: 12417 - DNA, 20618 bp, Homo sapiens
gatgcaaagagagtaagagaagaaaattagctcctaatagataatactaactcttccttctaaatggaagcacatatttaccttcagataagtgacacccaaaagggcaccttacctttcttttttttttttttgagacgaagtctcactcttgtcccccaggctggagtgcaatggtgcaatctcagctcactgcaacctccacctcccaggttcaagcgattctcctatctcagcctcccgagtagctgggattacaggcacctgccaccacgcccggctaatttttttgtatttttagtagacatggggtttcaccatgttggccaggctggtctcgaactcctgacctcaactgacccacccgcctcggccttccaaagtgttgggattacaggcgtgagtcaccacgcccgactgagatcacagcacttcttaacagcacagagcaagcacctcctttgtacttggtagcctaccatgtgaggctaataattttctcgattaggatcgcttgagcccaggaggtcgaggctgcagtgagccgagatcacaccattgcactccaacctgacaagactctgtctcaaaaaaataaacaggccaggcgcagtggctcacgcctataatcccagcactttgggaggccaaggtgggtggatcatttaagatcaggagttcgagaccagctggccaacttggtgagaacccatctctactaaaaatgcaaaaattagctgggcgtggtggcacgtgcctgtcatcccaactactcgggaggctgaggcaaaagaatcgcttgaactcaggaagcagaggttgcagtgatccaagatcgtgtcactgaactccatcctgggcgacagagtgggcctctgtctcaaataaataagtaaataaaatactgttgttttatctggatataaaagtaatgcctccttattacagaaaatgagtgggtggggggaacacttataacaatttaaaaatctccaccaggcacggtggctcacacctgtaatctcagcactttggaaggtccaggcatgccgaacacttgaggtccggagtttgagaccagcctggccaacatggtaaaactccatctcttataaaagtacaaaaattagctgggcgtgatgggcacctataatcccagctacttgggaggctaaggcaggaaaatcgtttgaaccctggaagcggaggttgcagtgagccaagatcatgccactgtactccggcgtgggtgacagagcaagactctgtctcaaaacaataaaaaataaataaataataaaaattttaaaatgtaatatatcactcttctggattgaattgtatcctcaaaaactcctgtgttgaaaccctatcccccagtgttacagtatttgacggcaaggcctttaaaaatgtaattatgttttaataaagtcaaaagggtgaggccttaatccaatagaggaagagacatcagggatgtgtaagcacagtaaaggccatgtaaggatacagcaagaaggcagccttttgcaagccaatgagcgaggcctcagaggaaacaaaacctgccaatgccttgatcttgaatttccagcctccagaactgtgagaatatcaatttctattgtttaagccacctagtctatggtatttcattatagcagcctgagaaaactaatacaaccaccactatagatacactttttattatttgagatgggatctcactgtgctgcctaggctggattgaactcctgggctcaagtaatactcccatctcagcctcccaagtagctgggatttcaggtgcatgccattgtgcccagctttgtacatatacttttaacgttttactatacagtcatgcactgcaaaacaatgtttcagtcaatgattgatcgcatatacagcatatacagtggtggtcacacaagagtataatggagctgaaaaattcctataacctagtaacattgtagctgctataacattgtagtcgaatgcattaatcacgtttgcggtgaaggtggtgtaaacaaacccactgtactgccagctgtataaaagtacagcatattcaataatgtatactacataatacttgacaatgataataaatgactgtgttactggtttacgtatctactttttatggttagagtactccttctacttattaaaagaaaattaactgtaaaatagtctcatgcaggtgcttcaagaggtattccaagctggccgcagtggctcatgcctataatcccagcactttgggaggcggaggcgagcagatcacctgaggtcaggagttcaagaacagcctggccaacatggtgaaaccccatttctactaaaaatacaaaaattagccaggcatagtgctgtgcaccacagtcccagctacttgggaggctgagacatgagaatcacttgaacccgggaggtggaggttgtagtgagctgagatcatgccacttcactccaggctgagcgacagagtaagactctgtcccaaaaaaaaaaagaggtattccagaaacaggcattgttatcacagatgatagctccatgggtgttactgctcctgaaaacctgccagtaagacagtatgtggaggtggaagacagtgatattgatgatcctgaccctatttaggcccaggctaatgtgtttgtgtcttagtttgttttttgtttgcttgttttttgagatgctcttactctgtcacccagactggagtacagaggcaccatcacagctcactacagccacgacctcccaggcttaggtgatcctcccacctcagcctcccgagtagctgggactacaggcacccaccaccatgcccggctaatttttgtatgctttgcagaaatggggtttcgccatattgcccaacctgttttttgttttgttttgttttgtttctgagatggagtctcgctctgttgccaggctgagtgcagtggcgtgatctcaactcactgcaacctccgtctcccaggttcaagtaattctcctgcctcagcctcccaagtagctgggactacaggcgtgtgccaccacgcccagctaattttcgtatttttaggagagacggggtttcaccatgttggccacgatggtcttgacctcttgacttcgtgatccacccgcctcggcctcccaaagtgctgggattataggcgtgagccaccacgcccagccccaagctggtcttgaactcctggactcaagccatccacccacctcagcctcccaaagtgctaggattacagatgttagccactgcgcccggcctgtgtcttagtttttaacaaaatagtttaagactgaaaaaaaaaattttagtattgtaggaaaaagcttatagaataaagatataagaaaaatattattaagtcaggcatggtagcatatgcctgtaatcccagttgctagggaggctgaggcaggaggcttgcttgagtccaggagttcaatatctgcctggggaacatagcaagatcccatgtcaaaaataaattttaaaaatatatttttgtacagctgtaaagtctgtgttttatactaagtattattacaaaagtcaaaaattaaaaaaataaaatgtttgtaaagtaaaaaagttacattaagctaaggttaacttattattgaagaaattttataaatttagtatagtctaaatgcacagtatttataaagtccacagtagtgtacagtaatgtcctaagcctttacatttactcaccaaccacttactgactaaccccagaacaactcctagttctgcaagatacattcatgttaagtgccctataccagtgtaccattttttatctttcatatcctatttttaccatacattttctatgtttagatacacaaatatttaccattgtgttacaattgcctacagttttcagtaaagtaacatgccgtacaggtttgtagcctaggaagaataggctgtaccatatagcctaggtgtgtagtaggctaaaccatctagatttacataagtacatgctacaacgtttgcacaagagggcatttctcaggatgtattcccatcattaagtgatgcatacctgtatgtcttcatttatttttcaatctgaaaactgtaggccaggtgcagtggctcacacctgtaatcccagcactttgggaggccgaggcagccagattgcttgagcccaggtgttcaagaccagcctgggcaacatggcaaaaccccgtctctacaaaaaatacaaagaaactggagaggtgtgcaccagtagtcccagctactcaggaggctgagctgggagggtcacttgaacctgcaaggtcaaagctgcagtgagccatgatagtactgtactccagcctgggctacagaatgagtccctgtctcaaaaaattttaaaaagtcttggctgggcgcagtggctcccacctgtaattccaacactttgggaggcctaggcgggtggattacctgagatcgggagtttgagaccagcctgaccaacatggagaaaccctgtctctaccaaaaatacaaaaattagctgggtgtggtggcgcatgcctgtaatcccagctactcgggaggctgaggcaggagaatcgcttgaaccccagaggcggaggttgtggtgagccatgagatcgcgccattacactccagcctgggcaacaagagcaaaactgtctcaaaaaaaaaaaaaaaaaaaaaaaaaaaagtcttaaacagagtccttttcccccctcatcagcctaacctggccctgggctcagagcagagctgcccaagacactaagcagttaggaaatgccattcattcattcattcattcatgaaaataaaattaagaaaattgcatatatcaagtattctgcaaaattagatacacatatcacccgatatatatgtgtaacatacacatatgacattgtgaacagttgtgcacatcattaaaaatgtaacatgttttatttgtcacactgtctggcataacaggtactcaacatatatgcgaatcaacttttccaagacagaaaatacttcagaggaggagaaatctgacctgggccctgaagaataaagtgtaaatagcaataataacagataacgcttaatgactgcattcaatgagccaggcattgtgctaagtaatttaatgggattgtctcattcattctcacaagtactgtaagagataacggactgttagtaaacccattctacagacaaagaaaccaaggcacagagtggttaagtcactttccccaagatcacacaagtcttaactagtaaaattcaaacaaaagcaagctactccagggccttaaggaagacgtgggtgggtgaatgaatgaatgagtgaatggcatattctagctgcttagtgttttgggcaatcctgctgtgagcccagggccagactaggttgatgagaggggaaaaggactcagtttaggacttttaagacgaaagctcctgttcacttgcctacaagacaccaattcgagtaggaattaaagttcactgacagcttggcgacctctgacacctggtagaccagaaacctcacagtcaaaaaaatcgaacctgacgagggaggacgggatcagtgatctctgaccggcaccccaagcattcctggatggcagggccggcttacacgcaaggatcagcttagaatgacccctaacacttggtttaaggctctgcttccaacgactttaaatccttaataattttttaacaaggggccccacgttttcattttgtactgggtcctgcaaattatgcggccaatcctgttaagtgacaacctttagcaggtaggagacaggtactggggaaacagccacttatctctcgaatatgttccacacgtacgcaccaatcaaacttgcccacttggtcttcgtagaccgcggccgcaggaatcagcagcgtagcccaaagccagaaacgagaagcccactcagccgccatgatgcgagcgcatgcaccacccaycgccgtcccggcatgcaccgcgccgsgggctccgyctccgcgggaccacagagctgggatagcgcgcgaggscctcggtcggacgggacgctcgggattcagggactgcctcggcacacgggaagttgccctacaggcgcgggagaaagcgcaggcggcggcttrgcagggagaggcaggctgcagtgcacattgggtcaggcacacgcgaggggcagcccccgagggccgtcccagagtcccccgcgccgccggggtcctaacggggtgcaccgtcttccgccgcacgtggattcagcgcgatgcccaaatccaagcgcgacaagaaaggtgggcgaagggggagtcgggaccctgsggggagctccgtgggctggctacccagcctgcggtgagggcttcggggcggcgggggcgcagattggaacgccaggacatcctcgaggtgttccgctgcctcgctgcgagctggaatgggggcttcggggctgtaaaaccgccagaggtggctgacgcccggtcgggtctggggagcggagactcgttttgcctagtttcaggtgctcttgcaaggccaactgggtcgggaggcagctcctgaacaccgcccccggctatgcctgctgccgtttcggcccacttttcccaacttcggccctttctcatcttcctgcgctcccgccaccctggctgcctttcccttctttcagcacaggtttgttcccgtgtctggcgttgtgtgtctgcggttgtttctgcctggcatgcttacatcttcgtatggtttgcgccttcttagttgtcagttaataggatccctctgagacagggtctcgctctgttgcccaggctggagtgcagtggcgcgatcgtaacactgcaggccggatgcggtggctcacgcctgtaatcccagcactctgggaggccgaggcgggcgaatcatctgaggtcgggagttcccgaccagcctggccaatatggtgaaaccccttttctactaaaaatactaaaaattagatgggcatggtggcaggtgcctgtaatcccagctacttgggagactgaggcgggagaatcgcttgaatccgggaggcggaggttgcaatgagccgagatcgctccactgtactgcagcctgggcacgacagagcgagactccgtctcaaaaataaataaataaaataagtcactgcagccttgacctccttggcttaagcgatcctcccacctcaacctcccgagtagctgagactacaggcgcacgccaccacacccagctaggttttttttgtttattttttatagagaagactcagtgtgttgccaagctggtctcgaacacctgggctccaaccaccctccctgagtgctgggattacaggcgtgagccactacacccgacttgcgcacctcttaagagaccgtttttgaccacctttgctgtggtggcctctctcttaacccggctccctggaatattcaaaaatatttaggggtctggcactttctaggcgttagaggatacagcagtcacaaggaaagcctatttcttatcgagcctaacgttttaggagaaacatattccgcaaaatgctaaaaatcagattgaaaatggggtgaagagatgttgatattttgtatagtgtggtcgggaaaggtctcactgatgaagtgacaaatgagcagaaaataaagaaaggaagcgagcaacctgtggaattgagcagctgtggaattatctgggagaatgctgttccaagtagagggaacctgaagtgaaaaggctctgaaatgggagcagatatgacgtgtttgggacaagaggccagtgaggctggagcagaaggagccaaatagagtttggggagggagttaggcagagagggcaggacttcctcggccttggcaaggcattggctttcctgcccaggtgaagtgagtagcagaggacccatgtgatttacctttacttatgaagggtcactctggttgccttggtgagaatagttggggaagacagggcagagggcaggaatggaagcagtgagaccagcattaatccaagacagggtgatgctggcttgagccaaaggtataacagtggaaatgatgggaagtggcccgctatatttcgtttgccctcctctgctccacttaccattgactgatgtcattgtctttgtctgtgtggtacctagttaagaggggctgagtgcgggcaggttaaagaagagaggcctgggtccctttgtgaaggcgcccggggctttgcagwtggagttctgttaagtgtttctggaacgatttgattctgtggaggggcctgggtcaggtctggcaaatgccaaactctgtgggtagagggcaaattgggccccagccatttttacagtagaggtacatgttcctccccagagaggtgttgctgcgtctttgggtccaaattgcaatactggggtgcagatacataccaggagattcagtccccagcctcatggttgcacagcataggccagctagagtggcctctgcatcatggtcaagagcagcaaggggccaggcatggtggctcacacctatgattccaacactttgggagactgaggtaggcagatctcttgagcccaggagttcgagaccaacctgggcaacrtggcaaaagccatctctgcaaaaaatacaaaactcacctgggcatggtggtgcatttctgtggtcccagccaaaattagcaggccatggtggtgtgtgcctgtagtcctgtgtgggaggattgcctgagcctaggagctcaargttgcagtgagcccagatcgtgccattgcastccagcctgggtgacagagtgagaccccatgtcaaaaaaaaaacaaaaaacaggggcctgcctcagccagcaggtgaggtctgccactgagagcacttctagcagcaggaacagcctccacccccacactgcaatcaagttttttgggtcagccttaggagctaagaaaggcctagtttgtctaaatagcaggagttatatccagggatcttcaggcccaggaatgctaatgagtaggcattccatgggccctgggaatggctttgtgtgccagaaatgatggccacaaaggccttgctgccttttttcagaatggctgcatccagctgagtgctctctgccaaaggggagaagaaaataagtctccartgcatttagattggtctctcatcatctctctcctttttgtttttattagtctccttaaccaaaactgccaagaaaggcttggaattgaaacaaaacctgatagaagaggtaagaggttgttcttttctagagcttgcaattgtttggtttataaaggtaggtataggactgttggccagggataggactgttggccaggggaacatactagtggggaaaaaaaaaaaatctccaagctgcyaatccaggcctttttcctccagcagcagcaccagcaaaaacttccatagtgatgatttccagctttgactagctcrtactctgtgccctgtcctgcactgtgtttcttatgcgttgttccactccatcctcataacatccctgtgatgtgggtactaggtgatgatgttgctgttttgcatttggggtcactgaagcttacagagatttgttagcctgccyaatgtcaaaaaacaggaggccaggaayggtgggccacgcctgtaatcccagcactttgggaggccaagtgggtcagacagcttgagtctgggagctcaagagcagcctgggcaacatgacaaaacctcatctctacaaaaagaaaagaaaaaaaaactagctggacgtggtggtacgcagcctgggcaacagagtgagaccctgtctttaaaaaaaaaaaaaagagctgggagatttaccaggtgtaggtgactgcaccaacccactgtctgtacagcttctgacctgccaacctgggctgcaggctgggtgaaacagtctcctcctgcacaatgactccactcctagaggctgcctcatggtggctttggccagcaccacgtgcagagcagtaccgatcagctgcctccccttataacagagaggctccatgtgtttccatgtagcaggacccttcctaatgtgggtgaatgtttctaggttaacagctgatgatcagttccactgttggtcataaataagtgagagacctggaaaaggccgtggggtgtagatccatggctcagcctcccctgtggttagggatcctaatttcagtaatggaggtaggagacaaccaaattagaggcctccagttcttccagtttcmatagttgtcaggggcccagagcagattcattctcatctgaggccagagtagtgcccgttgtatgctgctgcttgaactcagagcctcgtgaattgtcccacagcttcggaaatgtgtggacacctacaagtaccttttcatcttctctgtggccaacatgaggaacagcaagctgaaggacatccggaacgcctggaagcacagccggtgagcgggcagggggargaaggcccttctgagtggggacccggccaggctgctctcagtcaaagcacaggagcaatttctgaccctttaggtgcctgggtcatgccgctgacaccttaataaggacaaagtgctacctgccactgaagagcacttccttttcactgttaaagctggtcttgggcagggtgcggtggttcacgcctgtaatcctggcactttgggaggctgaggcagggggatcacctgaagtcaggagtttgagaccagcctggccaacatggcgaaaccccttctctactgaaaatacaaaaattagccgggcatggtggcaggcacctataatcccagctactcaggaggctgaagcagaagaatcacttgaacccatgaggcagaggctgcaatgagctgagattgcaccatcgcactccagcctgggtgacagagtgaaactccacctcaaaaagcagattttgcactgagctcctaggggcaggacttggcagttgctcaggagatgtttgagaggtgggcctttccggagaagtggccctttaaccctggactgtgggccatttaggagcatcacaccagttttagaatgtcagtagggacactgcgacacagacagtgacctgggagcaggatgcaggagccacatggcaagtttctgtcctggggcaggtggctctggtggtggtctcttgccgcaccagctctggttcaggctgttaacatgcctcccgcatacatccagatagagaactggtacatgatgctcstgatgggctgggagacaaaatgttgccatgtcaggagtctgtgggtgggaacataatgaaagggaccccracgtggggacagtgtggccaggcagcatggagaagtgggtgccactggctcagcctgggcctgagctcactggggaccggagctactttgcatgttgctgagggatggggagggcagggctcttccttcacagaatgctctttctcttgcttggtaggatgttctttggcaaaaacaaggtgatgatggtggccttgggtcggagcccatctgatgaatacaaagacaacctgcaycaggtaagtctctggccctcacggggtggagctaaggcaaagcygccytctctcccactactcccatgtgacagcctcccccagccatyggcaggccrgaggctcagggagagcagggcctggcttaaagctctgggttctcccttcacctccggacccaaggaatagcagcttcctgcctcccactccttcctgctatgacaaccaaaaacgtctttaaatgttgccaaatgtacccggtgagcaaaaacgtgcctagtagagaaccactgctctaatgtgaccaagctgtcctcactcctgatttgtaggtcagcaaaaggttgaggggtgaggtgggtctcctgttcaccaaccgcacaaaggargaggtgaatgagtaagtactgctgaggaacrgagggaaagaggcgggtgagaggggatttcagggagggaatgatgcaggaacttcgttccatatgtggcatcaagttggaactgctcctggaagcctgtcactgagctagtggcctgggaccacagccctctctgtcctctccagcatggtgctctgggctggctgctggccagcagccaaggtctgtgatgggggaaggcccagggccacgggacacttgggggagcctgactcatgggctggtggcgtggccaggagcatctcctcctaccacttctcttttcccttaggtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtatgggcagccctggagccaaaaggtcacagcctagagtccaagagcacgggcctgcaagctcatccctttctagctragcaagttatttctacaagcytccattttctcatgagaaaatggggctaagagtgcatgcctcacagtgggggtgaaagcagacagtaacttacagccaaaatgcagcccttgaggcccatcaggggccttgcgcttgtttaaaaaaaaaaaaagtcaaaaaattagacagccatggtggtgtgtgcctgtggtcctagctacatgggaggctgaggcaagaggatcactakagcccaggaggtcgaggctgcggcaaatcaaagggacctcagggagacagccactgcccagtgtgtgttggagccgtggggagggcaggtggctgactggattcctcccaacatgaccagggcagagagggctctgcaggcctctgggccagaggtaactgagagccaccctcttctgcaggtgtggtgactctgctgtctgactacgaggtgtgcaaggagggcgatgtgctgaccccagagcaggctcgcgtcctggtgagtctggcrccttgcgggctgttgcgggcggggttgctggctttcctctgcctgctgaaaatgcscccctgcaytttgaataccttcattcctcctgattctttgttccctttgtctcttgcagaagctttttgggtatgagatggctgaattcaargtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcrggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacrtcactgcaagagttgagagccagcgtctaaagtgtccacggcatcctgggaggttttatccttggygactctaatggtagatttttgtccaccttgttctatttgcttttgtttgtttttgatttttctgttttaaaattttaaggagagatggggtttcaccatgttgcccaggctggtctcaaactcctgagctcaagcgatctrcccaccttggcctcccaaagtgctgggattataggtgtgagccaccgcatccagcccacattgttctatytgtatttcatgaaagcagttctgaatgagagtaaatcagcttcagggtgtacagtggccctcttttttctgccatgcatggaagagggccacctccagccctgctgttgggaggtcaggctgggtcccacggtgtggggtgaccttcacaacggcattgtgcctctgacaccctctcagtgcctctgttctttggagacttcctactcccgcccacttctcaccacgcccttgggaaggacagcaggaagcaggsttcgggcagaagaggaattcaccatgttcacccaggcctaggccaggtcaagcaccagcctcagcaggaagtgctgaaggagagctcaggcccggccctctcgccttgtgaggatgactgggaagactgcacgagtgtagaggaggatctgcaaaccgggctgagaggggaaagcagcctacaaccatttaaggccaaaactggccagggggagagaatgaagggtggcaggtggtgccctccgcacctgagccaggtctagccagacctggaggaggtagtgggatggtcaggtgccaggcttggtcggcggcctctgtgacagccgagtccagggkccctttgctgctgccagtttctccaattgctccatccaggatgaccacgtccctatgcatgccctgtaagggagacagctagacttcaacacatttctgctgcacagtgactaatcatgcccctcccagccatggccccgccgctaactgggctctggttattcacgtatgccttgcattactgcttgcaaacagccatgaccgttgggctttaaagccctgcctccacgctgtctcagctttagacagctgacttcagagccactcatctgctgctcagcagctgggtaaacccaggtcagtcacccagcctttcagcttcagacttcaggccgcttgtctgaattagaaattgtgtgaagcactttgcctgcagaccaggcacgtaacgtgctcactaaagggaagccataaccatataatacccaagctggagaagggggttagggacagcagggagagggaaaccctgccactacacacagggttgggctgtctccagggtgggcagccaaggagccaggaaaagctaatggttaaaaatgtaggtttcagaccagatgcagtggcttgcacctgtaatcctagcaatttggaatgctgaggtgggcggattgcttgagcccaaagactcaagatcagcccaggctcaggccgggcacggtggctcatgcctgtaatcccagccctttgggaggccgaggcaggcrgatcacgaggtcaggagatggagaccatcctggctaacacggtgaaaccccgtctctactaaaaatacaaaaaattagctgggcatggtgacgggcgcctgtagtcccagctactcgggaggctgaggcaggagaatggcttgaacctgggaggcggagcttgcagtgagccgagatcacagcactacactcagcctgggtgacagagctagactctgtctcaaaaaaaaaaaaaagatcagcccaggcaatgtagtgagacccctgtctctacaaaaaatacagaagttagtcacatggtggtgtatgcctgtggtcccagctacatgggagactgaagcggagcattgcctgagccctggaggtcaaggctgcagtgaaccatgatcaagccactgcactccagcctgggtgacaagaggaagaccttgtccccccaaaaagaaaaacattagtttcagtcaaacccacgttcgttccctaccatgtgtagctgtgggaccctacacaagtgaaattgcctctgagccarttgcctcatgtaaaactgagatgaccatacttaacatggccatcgcaataactagtgttggttacctggccgcttaagtaatttgtgtaagaacaggtttaccccacccaaaagaactgggccatggagagccttcataggaagaaaaggacttawctcctcttggtcaaagtgaccaaatgactgcatagccctcgcagcttccccagtctccccacccccacagaatttgagagaagcagctgagcatctagagacagctgggttacctgcagcttgcgagtggtccatcgcaggacagtcaaggccatgccaggggcactggtgctatatacacaatctgcaggacctgctccaccagggccatggccttgaagtggtgcttgttccagaagctgggttgggggagggtattgcacgggggtcagtactaggggtcatctcagggcggttgcctgcacccaggtccctgaagcactgaggggctaatggcttctaagtagacatcttacatttttgagcatcagaatgcatgcatgtttctgggcccctcatccgtgttcttgggtggctagaggggaggcagtgggcgagaatccttgcatttggccaggcgtgatggccacacctgtaatccaagccctttgggaggccaagaagggaggattgcttgatgccggaagttagaagtcagccaagataacgtagggagacctcctgtctctacaaaaaaaaaaaaaaaaaattagccgggcgtagtgatgtgcgcctctagtctcagctgctctggaggctgaggcaggaagatcacttgagtctgggaggtagaggctacagggagtggtgatcgagcccctgcactccatcctgaacaacagagtgagaccccatttcgaagaaaaaaccctagcatttaacctcaccaggtgttaaacacccgccaccttaggacccctcagcacctacagcaccacacctgtgtgccctgggggacacaaggacccatgacaagtcctgatctccaatcctggctctgcggccttggctgagccacctgccctcacctgctcagtgaggaagggaaatgccccatgccagccccatgtgctaaatgccaagtataaaggtagtaaggggcctggccagctttgcacactgtaaagaacagatgggatgaaacccagcaggtctcgatgctccagggctgtagcctgggccctgcagtgtgaaaagcttgagaaaacctccgcttaggacggtggttcctgaacatggcaaggattattagaaacccttggggtttctgatcatccttatcatccaaataaggctgtaaatcacagcagtgcacacaaggtgaacccaaatgttggacactgctgcctaagtccttggccatttcaacaaaactagcactggcaccacttccatggagcttggcttgtttctgccttcctcccagggggagaaaacaaaaagaagtaataaatcacattgtgcacaaatattaaccttgcaggtgtggatttggtaaatctaagatcaggaactttccagcagcccacacacgacatctaaatttgatatattaaggaatagcgataaagtgtgtagctttttttttaataagagatggyggtcttgctttaatatccaggccaaactcctaagctcaagcaatcctcctatcttggcctcctaaggctggaactacaggcctatgacaccatgcctggctagtttttaaaatttttttgtagagacagtctcactgacctgcccaggctggtctcaaactcctgggctcaagcgattcacctttgtctcccaaagtgttgggattataggtgtgaaccaccacccccagccaagtgtatactttagacatagtgcagcagtaactgctagagaaaaagaaagctgcaagaatttctagaagttgcctctgaggaatgagacttggaaagtgacagcttttaaccatgggcacatatcactttaataaattgtccaaattttaagaaatagactgggtgtggtggcttccagcttgtatatataaactgtcttccatccaactcttggaatcagagtaaagcttttggaaatccattttgtgagagagaaagcatctaactgttgtgaatgctatttcaaattcagttaataaagctcaacattgagaatagaaatttgtttctgcagtggacatacacttacaaatgccatggtaaggacggtggctcacgcctgcaatcccagcactttgggaggccgaggcgggtggatcacgaggtcaggagttcaagaccaggctggccaagatggtgaaaccccgtctctactaaaaatataaaaaatgagccaggtgtggtggcaggcgcctgtagtcccagctactcgggaggctgaggcagagaattgcttgaacccgggaggcagaggttgcagtgagccaagattgcaccactgcactccagcctgggcaacagagctagactccatctcaaaaaaaaaaaaaaaaaaaaaagccatggtaaaaacagccttattaaattaaaaatccatgcagcagaaatgtacttgttcataaacaattgtggagcctggcactcttaccttcctgttgcttctgaaatgtattcagaatggcccaatttgagacactggtgatgccaaccaacccagtcactgggaacaagcaggtcagaaatgaagcaagtagggcagcccatggcagcctgaagtttcaggaactcccctcctcatgaattcccatgtgcaaaatctatgtcacctccttctccagtcttttttttttttttttttcttttttgagatggagtcttgctctgtcgcccaggctggagtgcagtggcatgatctcagctcactgcaagctccacctcccggatttacgccattctcccgcgtcagcctcccgggtagctggaactacaggcgcccaccaccatgcccggctaattttttgtatttttagtagagacggggtttcaccatgttaactaggatggtcttgatctcctgaccccataatccgcccgcctcggcctcccaaagtgctgggattacaggcgtgagccactgcgcctggcccttctccagtcttttatacagcacagagcagtttccttagtttgaggatgaataaatatatattagacgctctccagatccagctctgctcctttaggtctttttgttccttctcatttgtttttaaattaacaaatacgaattgtatatatatttaaggtgctgtttgggaactgtctcttgaagaagctctttagatataaaatggctgagggaggaggtggagtgggaaaaaaagaagagaaaaaagatatgaaatggctgaattcaagtggacatcaactatctttgagatatagtatccagaagattctaataggtgggatgtggcatagcagagaatgcatccctgatggggatactcaagagtctcagcagctcctggggctcatctcgacttgaccactcaggaccgttgctcccagtgttacagtttattttcctaagataaccaccccatgctctcaaatgctctttgtacaggtatctttgactcccctcccaggacacaagagtgatgctatggactcctgaggctgggacataaaaggccacatggcttctgcctagattgcttgagatgtgctcccttggaagccacatgcagaggccacatgtgtgccagttaatgacagcagctgataagtgaatgtcttcaggtgaccctagcctacagctgctaaatcacgcctcagacaccggggaacagatgaggcttcccccactgagttctacccaaacagtgggtttgccaccacccagctaatttttgtatattttgtcaagatgggatttcaccatgttgcccaggctgctcttgaactcctggattcaagcaatccccttgcctaggcctctcagagttctgggatttcaggaatgagacaccgtgcctggcctgttttgttttttaaaaacaacagtattgagacataattcagacactatacagttgacttacttaaagtgatgtttaatgctgtttcatgtattcagagttgtacaaccatcacaatcaatttcagagcatcttcataagcgcccccaaaagaaaccctgtactcattagcagtgaatctccatttcctcgcaatcctc

SEQ ID NO: 12418 - DNA, 46075 bp, Homo sapiens
ttcctcagcagtacttactcattcacctcctcctttgtgcggttggtgaacaggagacccacctcacccctcaaccttttgctgacctacaaatcaggagtgaggacagcttggtcacattagagcagtggttctctactaggcacgtttttgctcaccgggtacatttggcaacatttaaagacgtttttggttgtcatagcaggaaggagtgggaggcaggaagctgctattccttgggtccggaggtgaagggagaacccagagctttaagccaggccctgctctccctgagcctccggcctgccaatggctgggggaggctgtcacatgggagtagtgggagagagggcggctttgccttagctccaccccgtgagggccagagacttacctgrtgcaggttgtctttgtattcatcagatgggctccgacccaaggccaccatcatcaccttgtttttgccaaagaacatcctaccaagcaagagaaagagcattctgtgaaggaagagccctgccctccccatccctcagcaacatgcaaagtagctccggtccccagtgagctcaggcccaggctgagccagtggcacccacttctccatgctgcctggccacactgtccccacgtcggggtccctttcattatgttcccacccacagactcctgacatggcaacattttgtctcccagcccatcacgagcatcatgtaccagttctctatctggatgtatgcgggaggcatgttaacagcctgaaccagagctggtgcggcaagagaccaccaccagagccacctgccccaggacagaaacttgccatgtggctcctgcatcctgctcccaggtcactgtctgtgtcgcagtgtccctactgacattctaaaactggtgtgatgctcctaaatggcccacagtccagggttaaagggccacttctccggaaaggcccacctctcaaacatctcctgagcaactgccaagtcctgcccctaggagctcagtgcaaaatctgctttttgaggtggagtttcactctgtcacccaggctggagtgcgatggtgcaatctcagctcattgcagcctctgcctcatgggttcaagtgattcttctgcttcagcctcctgagtagctgggattataggtgcctgccaccatgcccggctaatttttgtattttcagtagagaaggggtttcgccatgttggccaggctggtctcaaactcctgacttcaggtgatccccctgcctcagcctcccaaagtgccaggattacaggcgtgaaccaccgcaccctgcccaagaccagctttaacagtgaaaaggaagtgctcttcagtggcaggtagcactttgtccttattaaggtgtcagcggcatgacccaggcacctaaagggtcagaaattgctcctgtgctttgactgagagcagcctggccgggtccccactcagaagggccttcytccccctgcccgctcaccggctgtgcttccaggcgttccggatgtccttcagcttgctgttcctcatgttggccacagagaagatgaaaaggtacttgtaggtgtccacacatttccgaagctgtgggacaattcacgaggctctgagttcaagcagcagcatacaacgggcactactctggcctcagatgagaatgaatctgctctgggcccctgacaactatggaaactggaagaactggaggcctctaatttggttgtctcctacctccattactgaaattaggatccctaaccacaggggaggctgagccatggatctacaccccacggccttttccaggtctctcacttatttatgaccaacagtggaactgatcatcagctgttaacctagaaacattcacccacattaggaagggtcctgctacatggaaacacatggagcctctctgttataaggggaggcagctgatcggtactgctctgcacgtggtgctggccaaagccaccatgaggcagcctctaggagtggagtcattgtgcaggaggagactgtttcacccagcctgcagcccaggttggcaggtcagaagctgtacagacagtgggttggtgcagtcacctacacctggtaaatctcccagctcttttttttttttttaaagacagggtctcactctgttgcccaggctgcgtaccaccacgtccagctagtttttttttcttttctttttgtagagatgaggttttgtcatgttgcccaggctgctcttgagctcccagactcaagctgtctgacccacttggcctcccaaagtgctgggattacaggcgtggcccaccgttcctggcctcctgttttttgacattgggcaggctaacaaatctctgtaagcttcagtgaccccaaatgcaaaacagcaacatcatcacctagtacccacatcacagggatgttatgaggatggagtggaacaacgcataagaaacacagtgcaggacagggcacagagtatgagctagtcaaagctggaaatcatcactatggaagtttttgctggtgctgctgctggaggaaaaaggcctggattggcagcttggagattttttttttttccccactagtatgttcccctggccaacagtcctatccctggccaacagtcctatacctacctttataaaccaaacaattgcaagctctagaaaagaacaacctcttacctcttctatcaggttttgtttcaattccaagcctttcttggcagttttggttaaggagactaataaaaacaaaaaggagagagatgatgagagaccaatctaaatgcactggagacttattttcttctcccctttggcagagagcactcagctggatgcagccattctgaaaaaaggcagcaaggcctttgtggccatcatttctggcacacaaagccattcccagggcccatggaatgcctactcattagcattcctgggcctgaagatccctggatataactcctgctatttagacaaactaggcctttcttagctcctaaggctgacccaaaaaacttgattgcagtgtgggggtggaggctgttcctgctgctagaagtgctctcagtggcagacctcacctgctggctgaggcaggcccctgttttttgttttttttttgacatggggtctcactctgtcacccaggctggactgcaatggcacgatctgggctcactgcaactttgagctcctaggctcaggcaatcctcccacacaggactacaggcacacaccaccatggcctgctaattttggctgggaccacagaaatgcaccaccatgcccaggtgagttttgtattttttgcagagatggcttttgccatgttgcccaggttggtctcgaactcctgggctcaagagatctgcctacctcagtctcccaaagtgttggaatcataggtgtgagccaccatgcctggccccttgctgctcttgaccatgatgcagaggccactctagctggcctatgctgtgcaaccatgaggctggggactgaatctcctggtatgtatctgcaccccagtattgcaatttggacccaaagacgcagcaacacctctctggggaggaacatgtacctctactgtaaaaatggctggggcccaatttgccctctacccacagagtttggcatttgccagacctgacccaggcccctccacagaatcaaatcgttccagaaacacttaacagaactccaactgcaaagccccgggcgccttcacaaagggacccaggcctctcttctttaacctgcccgcactcagcccctcttaactaggtaccacacagacaaagacaatgacatcagtcaatggtaagtggagcagaggagggcaaacgaaatatagcgggccacttcccatcatttccactgttatacctttggctcaagccagcatcaccctgtcttggattaatgctggtctcactgcttccattcctgccctctgccctgtcttccccaactattctcaccaaggcaaccagagtgacccttcataagtaaaggtaaatcacatgggtcctctgctactcacttcacctgggcaggaaagccaatgccttgccaaggccgaggaagtcctgccctctctgcctaactccctccccaaactctatttggctccttctgctccagcctcactggcctcttgtcccaaacacgtcatatctgctcccatttcagagccttttcacttcaggttccctctacttggaacagcattctcccagataattccacagctgctcaattccacaggttgctcgcttcctttctttattttctgctcatttgtcacttcatcagtgagacctttcccgaccacactatacaaaatatcaacatctcttcaccccattttcaatctgatttttagcattttgcggaatatgtttctcctaaaacgttaggctcgataagaaataggctttccttgtgactgctgtatcctctaacgcctagaaagtgccagacccctaaatatttttgaatattccagggagccgggttaagagagaggccaccacagcaaaggtggtcaaaaacggtctcttaagaggtgcgcaagtcgggtgtagtggctcacgcctgtaatcccagcactcagggagggtggttggagcccaggtgttcgagaccagcttggcaacacactgagtcttctctataaaaaataaacaaaaaaaacctagctgggtgtggtggcgtgcgcctgtagtctcagctactcgggaggttgaggtgggaggatcgcttaagccaaggaggtcaaggctgcagtgacttattttatttatttatttttgagacggagtctcgctctgtcgtgcccaggctgcagtacagtggagcgatctcggctcattgcaacctccgcctcccggattcaagcgattctcccgcctcagtctcccaagtagctgggattacaggcacctgccaccatgcccatctaatttttagtatttttagtagaaaaggggtttcaccatattggccaggctggtcgggaactcccgacctcagatgattcgcccgcctcggcctcccagagtgctgggattacaggcgtgagccaccgcatccggcctgcagtgttacgatcgcgccactgcactccagcctgggcaacagagcgagaccctgtctcagagggatcctattaactgacaactaagaaggcgcaaaccatacgaagatgtaagcatgccaggcagaaacaaccgcagacacacaacgccagacacgggaacaaacctgtgctgaaagaagggaaaggcagccagggtggcgggagcgcaggaagatgagaaagggccgaagttgggaaaagtgggccgaaacggcagcaggcatagccgggggcggtgttcaggagctgcctcccgacccagttggccttgcaagagcacctgaaactaggcaaaacgagtctccgctccccagacccgaccgggcgtcagccacctctggcggttttacagccccgaagcccccattccagctcgcagcgaggcagcggaacacctcgaggatgtcctggcgttccaatctgcgcccccgccgccccgaagccctcaccgcaggctgggtagccagcccacggagctccccccagggtcccgactcccccttcgcccacctttcttgtcgcgcttggatttgggcatcgcgctgaatccacgtgcggcggaagacggtgcaccccgttaggaccccggcggcgcgggggactctgggacggccctcgggggctgcccctcgcgtgtgcctgacccaatgtgcactgcagcctgcctctccctgccaagccgccgcctgcgctttctcccgcgcctgtagggcaacttcccgtgtgccgaggcagtccctgaatcccgagcgtcccgtccgaccgagggcctcgcgcgctatcccagctctgtggtcccgcggaggcggagcccscggcgcggtgcatgccgggacggcgrtgggtggtgcatgcgctcgcatcatggcggctgagtgggcttctcgtttctggctttgggctacgctgctgattcctgcggccgcggtctacgaagaccaagtgggcaagtttgattggtgcgtacgtgtggaacatattcgagagataagtggctgtttccccagtacctgtctcctacctgctaaaggttgtcacttaacaggattggccgcataatttgcaggacccagtacaaaatgaaaacgtggggccccttgttaaaaaattattaaggatttaaagtcgttggaagcagagccttaaaccaagtgttaggggtcattctaagctgatccttgcgtgtaagccggccctgccatccaggaatgcttggggtgccggtcagagatcactgatcccgtcctccctcgtcaggttcgatttttttgactgtgaggtttctggtctaccaggtgtcagaggtcgccaagctgtcagtgaactttaattcctactcgaattggtgtcttgtaggcaagtgaacaggagctttcgtcttaaaagtcctaaactgagtccttttcccctctcatcaacctagtctggccctgggctcacagcaggattgcccaaaacactaagcagctagaatatgccattcactcattcattcattcacccacccacgtcttccttaaggccctggagtagcttgcttttgtttgaattttactagttaagacttgtgtgatcttggggaaagtgacttaaccactctgtgccttggtttctttgtctgtagaatgggtttactaacagtccgttatctcttacagtacttgtgagaatgaatgagacaatcccattaaattacttagcacaatgcctggctcattgaatgcagtcattaagcgttatctgttattattgctatttacactttattcttcagggcccaggtcagatttctcctcctctgaagtattttctgtcttggaaaagttgattcgcatatatgttgagtacctgttatgccagacagtgtgacaaataaaacatgttacatttttaatgatgtgcacaactgttcacaatgtcatatgtgtatgttacacatatatatcgggtgatatgtgtatctaattttgcagaatacttgatatatgcaattttcttaattttattttcatgaatgaatgaatgaatgaatggcatttcctaactgcttagtgtcttgggcagctctgctctgagcccagggccaggttaggctgatgaggggggaaaaggactctgtttaagacttttttttttttttttttttttttttttgagacagttttgctcttgttgcccaggctggagtgtaatggcgcgatctcatggctcaccacaacctccgcctctggggttcaagcgattctcctgcctcagcctcccgagtagctgggattacaggcatgcgccaccrcacccagctaatttttgtatttttggtagagacagggtttctccatgttggtcaggctggtctcaaactcccgatctcaggtaatccacccgcctaggcctcccaaagtgttggaattacaggtgggagccactgygcccagccaagactttttaaaattttttgagacagggactcattctgtagcccaggctggagtacagtactatcatggctcactgcagctttgaccttgcaggttcaagtgaccctcccagctcagcctcctgagtagctgggactactggtgcacacctctccagtttctttgtattttttgtagagacggggttttgccatgttgcccaggctggtcttgaacacctgggctcaagcaatctggctgcctcggcctcccaaagtgctgggattacaggtgtgagccactgcacctggcctacagttttcagattgaaaaataaatgaagacatacaggtrtgcatcacttaatgatgggaatacatcctgagaaatgccctcttgtgcaaacgttgtagcrtgtacttatgtaaatctagatggtttagcctactacacacctaggctatatggtacagcctattcttcctaggctacaaacctgtacggcatgttactttactgaaaactgtaggcaattgtaacacaatggtaaatatttgtgtatctaaacatagaaaatgtatggtaaaaataggatatgaaagataaaaaatggtacactggtatagggcacttaacatgaatgtatcttgcagaactaggagttgttctggggttagtcagtaagtggttggtgagtaaatgtaaaggcttaggacattactgtacactactgtggactttataaatactgtgcatttagactatactaaatttataaaatttcttcaataataagttaaccttagcttaatgtaacttttttactttacaaacattttatttttttaatttttgacttttgtaataatacttagtataaaacacagactttacagctgtacaaaaatatatttttaaaatttatttttgacatgggatcttgctatgttccccaggcagatattgaactcctggactcaagcaagcctcctgcctcagcctccctagcaactgggattacaggcatatgctaccatgcctgacttaataatatttttcttatatctttattctataagctttttcctacaatactaaaattttttttttcagtcttaaactattttgttaaaaactaagacacaggccgggcgcagtggctaacatctgtaatcctagcactttgggaggctgaggtgggtggatggcttgagtccaggagttcaagaccagcttggggctgggcgtggtggctcacgcctataatcccagcactttgggaggccgaggcgggtggatcacgaagtcaagaggtcaagaccatcgtggccaacatggtgaaaccccgtctctcctaaaaatacgaaaattagctgggcgtggtggcacacgcctgtagtcccagctacttgggaggctgaggcaggagaattacttgaacctgggagacggaggttgcagtgagttgagatcacgccactgcactcagcctggcaacagagcgagactccatctcagaaacaaaacaaaacaaaacaaaaaacaggttgggcaatatggcgaaaccccatttctgcaaagcatacaaaaattagccgggcatggtggtgggtgcctgtagtcccagctactcgggaggctgaggtgggaggatcacctaagcctgggaggtcgtggctgtagtgagctgtgatggtgcctctgtactccagtctgggtgacagagtaagagcatctcaaaaaacaagcaaacaaaaaacaaactaagacacaaacacattagcctgggcctaaatagggtcaggatcatcaatatcactgtcttccacctccacatactgtcttactggcaggttttcaggagcagtaacacccatggagctatcatctgtgataacaatgcctgtttctggaatacctctttttttttttgggacagagtcttactctgtcgctcagcctggagtgaagtggcatgatctcagctcactacaacctccacctcccgggttcaagtgattctcatgtctcagcctcccaagtagctgggactgtggtgcacagcactatgcctggctaatttttgtatttttagtagaaatggggtttcaccatgttggccaggctgttcttgaactcctgacctcaggtgatctgctcgcctccgcctcccaaagtgctgggattataggcatgagccactgcggccagcttggaatacctcttgaagcacctgcatgagactattttacagttaattttcttttaataagtagaaggagtactctaaccataaaaagtagatacgtaaaccagtaacacagtcatttattatcattgtcaagtattatgtagtatacattattgaatatgctgtacttttatacagctggcagtacagtgggtttgtttacaccaccttcaccgcaaacgtgattaatgcattcgactacaatgttatagcagctacaatgttactaggttataggaatttttcagctccattatactcttgtgtgaccaccactgtatatgctgtatatgcgatcaatcattgactgaaacattgttttgcagtgcatgactgtatagtaaaacgttaaaagtatatgtacaaagctgggcacaatggcatgcacctgaaatcccagctacttgggaggctgagatgggagtattacttgagcccaggagttcaatccagcctaggcagcacagtgagatcccatctcaaataataaaaagtgtatctatagtggtggttgtattagttttctcaggctgctataatgaaataccatagactaggtggcttaaacaatagaaattgatattctcacagttctggaggctggaaattcaagatcaaggcattggcaggttttgtttcctctgaggcctcgctcattggcttgcaaaaggctgccttcttgctgtatccttacatggcctttactgtgcttacacatccctgatgtctcttcctctattggattaaggcctcacccttttgactttattaaaacataattacatttttaaaggccttgccgtcaaatactgtaacactgggggatagggtttcaacacaggagtttttgaggatacaattcaatccagaagagtgatatattacattttaaaatttttattatttatttattttttattgttttgagacagagtcttgctctgtcacccacgccggagtacagyggcatgatcttggctcactgcaacctccgcttccagggttcaaacgattttcctgccttagcctcccaagtagctgggattataggtgcccatcacgcccagctaatttttgtacttttataagagatggagttttaccatgttggccaggctggtctcaaactccggacctcaagtgttcggcatgcctggaccttccaaagtgctgagattacaggtgtgagccaccgtgcctggtggagatttttaaattgttataagtgttccccccacccactcattttctgtaataaggaggcattacttttatatccagataaaacaacagtattttatttacttatttatttgagacagaggcccactctgtcgcccaggatggagttcagtgacacgatcttggatcactgcaacctctgcttcctgagttcaagcgattcttttgcctcagcctcccgagtagttgggatgacaggcacgtgccaccacgcccagctaatttttgcatttttagtagagatgggttctcaccaagttggccagctggtctcgaactcctgatcttaaatgatccacccaccttggcctcccaaagtgctgggattataggcgtgagccactgcgcctggcctgtttatttttttgagacagagtcttgtcaggttggagtgcaatggtgtgatctcggctcactgcagcctcgacctcctgggctcaagcgatcctaatcgagaaaattattagcctcacatggtaggctaccaagtacaaaggaggtgcttgctctgtgctgttaagaagtgctgtgatctcagtcgggcgtggtgactcacgcctgtaatcccaacactttggaaggccgaggcgggtgggtcagttgaggtcaggagttcgagaccagcctggccaacatggtgaaaccccatgtctactaaaaatacaaaaaaattagccgggcgtggtggcaggtgcctgtaatcccagctactcgggaggctgagataggagaatcgcttgaacctgggaggtggaggttgcagtgagctgagattgcaccattgcactccagcctgggggacaagagtgagacttcgtctcaaaaaaaaaaaaaagaaaggtaaggtgcccttttgggtgtcacttatctgaaggtaaatatgtgcttccatttagaaggaagagttagtattatctattaggagctaattttcttctcttactctctttgcatctgactacattgaatggaaatcttgcttttggtcagagctcttcactaacaaacacttcttttttttgagatggagttttgctcttgttgcccaggctgaagtgcaatggtgcgatctcagctcactgcaacctccgcctcccgggttccagcaattctcctgcctcagcctcccgagtagctgggattacaggcatgcgccaccatgcccagctaattttgtatttttcatagagacagacggggtttctccatgttgatcaggttggtctcgaactcctgacctcaggtgatctgcctgcctcggcctcccaaagtgttgggattacaggtgtgagccactgcgcccagctaacaaacacgtcttatgtgtcctaaaatgaatgtgatggtgatagccctgtgattttttttccrgagcattttgtggaatggtgattttagctccttatggtcccctgtactctttttttctcaggagacagcaatatgttgggaaggtcaagtttgcctccttggaattttcccctggatccaagaagttggttgtagccacagagaagaatgtgattgcagcattaaattcccgaactggggagatctgtgagtgaactgagaactgtgtstactggctgcctcagggatgaaagacttaccattgccaactctgcctggctgattcctgaataaggaacatgttggccaaaagatgcctctcctagtggattctgatactttttttttttcagtcttaccatctttgaatatttgtatgttcctataactgacctttgcggtttgttctctcagcttgaatcctgagtgtccttaaataagatattgctgcaagcccaggygggaggatcacttgagctcaggagttcgagaccagcctggggatcacagtgaggccccatgtctaaaattaaaaaaatcaggcatggtggcgtgtgcctagattcccagctacttgggagactgaggtgggaggattgcttgagcccagcaggttgaggctgcagtgagctgtgatcatgccagttcactccagcctgggcaatagrgcaacaccttgtctcaaaaaaaaagatgctgctgcaaaaaacacattattctactttgcagtaaactctcagataccctcacttaattacctacactggccggatgtttttaggcactaaaataagggaaatagaatttatgatcactatttttcttgtgaattggatggattttattaatcttattgttgtttgtttatatgtttgatggggtggtagtggggcctggacagtagtggcccctcttaaccccttctaccctcattaccccgtgaatgggactggatcactgccagttagctatactccttcactccctcgagataaaattggacattgctgtgcaaatgaagagctcttcatttatttcttagtcttctgggttgccaccttttgttcatagtaatgtctaactttcatgtctctcagtgtggcgccatgttgacaagggcacggcagaaggggctgtggatgccatgctgctgcacggacagggtaagcagagtcctcccstgtctccattgtgcggccagctccctgtcccattccttggctccttgatctgtacagggtctggtagggaaagragactggggactcctgacagtgaaggacaggtacctgtttaacatgtatttgcatccagaaatcagaggtgaggccactgctcacagtgggaccctaggaagcgacagagcaagtgggaaatgacttcaccacgatcttttcttttccagatgtgatcactgtgtccaatggaggccgaatcatgcgttcctgggagactaacatygggggcctgaactgggagataaccctggacagtggcaggtaggggagaaactggattttatcttgactgagttaaaggcttcaccggaacacagatctgcatagacagcaactctgggcttttggctttttcccagggaccactgaagagccagccattgacattgagtacccattgtggatatgcttgctcagccaacatgtattgagcgcctgttagatgcagagtttctaggtgcaatrtttgcgcttgtgcttgaatgctgttcctaatttcactgtgattcgtgagttttgcaatgttccagatataagaacataatataaaacttccactgtttagttttgtttaaagaacagcctgacctattgttaacatctttgctaaagttgtttatttttatttattgagttttttgagacatagtttcactctgtcacccaggctagagtgcagtggtgtgatcttggctcactgcaaccttcacctcccaggttcaagcagttctcgtgcctcagcctctccagtagctgggattataggcatgtgaaccacgcctggctaatttttgtattattagtagagacggggtttcaccatgttggccaggctggtctcgaactcctgaccccgtgatcctcccacctcagcctctcaaagtgttgggattacaggcatgagccaccgggcctggcccctaaagttgttcaaatgatagggtcatttgtattagcttatacattttctgatagtaattcatttggtaaacacgtgctgagccccaggcgatgagaacacatgggactgtgagacagttgctgtcattgaggattccgctgtccattgggaggcaggcaggtagcacagtaatgacagcactgtctcatggatatgtggcagagggtaggtccagttgctgtgaagtcccaggggaaggagggaacagcccttaggagatacagatggtttcagggaagcaagtagtgtggccaaatggttgcaagtgcagaatctcaagttgactaacaagaggcagagccagggttaggatccagctgtgtttgaccccaaagcctgttttcttacccactaagcaacagtgggtactgttctggactgtctctcccagcctgaggctctgcasgtgtgggctgctctcaacctgtacttgtgytcagtttccaggcacttgggctggttggcctgcaggagtctgtaaggtacatcgcagtcctgaagaagactacacttgccctccatcacctctccagtgggcacctcaagtgggtggaacatctcccagaaaggtaaggctgcctgctcacaggcaatagctgcctcgttctactctctaggagctcctctttctcctcgagggacccgaagcatttgctttaacccaggcctgtctcttgttggtgttscatggagtgtgttgcactcagaatatcttgaaggctgtgagtatgggtgaaactccggagtatgcctggagtttcctttgcactgaggagaacactctcaaactggggtgctagggcgwgccatgctacgggagccactcactcgctcatggttatggtactttgtgccttctgacttctagttcaagttctagttctagttctagttctgactgagcctttcgttcatattaagagttagaacaactcaagaagacccagggtaggctgagtgaggtgtgaaatggtttctcgaggtcctgctggtagaaagcatcgaaattgggaaggaacaagagagaaggaacaagataaaaggatctacttagacaccctgtggccattttcaaagtttagagcaggactcaaaacttcaaattctggcctggcatggtgtctcacgcctgtaatccctgcactttgggagcctgaggtgggtagatcacttgagctcaggagttcragaccagcctgggcaaccccatctctacaaaaagtacaaaaaattagccaggcatggtggtgcgtgcttgtgatcccagctacttgggaggctgaggtgggaggatcacctgagcctcgggaggtagaggctgcagtgagccgtgatcrcaccactgcactgcagcctgggtgacagagtgagacgctgtctaaaaaaaaacacaacaaagaaaatgctaygaggcgggttatgaaatatccatgagcaacactggctggatgggagctgcagtgctcctggcctgcctggagggggcagccttacccacctgattggtgctctgtatttaggcctagtgttgccacatcttctaaccgtaggaaaatttagaaatctgattgtgaagtataatatcttctaaatgttgacaactaattcaaattaagaacaacwacaacaaaagcccccaaactgtgtgagccaaacaaaacctatttgggaattactagtttgtgacatctggctgaggcctggcagcccctgaggataatcctgtcctgggttgaaagctgacgctgcggtttcttcttccctctcttagtgacagcatccactaccagatggtgtattcttacggctctggggtggtgtgggccctcggagttgttcccttcagccatgtgaacattgtcaagtttaatgtggaagatggagagattgttcagcaggtacaggagggtgacaggagcctgtgaataaggtggggttgggggagacttgatagatttctttgtactggggaacagggaacttggctgggcagatgcaaaagctacttatgctccctcattctggtcacttgccagctgccttcccattaggcctytwtttaaagtactcatatttgcatgtgttatcttctggggtggctaaaaaattacatagatctagtctctgcctgtaagtatcttacagtgctgtgaaatcacagtaggacaccacatatggcaaatatagtaaagaagtgctgattctgaagtgccaggtatttaaaattatcggatatatttttccagtgaccagaaagaaaatcctgatattttttccaactttgaaggctctcaggaggttggagggtggggtttcaggggacaggaagaactcctatacaaccaaccatgaagaacctttgagcttaggacccccagtgggatgctggcagcaatattgctgttgggctgagagggaaatgtaaaaatctttcacgagcttcctgttaaygatgacttttctgtaggttagggtttcaactccgtggctgcagcacctgtctggagcctgtggtgtggtggatgargctgtcctggtgtgtcctgacccgagctcacgttccctccaaactttggctctggagacggaatgggagttgagacagatcccactgcaggtgagaggctgccactgcttcttctggcctgaggcatttcctgcggggagtagaaagtttggcatgattcccctggagggtctttctcctagactcttcctgagcagtggaagccattcaggcctctggctgaactggtgtaagaggaaatcagtcactttccyctttggggaacttgaactggagcatttggagccacctgccatggcccagttacttcccccggcaaagtagggcagaggttgtgagcctgggatgggtcagggagtcgtcagctgttagccataatcctcctcctycttgccttccagtctctcgacttagaatttggaagtggattccaaccccgggtcctgcctacccagcccaacccagtggacgcttcccgggcccagttcttcctgcactygtccccaagccactatgctctgctgcagtaccattatggaaygctgagtttgcttaaaaacttcccacaggtaactgcaggcaacrtggtttgctaggattcaggagatctctccaagacatggatgctagaaggcagtgcttttgaatctggaaacgtttgctcttaggcccaagattgatgacaccttcccgtaagtggtttgagagggggtaggtagccttatcatagaaatggtgtatttcctcctgagtattacaaaggatctttagagcaaaactagtgccttccttagtccaaaggaaatatggggacataaatgagagcttccccatagatagtaagaacaagcagcatgggatttaagattgacctgtgcctgcgttggaggtagggagagttctgttttcagctgtagatgcaactgaggcctccctctgctcttaaatgcctgaccattctgctccaaagtggggagcactttcaactctaaggccaagggccttccctggagaggtgaccctctgtaaggcagctggctagtactggtcccatttaggagctgatgccttgcttttcccccagactgccctagtgagctttgccaccactggggagaagacggtggctgcagtcatggcctgtcggaatgaagtggtgagtattgagaacaacagtcagcacttgggattttccttcctggtctccactaggaaccctgaaaatcagaagtctgggcacattgacctggtcagtttgaacccagcgggcaggaggctgttgagaagtgaggtmttgcctcaactatagagctttctgcacaccccatttctccccaggaacgagaccctaatgtgatgaccttactttcatatggggctattaagggttgaataggctttgtgggcaggggtgagaaatgagctttgtcttctctcaagtgctaagaagacaaaaacaaaagcttcatttcagtgactgggaagtgaccctttggctgaattttctcctgtccttctctttctcatagcagaaaastagcarttctgaagatgggtcaatggggagcttttcggagaagtctagttcaaaggtatggtgtggcactgggcagtatgccagacctagagacgcaggaggccaccaaagagagttgggggaagagctttggttaggagcaggtcctagagttcccagcttcaaatgrggtttcctaagtactgtaaattaaatgatgtttctcttaatctcattttaccgggagattaggaggtagaatccctagagtctgtttctagccactttctcctctgggcctcagcgtccccatttcttttgggatcctggctggcacagttgagtagtactctgtgcagttaccctgtagcagaggcatgagcccctggctggaggcataggttcctgctgtggcttccatctaagcgtttccctgcctcctgtcttgctcagtcttaccttgctcagccctacctctctctcagaagtctctgctactctgtactggcttccaagacaagtatggtagttgtaatttcatttatttactcaggcaccttatttctgccttaggatttagcttgcttttctcttttattctcctttgcatatatttccccttctggcctggctccttctctagggtatttgcccccaatccttggacttcctttggtgggctttgctttcgggggatacctgtagttgacacgtsctgtctgtactcctaggactctctggcttgcttcaatcagacctacaccattaacctatacctcgtggagacaggtcggcggctgctggacaccacgataacatttagcctggaacagagcggcactcggcctgagcgggtaaggcagagcctttctttgcagactgtcctgtgggcttctcagcacatggcttcctttcctcagggccaggtcttagccatggggcttggattaggctctctaaacatgtgttctagtgctctctgagccactgacttgttagaagtcacagtaaaggcgggtattatttatgccagctcatcattgtgcaccagggactgttctaagcttttaacttacacattaattgatttaaccctccaaacactctcatgaagcrgttgttcctgacctggttttaaaatgattctgtggcctggtgggatygagtaccatagccagagtcacggagccagyaagaggtgtcactgcggttcagattcaggtctaaccccacagcctggactcctcatcactacccagtattgcctctgtgtgcatctggttgtgttcctcagctgcttgggctgtggcttcttygtttctaaagcrgaaagtctaatcccggcctcctgctcactttgtggggtgtgattagagcatggatgaatggcgtggtacccgtggagtactcaggttcttccatggaaaggtctgggagaccccagcatcattatgttggctcctamgaatatgtatcacttactggcatccagataatagctacattgtttagacatcaaataatgccatggcctgtacctctgttaagtccaggctttgactcctggggtctggtgctctcagaggcatttggatcctcactgactacaccggtcttgactgtggcttatagctgtatatccaggtgttcttgaagaaggatgactcagtgggctaccgggctttggtgcagacagaggatcatctgctacttttcctgcagcagttgggtaagtagacctcattcaacccatttttttatttccccaggccttccaatgtgttccaatcagactgttttttgggaggctgcaggtttctggaaragattcaagtggagtgtgccctgagtgtttcgttcatagccaaatgtcacctgctttttttttttttttttttttttgagatagagtcttgctctcttgcccaggctggagtgcagtggcatgatctcggcccactgcaatctccacctttcggattcaagcgattctcctgcctcagcctcctgagtagctgggattacaggcgtgtgccaccacgaccagctaatttttgtattttcagtagagacagggtttccccatgttggccaggctggtctcgaattcctgacctcaagtgatccrcctgcctcggcctcccaaagtgctgggattacaggtgtgagccaccgtgcctggcctgtcacctgcttttttttttttttttgagacggagttttgctcttgttgctcagactgctggagtacagtggcatgatctcagctcactgcaacctctgcctcccaggtttaagtgattctcctgcctcagcctcccaagtagctgggattacaggcatgcaccaccacgcctggctaattttgtatttttagtagagatggggtttcaccatgtttgtcaggctggtctcaaactcctgacctcaggtgatccacctgcctcggcctcccaaagtgctgggattacaggtgtgagccaccgtgcctggctctttttttcttttttgagacagagttttgctcttgttgcccaggctggagtggaatggtgtaatctcagctctttgcaacttctgcctcctggttcaagcgattctcctgcctcagcctcctgagtagctgggattataggcgctaattttgtatttttagtaagagacagggtttcaccatgttggcccaggctggtctcaagctcctaacctcaggtgatctgcccgccttggcctcccaaagtgctgggattacaggcatgagccactatgcccggccccgttacctgcttttgaagaataacttggcattctcggtgggatacagaactttcctcctttgacctattgattccagccccttgctctgccatttctccttttatgcaagagcttgtagtaatccctgagtcagcgagaagagtctctctagaaaatctgggagacaggcttagcttttgtttatttatttatttattttttgagacaaggtctcactgttgcccagtctggagtacagtggcgtgatcatagctcactgcagcctcaatctcccgggctcaagtgatcttcctatctcagcctcctaagtagctgtgactacaggcgctcgccaccatgcttggctaattttttgatatttatttatttttattttattttattttatttcaagacggagtctcgctgtgtcgcccaggctggagtgcaatggcacratctcggctcactgcaacctccacctcccgggttcacgccattctcctgcctcagcctcccgagtagctggaactacaggcgcccaccatcatgcctggctaattttttgtatttttagtagagrggggtttcaccatgttagccaggatggtctcgatctcctgacctcgtgatctgcccgccttggcctcccaaagtgctgggattacaggcgtgagccactgtgcccagccctgatatttattttttgttgagataaggttttgccctgttgtccaggctggtctcaaattcctgggctcaagagattcacccaccttggcctcccaaagtgctgggattacaggcatgagccactgtgcccagccccaggcttagctttgtaaaaatgtttcctgtagcagggaaggtggtgctgtggagccgtgaggagtccctggcagaagtggtgtgcctagagatggtggacctccccctgactggggcacaggccgagctggaaggagaatttggcaaaaaggcaggtatgracctaagaggttggarctgcagagttgctggaggggccagtctggaaatgaccacaagagacactgtatcatgcatctctggcttcctaggctgggcagattgctagtcttttctgaatgagctctgtgatgaggttccggtgcattcatggccatatggtttatgaaaccattcttttctgtgaaagaatgaactgtgaatccttctagggaaagctagggaaaaatccctctagggaaagctgagggaaaaaagtctttttttttttctttttttgagacaagagtctcgctctgtcacccaggctggagtgcagtggcgcgatcttggctcactgcaacctctgcctcccaggttcaagcagctctcctgcctcagcctcctgagtagctgggattacaggcatgcgccaccatgcccggttaatttttgtatttttagtagcaacagggtttcagcatgttggtcaggctggtctcaaactcctgacctcatgatctgccagctttggcctcccaaagtgttggggattacaggcgtgagctgctgcgcctggggggaataaagtcttaacttggtattgtaatagctaccattgcctgtgtactaaaaatttgccaggcaccttatactcattgtccctaaagcagcagccatatctgtctggagacaccattgggttgatctgggtattgtggaaacagcccagtgccctctaaagctggccatggtcccaactgccaggatgaacttgattcactctgctctgattcagtcctgycccccaccctctctcttctctccattcatccagccctccaacggatagctgttgagggcctgctctggaccaggcactctgctaggcaatgcacattttcttaagctgaggattaatttgactttactgtttatttctgctgcctggatccagcaattcaaggtaaaacctgcttcttgctgccttgttgctcgttgcctgctcacatggctagcttttggttaattgtttttcttcctaacttggaccaatgaggtacatccttggggtgtgtgtgtgtgtgtgttgactgccatgcttgtgagttgtcctgttgcttctcacttctcttccttgagcagaggtgggtggaaaataagataagcagaggttctgctccttttttagtgagttattaccatgtaccagscaccacgctaaatcctttatgtacatcgtatgatgtaattttggaacagtccagtgggttacatgccactttacagatgaggaaccagaagcaaaaaggtgaagtacatttctcagtgttaccccgcagtgagtggtgaagctgggatcttaatctgggcctgctagattccagagaccatgctctttaccttgcttccttgcatctgtttacaaatctgtggtctccaatggaggagatttggagggcagtggcttcattgacrgaatcagggaaagagtgaatgatggtcctgggaactcgttgcaagtacgtctgttgggtgcaggttaaacagctgacaaagtaggaatgaagcaatgggagatggaagtacctgctcatgatacatattcactgacctgcaccctccacccccacactcatacctcttctggctttgtcatggcacccagaaaccttcttttagcatcttggatgtggggctgtggtggagacattcacagcatggctgtctcctgcatgcctgatccctgacctcttagtctcctattccaagattccagctgggtttagttgttaagagccagttaagcagtttttggaagctcctgcatgagcctcacctgagtgtgagactttgggcatcagatacaggactgccctttgggcttgtggcctagagtgtggactttatygctccagaggagaggcagagatccctcattaggaaaatcatgtacctccttatggacccctagtctgatgtagagtatgttacttttcctttacaccagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaaggtgagtggggtttaagctccagttactgaaccttttcaaattctgagggtgaggaacaaaaagccttcagtgagggataacactggttctagttttcaaggacagactcagttctttggtttcyctttctagtagtgagccaagtatttgtttatcttgcagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggtgaggcatccagctctgacttgagccagactcagtgtggcttttttgctattttgtaacttaaattgctcctaggcccttggaattgtgtgagttaatgaggaacattcaggggttagaactctgtttcttctagtttcatgcatgggtggaggaaccatccagcactgatgtggaattgtttagaaagtgggtgtgacttcaccagctatgtagggagccagctctcctcttttctaaacattggctgttggttgctgagtggctattttctcttctctctttgaggaagagcaggacacaaagatatttttgtgtcttcccagaattagaatggatttttgtgtattcattctagcatagaaggcgggcttggtagacactttcctggaacggctgcctggtgcgatctcggctcactgcagcctccacctcccaggttcaagcaattcttgtgcctcagcctcccgagtagctgggattacaggcacacgccatcatgcccggctgatttttgtatgtttagtagagacagggtctcaccatgttggccaggctggtctcaaactcctgaccttagatgatccacctgcctcggcctcccaaagtactgggattacaggtgtgagccaccacgcccggccaggttgctgaattgttacttgacttttttattagttcttgtttagaactggcagagcagccaggcgcggtggctcacgcttataatctcagcactttgggaggccaaggagggcggattgcttgagtccaggagttcgagaccagcctgggcaacatggtgaaacccctctctacaaaaaataaaaacagaattagccacgtgtggtggtttgtgcctgtagtcccagctacttgggaggttgaggtgggaggatcacttgaacctgggaggcagaggttgcagtgagccttgatcatgccactgtacttccagcttgggtgatagagagagaccctgtctcaaacgaaaaagaactggcagagacagtttgacttttttctttgtgacgttagcctaggggactattcacctacagccaagaacttattttccacaaagagggcaaagactagagaacccccacagttgttgagctggagtcccagctcttcaggtctatccctaggatttgcagtcttttyttgttggtggagcctgacagtttgctcattttaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtactgtcttcagaggggatggagmacatgctagcggagtcsggtttggggccaggtggtcaaacacagcggcccggagatggagtgctctctgcacccagcacgtgtttgggctctaaggccatcccgaagagaaatgatggctgtgtctgcatttgtgaaaactcaggttcttaacagaactgaatgtaaaccctaaactgagttcaaatcaactgatttgcagttttattcttaaggctctctttgatggggaaatttcctaactctttccttgggctctctgggtttttcaaggtcacagcttttccagccactcggaatgtcttgcgacagctacatgagcttgccccttccatcytcttctatttggtggatgcagagcagggacggctgtgtggatatcggcttcgaaaggtaggaaggcatgtcctggcacaaccctttgtggatgagatgcaggtgtttcctggccatttggctaagaagtgaattatgctactcattctactgtaaacttagattagcataatcctgatgtctgatacaaagtcaatcatttgttcatatttgttgggcagctactacatggcagatacggttctaggtgctgtggatggagtggtgcacagtagaacaaatctctgcccttgtggagctttcattccacattctttttctttttttttttgagatggagtcttgcactgtcgcccgggctggagtgcagtggtgcgatctcggctcactgcaacctctgcctccttggttcaagcgattctcctgcctcagacacccaagtagctgggattacaggcgtgcgccaccgcgcccggctaattttttgtatttttagtagagacagggctttgctgtgttggccaggatggtctcaaactcctgaccttgtgatccacctgcctcagcctcccaaagtgctgggattacaggcgtgagccaccgcgcctggccccattatttttctatagcagagagatgggactttttttccattcttgggagggtagaaggtaggaatgtgggttgagtaataagttgtacttttatatgaagatgatgttgaccaactcgtgatggaatgtgtgctttgaattttatttctagaaagggggtcagtttgctttaatcctcacatacttgagaccaactcttgtaaacagtaatacacgctggctgtgaagtccagctctgaagttcacgaggggctggcatggccttgttagcaggactgtttggagaagtactctgtggtgtgtactcacaaacagctctcccatcctgtcctgtaaggccttttgagaggcatagagtttaaccaatttgctrgattggaagtctaggtttgtcacttactaactttgtgaccttgggctctggtcttctgttttcttatctgtaaaataaggtgataagtacctgtctcataaggttgttgtgagaattcaacacataaatcacataaaactgcctggcacatggtaaatgccatctgagttggaggtgctgttgttttgaaaatgcagcgcccttttgtgacatttgtaacagctaaccttagcataaacagcactggaaatggtctgcccagaagacacatcctttacccttgtgaatgaaaacataaataaataaaatcatccttctgagttaataaaaagaggaccttgaaagagacagttttgtagattcaggggagtgaactggagtgtgggtgtcatgaatctggagtcctgaggacatcatctgagtgaacaatgaccaaggaagacaaaggaggcagagctgtctgtgggaagtgagccagctgtgtgcgcgagtccgggaccacaagggagtgtgctgcctttgccctcacttggtgaccttcctctctggggatgttttagtgagttcttatgttttcaaagaaggttgtggcaatgaaggcttattattaataattttcactattttaaaaatttaggtaatacattgagtatattctcattgtaaaagagtccattgatacagagaggtgaacaagcaaaatgtgaacagacccttgtagccccattcccagcggtcttcccctccccaggtggaaagcctgtcagcagtttgctgtgcctctttctactgtccttgtgtatttatgattccctatcaacagctgtgtggacacacgtgtgtggctcatactttatttatttttttttagagacagagtctcgctctgtcacccaggctggagtgcaggggcgcagtctcagctcactgcaacctctgcctcctggtttcaagcgattctcctgcctcagcttcccaagactacatgtgcacgccaccatgcctggctaatttttgtattttcagtagagacggggtttcaccatgttgaccaggctggtctcaaactcctgacctcaagtgatcctcccgcctcgggctccgaaagtgctgggattacaggtgtgagccaccacgcccggcccattttatttttttttctcattcacatgcaattgacctatatttattcttatgaaatttgctttttttcatttaatgggttttctacctcattgttttgtcaacttcagttttttattacagaaaaatattgacaaaagtgcaaaatcatgaggtatggctcagtgaaccctcaccaagggaatacacttgtgtacctggtgaycacttcaggaaacagaatagcaccagctcctagaaggcccttgtgccctttgccagtaactacctcctgtctccacccccaagggctccgcataattccataggatggatgtataataatgtatttaaccatgagtgtttattggttggtttcctatgaccataaacaatcatacacgaaatgttttgagctccctgttagcttagacattcactgctggccccagtatacagggatcttggagtttagtaataaatggtaaattttccttgcatatttcctactcagataaacaacgggatactattgagcgttcgcctcctttcctactggctttattatctttttttttttttttttgagccggagtttcgctcttgttgcccaggctggagtgcaatggtgcagtctcggctcactgcaacctccacctcctgggttcaagtgattctcttgcctcagcctcctgagtacctgggattaaaagcatgcgccaccacacccggctaattttgcatttttagtagagatgtggtttctctatgttggtcaggctggtctcaaactcccgacctcaggtgatccacctgcctcggcctcccgaagtgctgggattacaggtgtgagccaccacgcccggtctagtatctatcttaatcaaaccgagagttctgaaatttcttcataaactagatctctattgctgtttttctggtttattttttgttttgagtcttgctctgtcactcaggctggagtgcagtggcgtgatctcagctcactgcagcctctgcctcagcctcccgagtggctaggattataggtgcctgccaccacatctggctaattttttgtatgtttagtagagatggggtttggccatgttggccaggttggtcttgaactcctgacctcaagtgatccgcccgccttggcctcccaaagtgctgggattacaagmatgagccactgctcctggctcatttttctagttctgatctctattccttcctgcacaaaggcctcaaataatgaactgtaggatgtgtctaactccagctgtttcagttctaagtgtaccctcctgattacaggcttttttgcccctgccctaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaaggtacatacagccagctgtctggtctacagcaagggctttcgaatcaggaaaacaagggcttcaagtctggctgtaggacttggtacatatatgaccttgagtaagtcatttaatccctttgagccttaatttttgtttgtgaaatggggataatataccctcctcctgggcttgttgtgatgatcacatgggatgttcatgtctagcccagtgcctagcatatggtaagtaagcaacagatgttagctcttatttttttgactttttttttgtttgtttgtttcctgtgacagagtcttgctctgttgcccaggctggagtgcagtgatgcagtcatggctcactgcagcttcgtcctcctgggcttatgcaatcctttcacctcagtctcccaagtaattggaaccacaggcacatgtcatgctaattttttaaaaacggctgggcttggtggctcatgccagtaatcccagcattttgagaggtcgaggtgggtggattacttgagtccaggagtttgaggccagcttgggcaacatggctgaaaccttgtctttaccacccccmaaaaaaaaaaacaaaaaaaacaattagctgggcatggtggtgcatgcctgtggtctcagctactcgggaggctgaggtaggaggatcacctgagcctggggaggttgaggctacagtgagctgcaattgtgccgctgcactccagcctgggtgacagagtgagaccctgtctccaaacaaacaaaaaaaattttttttaaattttttatttttgtagaagatagagatcaacctaggaaacatagtaaaaccctgtcttcaaaaaaaaatttttttttaattttttrtttttatattgacagggtctcactatgttgcctaggttggtctctatctcctggcctcaagcagttctcttaccttagcctcccaaagtgttgaggttagagacttgagccactgcgcctagcccagctcttattactagtggtagtactgatagagcattctggggttaaaccatagtcgagccatcagaaactccatctctgtgatccaacactctagttagtgttaaagagagggagattaaggtgactagtgggctgcaaaactgttatgggagagaatgtaatgatagtagtaatgcacattaattacaccctctggtacagcagagactgaattggagggggtgtcatagaatagagatcacggaacttgacggtaaagctggatcactaagcatgagccagtgcaacacagtgcaagcctctagtttgactgttaagacttggctctgccgtggcctagctgttcatctcttaggctgcctgagcttcaattttccccagtataatggggataatagcaccaacgtcagaggattgttttgaagattaatgataacatgtaaagtgattagaatagtgcctgccacatacttaacattattattagtgctattgactctttttttttttttttgagacagggtcttgccatgttgcccaggctggagtgcagtggtgtgatcacagctcactgcagctttgacctcccgggcttaagcagtcctcccatctcagcctcctaagcagctgggacaacaggtgcatgtcaccatggcttattttcttttctttcttttctttttttttgagatggagtcttgctctttcaccaggctggagtgcagtggcacgatcttggctcactgcaacctccacgtcccaggttcaagagattctcctgcctcagcctcccgagtagctgggactacaagcgcgcaccaccatgcccagctaaattttgtatttttagagatggggtttcaccatgttggccaggatggtcttgatctcttgatctcgtgatctgcccgccttggcctccctaagtgctgggattacaggcgggagccaccgtgcccaggcacttattttattttctttagagatggggtcttgctgtgttgttcagattggtcttaaactcctgggctcaagcaatcctcccatcttggcctcccaaagtgttaggattacaggcatgagccaccgcacccggccagcagcaagcagtttttgagtgctagctggatgcaggcactcatttagacactgggatataaaatgggcaaaayagacaaaacttcctgacctcgtgaggctttcatcatagttgggtgaggctaataataaagaaaataaataggtaaattagatagtatattagaaagtgaccagttctatagagaaaaataaagccgggaagagggaaagcaggtacagtgtaagtcgggtggctaaggaggggcttagtgagaaagtggcacggagtgagtggacttgagtgaggaagtgagttgtgtgggtagctgcggggagagccttccagagagaaaagtcaaagtgctcctggtatgtgtgagaaacagcaaagaagaccaggtaactagaagatgatgagtgaggaggcatgtcaggcctgctgagggcagagggcaacagggccagatcacaggccaccaccgtggccttcactttggagcacggtgaagagccactgggaagttttcagcagaggagtgacatcagtgactgagattccacaggctcatttgacctagattagactgtagaggggtgaggaggaaagcagaccatttaggctgtggggtcatccaggtgctgatggtggctggagctgggctggtagcatggaggtgggaaggagggatcaggttctgggtacttttgaaggtagagccaagagcaggtatatgtgtgttacagagaaaggagtcaaggataactcgaggctttaggtctgagccactgatgtatggagtcgtgactggctggggaggagagaggagcagattttaggcaggagttagaacagttcagcttgggccatgttaagtttcagatgaaacatctgagaaaagatactgagataatttcttagtgaagtctggagttcaaaggagtatctggtttggatatatacattgggcattgccaacatccataaatggtgttcaagccatgagattggcttgagatcaccacgagggtaagtgtgacggaaatgctcaaggcttgagagctttctgatgtgttccaccatgaagaaactggggagatgtggaagaacctccaaaagagactgagaaggagaggccagtaaagtagaaggagtgctgggcagggatgttctggaagccaggtgagaaaatgtcgcaaggaggtagtgatcacctgcgtcacgtggtactagtgggtcaagtaagttgagggccaagacttagccactggatttagcgatggggagggsggtggtgaccctcagaagaaaaatatcactgcagcatttgtccctaggtcaatgagtgggcagacctggattttgtcttgggttaccatttgctatctgtgacttgaaaagctgcttaactactttgggacttttctgcaaaatgtggaccataatagctactctgcaagactgtttaagggattagataaaatacaaggtacctggcatggcacccagtacccaatgcacataaaacaagtgcagtgatgagaaattccaaacaggaagctcttttcaccagaaaccctgattcctctgccaggctggagagctccaggttggtctcacagcacaggaatggagtgtgtgatgagtyrtcgtggttctaagggaggttttctctctctctccagagcctgaaccccaacctgctggccgtrgtgacagagagcacagacgcgcaccatgagcgcacctttattggcatyttcctcrttgatggcgtcactgggcgtatcattcactcctctgtgcagaagaaagccaaaggccctgtccatatcgtgcattcagagaactgggtggtggtaagcggtcactaccagggacccarggtagctccagaggtctccctgcctcctgagtcctttccagaaacccagttgctgctttggttttcttaggatctcaaattccctggatggcagcaaagcgtgcyggttagggcactgggctcaggaatcagattgcctaggtttaatcttacctcttccgtttcctgactgtataaccttgaactagttatgtacacgctctgtgttgcatcattgttaaaatagggataataacagtcaccttcagtctagcaaagaacaatgcctggcacctagtaatgattcaaaggttagctactattatggcttctaagactcttgagaatttcctttgttttgtggtgaactttcgatagcctagataaaactactttgaaagttagtaaacttgatagtaaggaagaaaagtgaggtgctagttgatggttctccttcatggatctgtagctaattagaggggtgccttccagtgcaatttccctttccagttgaagcagctgctaagccctgagctgccacstcctatccctgcagtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgagtgagtgactggggagcctctgggatggctgggttcccttgggcaaccacacttaaggacagagcaagggacacattgctggcagagccttgttgaaccacctgtaagggaaaggtggtgaggagggctatatatcrgtggaaaaagtttcttagttcatctttgccacctatgaaggtgaccacttctctctcagttctcatcttttttttgtttttcgagacagggtctcactctgtcatccaggctggagtgcagtggtgtgatcatgactcactgcagcctcaacctcctgagctcacctggctaattaaaaaaattttttttggtagagacagggatttgccatgttgcccaggctgatctagactcctgggctcatgtgatcctcctgccttggcctcctgaagtgttgggattacaggtgtgagccatcgtgcctggctgcctggccttcagtcctcatttctgatataccacctctctatttggcattttcacctagctcaaaaagtcagttcctgatagcattgttaacatagctagcctgtgctgacagcttgcagaaactggcagggtctattgcccaggctggagtgcagtggcacgatcttggctcactgcaacctccgcctcctgggttcaagtgatcctcctcctcagcctcccaagtagttaacaggcgtgcaccaccacgcccggctaatttttgtatttttagtagagatggggtttcgccatgttggccaggctggtcttgaactcctgacctcaagtgatccgcctgccttggcctcccaaagtgttgggattatatgtgtgagccactgcgccagccctaaaatctcatccttatgtaacctaagcccaggacttaggacttagtggttaacaggttcctgtgtttagttgattttaccgaagatgtttgggactctcagatctgatgggcacttggcattgctgttgcttttttttttttttttttgagacagagtcttgctctgtcacccaggctggagtgcagtggtgcgatctcagctcactgcaacttcagcctccctggttcaagtgattctcctgcctcagtctgctgagtagctgggactacaggtgcgtgccactgtgcccagctcatttttaaatttttggtagagacggagtttcaccatgttggccaggatggtctcaatctcctgaccttgtgatccacacctgcctcggcctcccaaagtgctgggattacaggtgtgagccgccgcgactggcctattgaattcttaaatatgaagaagccagccctgttggcagtttatcagctttaatcaccattactgaaactggtgctatgattgatcatgcctggtcctccagtcttccctggccactgtaccgcagctgcatgaacagctgcgtttgctcaatgggaaggagacttcctgctgggggaggtatgggagggaggccccggggagaggcatgaggaaatccaagtggccttctacatttttctctttcatcattatccatatcttgattctagaactttattttctggtgtctcagaaagttaagaaaccagtgtcttcaaaagtgagaaccttcattcagacccatgcgtatcattggattattatttttggctatgtaagggagcctcattgasccatttttttgttttaaattcttatttaaatgtctgcaataatgacatttttgtaactggcccttgctggacactggatcggtgtgaacattcacttcctcctgtgtagttggactaccttctggagcaattctttcccttcctaaggctttgctggatccccgccgccccgagatcccaacagaacaaagcaggtgagaccctcatgggcagtgctgaaggctctgaccttacataacttaacctcactgattaagcttggttcttggtctctgtgtgccttcatgctgtgctaggggctggggatgtagcagggggcaagtctgaaaaagtcacctgccctcatggagcttacagtctgctgggaaatggacaataaatacataagataaacaagtaaaatatatactatgttaggtactcaaatgctaagcagagtaaaacaggaatgagctaggaagtggggatggggatgtgcgtgggtgtaatttgagaggtggcctgggaaagcccctttgagaaggtgcattttgagtgaaggcctgaaggaggtgaaggagctagctgtgtagatacctgaggaagaactttctaggcagagggaacaggcaatgcaaatcccctgagatcatgtctggtgagtttgcggagggcaacgctaggaaatgagatcactgaggtaattcgggccagaccatgtgggcaagccaatatcttattcactgttggtattgttgtattaacaaccaccatcttgtcgggttttcttacctccatcctgaatttctttgcctaggggcatgaggaatggagaggagtgtgttttggagaagtatatgagagagaggaggttaaagctaggaaaagacacaggatgataatcaggtttcagagaaatggggactgagaggcaccctggagtggagagcaggaattagcttagtggttcagtgtgttggctttaaaatggtcggctttcctcttgtggtgtgaagtgccagtcatctgtatgttctttcttttcagatttagaacaaagtaggaatctagatctcagtcttactctccagagagcttcctttcttgtagtccttcctaacattcagctgctaaatttttaactacctaatgcaagcagacctcctaggagatttgaggctagatatgtagcctggaaacctcccaggactcaggaagggcagccaagagatccctttacagcagtgctcagactgcctgtcccggctggtgttttgcagagaggagaacttaatcccgtattctccagatgtacagatacacgcagagcgattcatcaactataaccagacagtttctcgaatgcgaggtatctacacagctccctcgggtctggagtccacttgtttrgtgagtagagcccacagctgccctatttcacccttggtggatcattggttgtttctttcctaattcttattccatctgccttccaggttgtggcctatggtttggacatttaccaaactcgagtctacccatccaagcagtttgacgttctgaaggatgactatgactaygtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccmctgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagacagaatctcactctgttgcccaggctggagtgcagtggcacgatcttggctcacggcaacctccacctcacaagcagctgggactataggcatgtgccaccacgctcagctaattttttgtatttttagtagagacggggtttcattgtgttggccaggctggtctcgaactcctggcctcaagtgatctgctggccttggcctcccaaagtgctgggattacaggtgtgagccaccgagcttggccaagtgcttaaaatagttaatgctaatgccacagtccaatttaaatcttttcttagttctcaactttccttaatcttaaagcagcattcggttctgagcagctacactcagtctccactaatggctgctgagactatgtttcctctctcaattctctgatctatttgctttcttgtcattccttgttttttgtgtgtattccttgacttacctcttctcctgtcttcattaattaggttaattttggggccccatggtgtttcacgtaaaaagatttggctgggcgtgatggctcatgcctataatcccagcactttgggaggccatagtggaggatctcttgagcccaggagttccagaccagcctgggcaacatagcaagactctatctacaaaaaataaaaaaaaattagccgggcctggtggcatgtgcctgtggtcctagctactcaggaggctgaggtaggaggatcacttgagcctgggaggtcgaggctgcagtgagccatgaacatgctactgcattccagcctgggcaacagagtgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtaagccgagatcatgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaacccttaggaactttgtcctcagtttcccaaatttctaagacttcggtgacttagtaaaggatttttttcctttttttgagacagagtctcattctgtctcccaggctggagtgcagtgccttgatctcgactcactgcagtttccacctcccgggttcaagaaatcctcctgcctcagccttccgagtagctgggactccaggagtgtgctaccacacccaactaatttttgtatttttagtaaagacagggtttcaccatgttggccaggctggtctcgaactcctgacttcaggtggtctgcctgtgtggcctcccagagtgctgagattataggcgtgagccaccgtgcctggccccaataattcttttttttttttttttttttttttgagacagagtctcactctgttgcccaggctggagtgcagtggcgcaatctcggctcaccacaacctctgcctccctggttcaagcgattctcctgcctcagcctcccgagtagctggggctcaggcgtgcgccaccatgcccggctaatttttgtatatttatggaaatgccaagagatagttcaatctgcctctctggcaagccatggacaccaggtctgacaaactctcttactccttaagacaaatgctcacctgatcaatatggggaaataagctgcatggtaccataatttctattctaaaagggaaaagtatctctttggtattgctttggaaaacattctttataactatcttgctatttaaaaattgacaattatccttccataattaaaacaggtagacaacatcctgtgctctttcatttttttgtaaaatgtaacaaactattcagcattcttgaagcaacctttcaataatggagatactggtgcttcatatcaatcagctgttttgattttgtggctaagttctttattttaaaaagactatgtaagtaaaaaaaattttttaacaatatccccaaattaaggtgagtgttgccttcaaaacctcccccaccatgtttcccagaggtcaccactgaacaatttggtatctctccaggtaatacaatcttctgcagcttggttttatcacttagtctatcgtggagagtgcctatgtgagaggtaatggatctacaccattcttagtggtcacacggttgaaattcttaagtgctgttccattagagatttttatgagactcaatactctttcgggaaagtctaatatttaggtcacctttccagtaagaaatttgtaacataaaggatgtgtacacacccaccttcccatttttttttaggaatcagagtgtgaagttagttgagactgacctccaacgaagaagcctgttttccaccagcactaaggcttttatatatttctgatccaagaaggtgacttttgcaggatagagactaagaacatttagcaaagtgtgtttgtaaaatagccaaaggtttatattgaagcaccctcttctctgtcccctaatgtgcaatctgaatgaatggaagtcaagaaagcaaactaaaactataattaaaaggcacaattactcatacaaactccattatacctcatggtttgttcacatcatggctttgatgatatcatatatcccatgtgctgtgataaaataagaactagactagatcaatcaaccagaggccagtttattgatgataatgaatgaagactgcaattgcaaagagggctaaaatactcatgctgctggaatatatatccgctcctataaaaaaggtgatataagttaaaatgctattataagtttgcttggttgttacggagttaggagatgtgatatcttactcatgctttttactataggcacataccttccaaggagaccagaacagtccctctctgcaccctgaccccccatgtccccaccccaaacagtgctaaagggtacacacagtgtaatcatttggctccacttttcccagagtttacatataaactactttccttctgttaagtatctggcatacagtaggctctctctgtcatcatactctgtacctaattataaagcaaatggatgataaagtatttataaattttttcttttgacttttgacaacacaatttcagacttacagaaaagttgcaatagtacaaataattcccagatcccctctacccagatcccccaaaggttaacattttaccacatttgatttatccttctccttctgtctgtctctctctctggctctcaatctgataggtcaaaacttttgagagtgtaaatcttaaagtgacattgtattctagtccctccacagctagcaaaattgtttttttcgctcttaaagcaagaaggctgcaataagcattttcttcttttaagttcatgccaggtgaattgttcagtatcatgggaaaaataatacttgtgggttacaaataatgtctcataattctaaattgaattaggcttctaatctaattccttatattcttggtaatttgaaaactaagtctgttgtgaattaccaaaaaggagctgctctccatttgaagttttcagtattgcagtaggagtttcaacaaaatatgcactgattacttgttcttgtaactttgtaaaagcttgagaacagattgacctctgttggctcctacggggtaacagctaaggtttattcatttacttgtttctagaaacactgtatctattaggatttattccaagcaactctgtattagatggcttaaaagaaaaaagagatgtgctatctaccacttttgaagctctgtagtgaggcacactgacctcatttgtttttagattgctgtacaatttacaaccaccaaagtgtgcaaatcataagtacaaatcatggcttagtgactactgtgtgtgtatatccatgtaagcataactgtgtcaaggtatagaacttttccagctcccagcaggcctcctcatcactacctctacacaaatctttaaaccataccattcatcaatgtctgccatttttacttcattgaattccctgtaacatgactgtatcatgtcttttatcattttaaatttcagttccttggcagacacttgggattagaatggaacaagtattttaagtccttcagttaattcataaaagttatttattgttttttagtttctatcttatttcctggaccagaatattagaagcttgtgtttcatctagaagtcttttattagtctcttttgtcatctaaatttataacatagatgccattccaaatctttgtggcaacacaagaccaaacctccagtactgaaataaatgtggcatttataaaggaagttctttatctggagtgctctctcccaatctattaaccagaaatataaagtatataataaataatttaggtaaaggtgaaaatctccctgtgatagtttgcatttgccttttattctcctggagagggaagggaggacagcagatacatttgatcttttatttcctgaaatttctccaagacagcttttgcagattaattttgtcctctggttaaaataaaattcatgtcccaaagccattataaaattctgggtctccagcctttccttagggctctggttcagtatcttgaaatactgcaatatttatagtgttatggaaagttctttttcatttctgatgtttttatgtttaagaaacttgctgttattattatcctctggtaagtaggcactgaaggaaaatccctactgctgtcatcaaagccacattttcctccaagaccggctttgacttgactgaattttatttcgaatgtaaagatgcaggctgggcgcagtgggtcaagcctgtaatcccagcactttgggagtccaaggtgggaggaacctaggacttcgaaaacagcttgggctacgtaggga

SEQ ID NO: 12419 - DNA, 19924 bp, Homo sapiens
gccatgatcatgcctctgcactccaccctgggtgacagagtaagaccttgttgctaaaaaaatgaataaattgggcaggtgcagtggctcatgcctgtaatcccaatgtcttgggaggccgaggcaggtggatcacttgagcctaggagtttgagaccagcctgggcaacatagtgaaaccccgtctctacaaagaatacaaaaaaaaaaaaaattagccaggtgtggtggcatgcacctgtggtcccagctacttgggaggttgacgtgggagaatcacctgagcctgggaagtcaagactgcaatgagctgtgattgcaccactgtgcagcctaggtgacagagtgagaccctgtctcaaaataaataaataaaataaaataaaggctaatatatatgtatagatatgtatatgtatttttttatgtgtaggtatatatacacatatatatacacatacttcatttttttttatcaggccccattctcatcattcagagcttgctctttggttttcactaaagcaaatccaggggaactaatttcagaagatcactgaccactgactattaaaatatataaatgaagtgtatggtaatgagactggctgtccataaacacattacaacttatcatccaaatgagtgctgtcatttcaagatagtcattcaagaagcttttagctttgttttaatgaggacactgctcaaaacaacaagaatctccttcagagtctataacacacaatgcaatgaatattcattatctgcaggtggattggatttatgcaaatagccaaaagaactcaggccaacactgatgagtaaatggggtgggaaatctggatggttaatgtgtttcaaaattttttggatttttgaaagatagtatggtgcatatacaaaatataaagcaacaatcccaatgcatcaggacagcacccagtaatcaaacaaattaatatttctggaatgacacatatgacttcatactgtggtaagtgaaagatggaaaagtgaaaactataaataaccttatgtaagtttaggtcaggttctgccacaaaataaattcagttcagattaggttttattgtcaaatatgttatgaaaaagattttgtttttgtttttgagacggagttttgcttttatcgcccaggccagagtgcaatggcgtgatctcagcttgctgcaacttctgcttcccaggttcaagcgattctcatgcctccacctcccgagtagctgggattacaggcgcccgccaccacgcccagttaatttttgttttcttctgttttgttttgttttgttttgttttgagaccgagtctcactctgtcacccaggctggagtgcgatggcgcgatctcggctcactgcaacttctgcttcccaggttcaagcgattctcgtgcctccacctcccgagtagctgggattacaggcatgcgccaccacgcccaggtaatttttgtatttttagtagagacggggtttcgctatgttggccggcttgtcttggactcctgacctcaggtgatccacccacctcagcctcccaaagtgctgagattaagggcataaaccacagtacccggtcaagcttttggttttcataatttttttaaatttaggaattgtggataaaggatttgcaggccacgaatatttgatgaaggctattccagagttttgagaaggaacactccattccacatactcmgtcacccaagctaggagcctgagagtcaccctaaaccctcattctctcctctcaacccctcagccaatcaatcaagtcctgtcgatcttattttctatattttgaatctgttctttccccccatgccagtgccttgccatctttcaactgagagggtccttcagtatttttcaagctgaccttcctactgtttttgcagccataaatccttcctccactctgctcctaagtgcagatctgaccatgccatgagtctttgtttccagagtctttatggttccagtaacaccacaggatgaagtccaacatccttagtatgatctaaaactcagaggcaaagacacaaataactataataatgttattcaatgtttgtcaccaatctgtaatgaaacaatttcagaaattaagtgtaagcatttagaaagttttataggaatttgacagagaaattttatatttattgaatctaacaaaatggtagtttattttgttttttgaataattcatttttagtgcattctacaaaagtagtggacaataatagattggaaatgttttaaaaattggtccttaaccatactttgaaaagcactggtccaaaatatttttaatgtaatgtacctgtacacctccctaggctcgtttctaaccagctccacccaccacccagcaataatgaacaaccttttatagtttctgaaacatatcactctgtttcatacctccacctccatggaaatgcactttctggcctctctgacttgacttcccttcctcctagaatttttgtttttgtttttgttttttgtttttgagactcactttttgctctgtggtgcagggatgcagtggcgccatcaaggctcactgcagccttcaacttctgggctcaaatgttcctcccacctcagcctcctgaagtgctatgattacaggtgtgagccaccgccctggccactcctggaaatctcatactgactgcatcatcacctcctttggatgcctgtctaaaccaaggcccctcacaactccaagcagaacagatcactcaccctcttatacttctgtcattgttgtacccatattattgcactatgttgtaattattcgtttataggtctatttcccctattagtctgtgagctccttaaaggcagtggttaggattatctgtctttcaggagtgaaacatttcttgtaaaataactaacttgaaggacaacattccttagatgataaattctgccatgttactgaaagagaaaaaagggatcattactttatacttttctattaccagccaggacttcggcctactacctttagcatctgagtgtgaattaatttaccagaatggtggacattttagaaggccaaggagccagatttgtgggactcactggaaactttacaagggaaagagatatggaaaacaaatgtcttcacttaaacagttttgcccaggctcagcccctttgggagtaaaatctgtgtcatgtgccctttcaaagttgcacaggcctgtgaataggatcaatttattcatttcagagggtccaccagataacaggcctatcctggagaggtcctggatttcggctgaaacaagcaactataattggaaatgtgtacaaagagcaatgaggaggccaccgaggggtgggaggaattaattctgcctggaggagtggaaggggtccaggaaggagagggtgagccaaaccttgctgagtgagtcggatctggcccagtggagacgttgggggaggagtgagcagagcaatctgctagatgaaaatctacacgtgcgcgtagggacgacagtctctgcactcctcttccgcccactttcctccctttcctcgcaatcgtttccccttttcttggaaaactaggactgaggatactgtttcccttcacggaggagaccagcacagataaaagaatattaatcctttttatcacgagatcagttcctctggtctgtctttgagagcactggggatggggagagcaggtgagtcaggcacagaagtggtccttctttgagtgagccaaggggacacaggggagaacaggtcccatgcaggaaacaaatgaaaatttttgtatttgtccccactccctttttgtcaccactcccccccmcmcacacacacacctgtctctttatgtttttctatagtttcccatggtctccgtctttgtctttgcctctttccctttgctacaggctggaaattccttgttctcaacggaagggagtaggaggggagttgggggtggcaggagtgggcgggaagaacagacatctcggcagctctggctgcgggctgcgggggcgctctgggcctctggcgggccctgacaagtcaatgattttttaaataggggctcatacacaaacctagagagagagaggaacacagatatacaagtggatataaagaaacatataaatacataatctcgggtacagagacacaaactggcagtagcgtcttaaatatgcttagcattctacaatttagagagttttcccgtacattctctcatccgaatctcacgacaatcttgagaaacaagggcacaaagacacaaacacccggtagtttcactctcacacacgggttcgcacccggacccccgctggctcccctaggggagtgggcaggccccttctgcggaatttctcttccctcgtccctctctggccgagcaccccctctcccaggacccgggagcggagagctcaaaatcggctcctccctccccctctttcccggatcaggaccgggacccgggcgccccgcgcccagtaggttgccgctcacttgctcacgccctactccgcctcctccttgggcgggcgtctccctccagatcctaaggctcagcgccgccccaagggggccggggtgggagggaggggggcgcctcgagcagaggctgcgtgggcggaggatgtgcgtcacggggagcgtgggctgggggagggagggggcacgtggaaacccggggccagcggctggcagcccgggatccaaaataacctgaggtggggggggaggggtcgcccacaccccgtacggggtcgggagcgtccccaggggagcccgtctagccgcaccctccagttgcggggcgggggactgggagacgggactctgctcgttcccaccacccccactgtgtttggcgcttaataggttggagaagaggacctgagcaactgaaatcctcccaccaacaacgcgctccttctccccggaccccacaaggcggaaaggtctcctcgctaggccacattgtaaaaccagccccggtccacggcctccacgccccgccatgccccaccccagcccctcagaagtgcggacagagaggcggggcggggctgagattccggactaggggaaacctcacctgtggccagtccgctcgctttccccggcccccaccccccctcctttccctggggcttagagtctatgggccgggcccttagagcccccgcctcccccaacagccctcccagccgtgggcgggagtgcaatgcgaaccagatggggctaggagaaaccaaagggggagacggtggtgggttgcagaggcgggggctaagctccttcaaggcgctcctccttccagctccgccgcaggaagtcacgtcgtaggctcccgacctcttactcatcttccactagactctcgggcgaggtccctaatagacggccccaggaagggtatcgtctttgtcacacaaaattcccaggcagggcctcatcctcagcaaacagaggacaagtggaggaatccctgcctgacctacgcgctgacaaaagccgacgcgtctaatcaacacgcgcacctaagtggtggcgtgcagcataaccctcccattcctgtttcccaaactttccaggctagcatggaggcctgggtttctgagagcgaccccctcagattattccattggggctgaggaggggcgcggggatatctaggagatccctgcagagccccacgctctcaggcccgccttaagtgcacactatacgggagtcagatgcacgcacaggagaagccgcacagcccagccttcgctaacttttcccggctcactgctaacattcacacgtccagcaccacaaggcctgagtatgggcaacgggcgtccccgtagttgtttaggcgcgtgtgcacgtccgtgcgcttctgtgtctttgtgtacttgtgcgtggttgtgaaactcctctctcagctcggaggggtgggggagagaaggaatgtcgccggcggggcgctcacgtgggtacgtgggcgccaagagggccggctgtgcatccggcgtgggcggcacagaacgacctcgccccgcccgctgggtccccaagcccgccctgcacagccgggcctcggtcacctcggtccccaattcggcgccccggctctgaatccccgcccccgcctcctgctccacaccccctccccccccgtctccgcctctcccagtctctaagccgcggcgtctccgcggccgagaggccccagcgcccgcctccccggcccccgcccccacccccgcccccggctctgcccacgccctccgcccgccagcccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagttagtgggcaaagggaggcagcggggagtggagatgggtggagctggacttgggaatggggtccagagggcggaggtcgaggggaggacgtggggaagsaggacgggggtggggggtggagactgatggaaaagggggtgcgtcttcgaattagggggccctgggagcaggcaagcatctgatgaagctggatatgaaagagtagtacccaaatctccattcctggtttactctgtgggctccatctggcctaagagccccctgcaaagaatgtgggagcctccaagcaccaggggatgccctggagctcgagctggcatcagtgcggaaggtggggggacgctcagttgcctcagtccctcgttggcacggagcgcgcgggcccccggtgcctttgagttaaaggagcatcagcgggggaaagggggggtgacgagggaggcagggaggccttaggcgttccttcccatatctgtccctttattcacagagcggggaggggagtttcagtgtgcagccccttcatcaagaggccttgagccgctcccccactccacttgaagatgcgggtggaaaatatgggagaggagagtaggcgggagcccctgggcggttttcgcctacagacgctaccactgtgggagtgtgtgtgggcggaacggccccggagcagaacaattgcgcccctccccctgccacggcccctgagctgaaggaaaaggctgaccgaggaagtggggagtgtcactgctaggagaggggccactgaggagcactgggcagcctggaagggtggagaggttctgaggggagagaggaagcgtgcgttaagaatgcttaaccaggccgggcgggcccggtggctcaggcctgtaatcccagcactttgggaggctgaggcgggtggatcacgaggtcaggaattcgagcccagcctgaccaacatggtgaaaccccgtttctactaaaaatacaaaaattagccgggcatggtggcgggcgcctgtaatctcagctactcaggaggctgaggcaggagaatcgcttgaacccgggaggcggaggttgcagtgacagcgccactgcactccagcctgggtgacagagcgagactccgtctcaaataaataaataaataaataaataaataaatgcttaacccctgggaaaagctgagcggagaagagtaaggcaccacctggctcactgagtgggaaagccagggaaggtgccacaccctcccttttagccacctggggctgtggccccttcacagggaatgaagctggccagcagcgtccactgtgggggagactgggctcctacattcactttagtatgggtgacttcacttcagtgttgagactgctgagtgwktagaggggaaggtgaggattgtgttttgggggagagggaggtccagccatcccaggtcggtgctggtcagcctcagcgctcaagttcttcttgccccagaccaaaaagataaaagctgaagataaggttgtaagacgcttcgactcctacagacacaggccactgacttttggggcttcgggccagtctaggacggcactggcttgtccatgcctctgagcagtgcctgattctgagagtctgtactcagacctgggcactgggcaggatagcatccaaatgagggaggggaagaaaagcaggcaggaaagagggaacaattgttagtgtgggttggtacccagtagggggacttgcaccgactgcctctctcttgtgcccctccttctcaggcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccscccttctcccccyctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgaggtgagaacccccaggcytcctaggattgcccttgacttccaggtctccagccgcttacctctgcgagtttctacagtctccractatctttcattatctcttgaccaggaccccaggccctgatcccctccccaacaggcccctaccccagcggccgcagtgcttccatcctcagctgagggggaagcagagatacaggcagcaccgagctgttcagctccttgtcactcaggaccccacaggagaggaggmggccccgggcattcctaggaagctgtgggtgctgacctctgtcttcccacctcagaaagctcccatgtagtgtcaaaaccaaagcaagcgtctgatggatgggcctcatttgtccaatggtgaaggggtgtgaggaggtctggtgaggcagcggggaagttcgaattctgactctcctggctgccctccctccacagctcaccatcaacgaggctgctgcccagttctgcatgagggacaacacrctcttattacggagagtggagctcttctctttgtcccgccaagtagcccgagagagcacctacttgtcctccttgaagggctccaggtgagaccccttccccaggtccttcctggactggaatcctgctatggagttagatcatgtcctaaccttcagctcaggcagctctaggcctgcttcccgcccacctggatgtcctgcttttggccaagtcagcttgtctcaggtctggtctctcctcccatccatgtcgggtccccccaaccccctacaacaatagtgcttgaactagagactctttctcggccagcttcttggcaaaggttttaaataacacatgcctctggctgggttctgtgctctgccrgtcgagtggccctcgtcagcctcatccactttattcttacccatcttttcaggcttcaccctgaagaactgggaggccctccactgaagaagctgaaacaagaggtatgttttccggggtgcatataggggcactgggcagccttccccaatcccctcccttggcaggtcttcatttccccatgttgggcatccacaggttggagaacagagtcaccctgaaatccagcagcctcccccaggccctgagtcctatgtacccccataccgccccagcctggaggaggacagcgccagcctgtctggggagagtctggatggacatttgcagggtgagtgtgcctcagaacacttttctcttcattgagggtgggggagtaggggagggggttgggggaggagtgagccaggaggcagtgcctgaaacagggttgggagacctggctggagggggggcagaagggcctgtgggctggctatgtggttgagggtgggggttccattggctgcagccccttacctgaccagtgcccatgcccacagctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcaggtgaggcagccagcagtgctgtccccaagcaccccggccactcaggccccacacagcaattctggtgtcctggggccaggtgggaggaagagggatatagtcgtcagagagggcagtaggatggctgggctccagccagccaggccttggggtgcagagaggcagaccctgccgagctgctcccaccatggaaagtctggtcctagtgtagatctgtraaaggggaactggggaatggggggacagagaaaagaggatgaaggagcaggaaggaggagcatcaataagggaagctcagatggcacttccaccaacccaggagtggggagcaggctaggagttgtgggkatggggatggggatgcccagcttggaagcagaggagcccaaagcagtsatgctttgtgtgtggaagggggaagagggagtgggcmggcggagggccgggcagccgctgggctgagagtgacgcagcagacaaagccaccaaccctggcttggtatttttaaactgtgcgtgggtgggaagtgggggcggggactggaaggggggctcttcttgagggaggagctcggaggctggcttcctgttctccctctgatttggctaccaaaaaacttggggggccatggtagagtggcctgggaggggcctgggagggggccagggatgagtgggggtggcagagcttgggaaggggggaggggagaggtcagagccaaaccacccccgcagctcctgacagaaccagaaattccagcgcaaccgaggaggcgggagagaaagagasagaracagacagagacagagctacgcacagccagggaggggagggggctcacacacatgggaatggaaccccccatacacatgcagtgggcaggaggcagtaattcaataaacctaaactgwgcccatcttcacagctttctttgcccctgcttctgttcccaaccacctctgtctgcagccagtcaccctgcagtctcctaactgcccccttttccctgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggmcctcagacttctggctcmcmcagacccccacgctctccatccccggaatctagtcacmmccctggatccttcctctgcccttctcctgcctccccacctgctccatgggcataagactgtggggcttcaagcaataacaagcagaggcctggagagaggacacaaggagggtgygtggtgccctcacccctgcccagagcgagggggcaaggactctgcctccagggcatctggggttttcccctccctcacacaacasactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggacygcagcacctatytgagcagttagagcgtctttcttttcagattgtgtacagtagattatttattttgttattttggaataaaatttattttatggcttaggatctatgacccctgccttgagagggagaatgggataggggagtgaagggaagctggcggtggatggggcaacagaaaagatgcagcaggcagggccctctcatacactggagggccacatggccaggcctggacccagactctcaccctggctcccaggyagcattggaggtgtggagccatacgtagatgtcacagccacttggacccacttgggcacagtcagactccaaattcagagtatttgggggttagcatatgtcagagaggccagcacacttgctgctgtmttctgtgcagtgtctcaccctcccaaatttgtgttgtcacgtaggcaaaagcagatagacacatgttctatgtggtcatgcaactaaggtgccagctatayatttaacatatcctaggtacatacacgttcacacagctatacacgaagaatctcagccctygtacttttgcatagtctcatacacgtatcagaagcctccacctggctaacaggaatttggggctttgggagattttttaatcagggcaaaacctgtactagtaaccacatgtccagacycctcctatgctcccacccagggtcccttgagctgcttcccattcccctagggctgagacccaatatcctctatccctggcctctagtgtaaatgtgtctgtatgttcctgcctatccgtcctaggccctgggtcagaatgggcggagaagccttccatgccctaacctgtgctcttacccagcccccctcctgctcagccccatcaccctcagagagctctgtatgtgtgtgtgcgtgcgtgtgcgcgctgcaggtgcaggcatgttggggygtgtctcagagcctgaacttcccttccagtcagtgctggaaggaggtgggcaggggaatgatagaaaggaaggagtggattggctccacccactgtgcattctcctgttagtcttttcctcctgacccaggagtaggtggggataggagggcaccctccccatctgctgcttggcagggcatgagcaagtgtccagagcaggtctgtgggggtagtagaagagctgtctctttgggttctccctccagctgggatcaccaactggggttggcccttaggtccatgtgggacattgagatcccagattgcccatagtgggagggctgcaggaggggctgtgcccccaaggaccctccccccgactccccttgcccctccaggagaagcttagtgaggtcctgttcagtgggaggcagcagaggagggaatatgtcttcaccaatcctgcaaggagatgggagaagcagtggagtaggcatggcgcccactcccctagatgccacccagcctccactcccaagctgccactcaccaagtgccctgaggaaacgctgtcactggctggctcaggcagctgtcttccaccatggtcacatctgagcagagcagggggtcagggctggacacagcatgctcctgaggctggcacggcagcaggcccctgccaggaaccagcaatggaaataaggagagcggggcaaggccaggaaagaagaggcacatggggtcaggaggggctttgtcactcactgggggtgaggctggtcaaagggcaggctcatctggcccaggctggggggcatctgcaggtgaggcctggaagtagggagagcacagttagaggaaggcaggctaggcaaatgcagagtggtgcaaagtcaggaccactgagtgaggaaacaagctccagctccttatcctgacttagtcatggcctgggcaagctatttctatgctctgagctcagtcttctcatctgtaaaatgtgcgtgttatgggggtggattagccaatttctaatgtttctttggactctgaactttggtagttcttaagtccccaagtcctcactcccgcctcaccttctgggaagggagatgttgtgtcttgactaagttaataagcacccgagtgtcatacttcgggaagaaaaatgtctaggccatttcaaggccaaaacagatgagtaaacaaaaaccaatacagcagagaagtgacagtggctctcaggggcaggacagaaaataataataacagtcatgcaccacattaacgacatttctgtcaactacagaccacagtggtcccataagattataatcaaggccaggcagagtgactcacgcctgtaatcctaacgctttgggaggccgaggtgggaggatcacttaagcccaggagtttgagaccagcttgggcagtaagtgagaccttgtctgcagaaaaatcttaaaaaagaattagccgagtgtcgtggtgcactacagcaggaggattgctcgagcccaagaggcggaggttgcagggagctaagatcgcaccactgcactccagtgagtgagaccctgtctcaaaaaaaaaaaattataatcaagctgaaaattcctatcacacaaatatttaccattatgttactatttccttatactattcagaacagtatcatgctgctcgggtttaaagctaggatcaataggctacacaatatagcctcagtgtatagtagtctataccatctaggtttgtgtaattatactcaatggtattcgcataattatgaaactgccaaagacagaaaatgctccttcattaagtgatccacgactggacttacacagcttttgctatgagccatgcactatgctcagctttttaagtgttatgaactcatttaatctccacaataatgcagtgaggtaggttattattattagcattattatcccccattgtgcagataaggcaccaaaggctaagtaatttgccccaaaccagtaagtggtggagctagaattcaaacctaggcagtccagatcttaactactaccccctcattagagtggacagaagagaagaagacaggctgttagcatttgctgctcctttctcacagaagagcctcttctaacaattcaaatgcccacccccttagagtgggatggtatccccatgaggtttttcacttactcctggaaggctgacaacacgttgactgattcttctggggagaggccttgatacggggggatggagtgagagtgtggtgggtacacctggggcctggggaaagaaaacagaccccctgatgccagcccttctcctggacaccaccacaccctgcttttgaacaggtgtccctctcatggaaaggaagattccctgttcagcccccagtgccagctctcccagctgcccatgctaagattagcccatctgcacagaccactcccattcctgtctttccagctccttacaccatatctgggccaagctgcatgctcatggaggaatcaggggccattccaaggtcataagaaggcaccatggtaggcatctggagctctggggtaggaagtggttggtccctggaggagggaaggaggtacatgtgactgaccaagggttgatgccacccctccttcctgcagataagcactaagcccctgacctacccactgtccataccaccacactcacctttccacggtcatcttgatggtagctgggacataacccctgccatccttacccatctgttcagctgttgtgagaaggaaaagacagccatggagtgctctggggttagggaggaagggaggtggaaaaggtgggcatggatcatggggaagtaagagaagcacagctatgaaatagggagtgacatcaggatgacacgcgggcagggagaggagggcagcggggagcagggaggaagtgggtgacaggaaggaatcagagctgccagttccagctcacgcttgtagtggctccggaaagcctcatccttgggcttcttgggatagagatttttgagctgagcaagatcccggattcggtcccccagtgagcgaatggacaggtctttggcagagaatggctggatgttctctatctgtggagagcctatggtaggaaggagaccctgagatccctctgtccggactttcttccccttccccaacccctaccataagacctgttctcactccaccaaggcaagggagagaggacctagggtggggctcctgagggagagagacccactagtctccgttcccacagagctcacagtgagaaggtgaacatttagaccacagaaggaagaagagaagctggaagaacttcctgaagatcaggatcggcatcaggaaggtcaggacatttcattcccagaagaaaccccagagggcacaggcacagagacagaggactggctggggtggcctcaccatcctggccccggatgacatgggcaatggtgatgcccccaatctctgagtcgctgaagcggaggagaaaggttccgtcgggctcattgagaagaaggctagtaacgtactgtttgctgatgaagccaatgatcagcctggccgggatgaaggagaggatggggcatgggcagtgagtatggaggtgactggtgtatggctgctcagactacccagggtggggactcaccggtcagaccagtagctccggagacagcgtttggtgaggtccaggacaccatcaaaccactgccaaaaggtgaagccacggcccagcaggatctcctagggggagagggggaaaggtgtgagccgagggagggccagagctggagcctgtttagggcaggcagtgagctgtgagtgccctcacgacagaatcacagggctgaggatcagaccgaacctgagactccatcaatgacaacgaccaatcctaatgcttacacgtgccagccactatttcaagcctttccatatatttatttgctctttaccaggctatggaagtagggattataataattccatcttacagatgaagaaatggaagtccaaaaacgtcgaatgacttgcccaggtctacatagctggtaagaggcagagctaggatttaaacccaggcattctggccctggagcccctcttaactactatgctacaccctctccctaaggaggtgtggcagaggtgacgcccaaaggaaggtaacctgctgggtgtgactgtcttgctccctttagctaacacaccctctggtcacatgagcatttctttcttctctttaaagattctgtctcacacaaaagaaagaaaaagagagaaagagaaagagaaagaaagaaagaaagaaagaaagaaagaaagaaagaaagaaagaaagaaagaaagaaagagaaagaaagaaagaaagaaagaaagaaagaaagaaagaaagaaagaaaagaaaaaaaaaccaaaacataaaataacataatataacataaaataaaagagcaagagtcagaaatatgtggttctctcctagccatggcactcacctgctttgggaacttgaacaaactacataaccctctgagcatcagattcctcatctgtaaaatggggataataatagtatctacctcaaagagatgttgggaggattaagtgagataacatacataaggtgttaagcacagcgcctggcatataagctgtcaacacgtggtagctggtattactgcacatgtccctgtgggattttgttcagtttttgcaacaggaattctttttctttctttctttctttctttttttttttagacagaatctcattctgttggcaggctggagtgcagtggcacaatcttggctcgctgcaacctctgcctcccaggttcaagtgattctcctgcctcagcctcccgagtagttgggactacaggcatgcgccaccatgcccaggtaatttttgtatttttagtagagacggggtttcaccatgttggtcaggatggtctcgatctcttgaccttgtgatccgcccgcctcagcctcccaaagtgctgggattacaggtgtgagccaccacacctagccttttttttttttttttttgatacagagtcttgcccaggctggagtgcaatggtttcatcttccctgcagcctctacctcctgggttcacctcctgcctcagccgagtagctgggattacagacgcaaacgaccactcctggctatttttttgtttttagtagagacggggttttgccatgttggccaggctggtctcgaactcctgacctcaggtgatctatccgtctcggcctcccaaagtgctgggattacaggcatgaaccaccatgcctggcctttttttttttttttttttgagacagagtcttgctctgtcacccaggcttgagtgcagtggtatgatctcagctcactgcaacctccacctcctgggttcaagcaattctcctgcgtcagcctcccatgtagctgggattacaggcatgtgccaccgcaactggctaatttttgtatttttagtagagatggagtttcaccatgttggccaggctggtctcaaactcctgacctcaggtgatccacccaccccggcatgtcaaagactgggattacaggcatgagccgctgtgcccggccaggaactatttttccaacaggtcaaagtcactttgaatcagagctctgtttacacacaacctgggtgagtcatgcaagtcactggtaaagaggaaggacagatggcccccagaccaaaacctcagggatgtcagagaacgcatctccagagccaacccccaggcctggggtttttcctccctggtccatgacaggccttcctaaaggacctgagggggcactgtggagaatccagtggaaggtccctgcatggaggctgagcaggccctgagtgccccagggatgaagagcttgggggtgggaggtccaaagggcaggagaatgaccttgttgaactgcgaccaggacacagaacggtgctggaaggcctccatactgaggctgttgtcattgaagatcttctgggccaggaagaggaagtgctctgggagcagcccccggttggtccccacctcagccatgaacttcaggttcagagtttcacacatcttctcccagggcacccgctcagccaccacaaagggcacgcggtcctggggagaagggggaagaagagagcactgcaggctaccgtcttgttattcctcgggccggccttcatccctcccacctgcctgt

SEQ ID NO: 12420 - DNA, 30832 bp, Homo sapiens
ggaatagaaatactgtgattggctatgccaattagattcaccccgtgaatacataggagggggacacctgtgtgaaatccagactttgctagcaagggagaaaagcttggctgctgaataggcaccaccagtgcttgcctcagtagtcacatcaaattcctcttcctttaagagccaactatttcaccttccattgggatgtgcaacatagggcttaagggcaacatttctggtgccaaactaactggatttgaatcccagctctctcaccttagccttgagcaagttgctgagttttccatgccagtttcctcatttgtaaaatgagggttatcagcactatccaatagaattttctgtgatgatggaaatgccccgtgtctgttttaatatagtagccacaagtcatacatggctattgcacatttgaaatgtggctgatacatcagaggcattgaattttaaaattgaaatagccacaagtggttagtagctactgtagtgggcacatagttctagctcatagtattattgtaggataaaaagtacagtgcttcaattttagagtaagaattgaagtaacacataaagccccactaagtgttagttattatttttgctgttatccactgatgtcctggtcactttatccgtgaagtctttgtttattttattttattttaatttttttgagacaggctctcactctgttgcccaggctggagtgcagtggtgcaattatggctcactgcagccttgacatcctgggctcagggatcctcccacctcagcctccccagtggctggaactataggcatgcaccaccacaccaggctaatttttgtattttttcgagagacggcatttcaccatgttgcccaggctggtctcaaactcctggcctcaagcagtctgcccacctcagcctcccagagtgctgggattacaggcatgagccaccacgcctggccttctgtgaagactttagcagctgactgtcttcctgtccacctcaagttttccacaaacccagatggtttcagtgctccggcaggtagtccagccaacaccctggcctcttggttccttgttctctttgactccaatgacttacctctgtgttgctgtagccactcactctcatagccaccacctttatcacacccttgcaggagagctggactgaaatctcactccctagattctgaccgcaacatcctagccttacagctcttctttcccttgcccccgggaagcctggtctttaagtctgttgagacttccagtttcttgcctttctttcctttgacactggcccctcatgtcttcacttttcttcctaaccagtctccattccacaatgcttcacctctgctcttcaactgtgtcgtctccctctctgttgttattaaccttctgaatggatctcctggcttcagaacttatcttttaaatccatcctccacattgcagctaggctgatccctctactaaatcttatcatatgactcacctgtctaaatcttctaatgctccgcattgcccattactacccattcccagaaggtrccatgctcccacaggtatccatgcctttgcatatgctagaccttcttcctgctttaatgctttccttgttctttgcctgaataattcttatgtcccttcaagattcatttcaggctgggcacggtggctcacgcctgtaatcccraaactttgggaggtcgaggcaggargatcacttgagttcaggagtttgagagcctggacaacatattgagaccctgttctatgagagagagagagagaggagagagagagagaggagagagagaaggattcgaacatgctttatgctgaaagtatagagctgtcataactacagagcaggagggtggagatttgaagaatgaaggggataataaattgaacaagtgcctgaagaggcagaagggaggggccttgagcacaggtgttttctaattaaatgatgagttggtatgaagatggatggaaacttgaggagaatagtgaaggcctgggagatagagctggctaggggccctcagcagcttcccacaattcttttgtgacctcctcctcctttccctcatcctccacaaatcacagtccactattcagtgttcttgaactgtcttgtctgtgaaatgtactgagctccagcaatcaatccatcaatcagtttagtccttacgtaggagagtatgtataaaacatttagcccagcaccaagtacatgggagacactcagttaattgcagcccttcatatctttaccaccaagaatgcatgttgttttttctagctgctgcacagcagtgtgtacagtatgatatgagtccttgccctccttgaacttgtgttattgttgaggaagaaagatgtacccacaaaataattaaaaagcaatacaaaggaatatgtagtggccaccagtacccaaattgtgcttctgttattattattattattattatttttgagacaaaccctcactctgttgctggagtgcagtggtgtgatcctggctcactgtaacctccacctcctgggtttaagcaattctcgtgcctcagcctcccaagtagctgggactacagggcagtgccaccacacctggctaatttttgtatttttagagacggggtttcaccatgttggccaagctgatctcgaactccttacctcaggtgatctgcccaccttggcctcccaaagtgctgggattacaggcgtgagccaccatgcatggctgtgctttttttttttttccccacaaccagcactaaaaagtatgttttatcatgacttagaattcagatacatatagggccgggagtggtggctcatggctgtaatcccagcactttgggaggctgaggtgggtggatcacctgaggccaagagtttgagagcagcctgaccaatatggtgtctctactaaaaatacaaaaattagctgggtgtcatggcatgtgcctgtagtcccagctactggggaagctgagacaggagaattgcttgaacccaggaggcagaagttgcagtgagccgagatcccgccactgtactccagcctgggcgacagagggagactccatctcaaataaaaaaaaaaaaaaaagaattcagatacatatataaagctgaaacaaaagtttaattaaacaatacttatccttacttcgcttgatgccttctgatattttctgtactgttctattctacttcagttttattttttaattttattcactttattttttattttttgagatggagtctcactctgttgcccaggctggagtgcaggggtgtaatctcagctcactgcagcctctgcctcccggattccagtgattttcctgcttcagattcccaggtagctgggattgcaggcacatgccactgtgcccagataattttttgtattttttagtagagacggggcttcaccatgttggccaggctggtcttgaactcctaacctcagatgatccgcacacctcggcctcccaaagtgctaggattacaggcatgagcctctgcgcctggcctttacttcagtttcaaagagtgaaggtcaagacactgtttttttttatgttttgtttttaattttgttttaaattttttttgtagagatgggatcttgctatgttgcccaggctggtctcgaactcctggcctccagcaatcctcctgcctcagcctcccagagtattgggattacaggtgtgagccattgtgcttgatcaagatgctgttatgggctgagttgtgttcctcaaaaattctcttgaagtcctaatctcaagtacttcaggacgtgaccttattttgaaggacccccttatagggtctttacagaggtaattaagttaaaatgaggccattaggatggggcctaatgcaatatgactggtatccttgaaaaaaggggaaacttggagactgacttgcatacaaagagaacagtgtgtgaacgtgaaaatggccaaggagggaggcctggaatagagccttccttcacatccctgagaaggaatcaatcaatcctgctcaggttaaccttgatcttggacttctagcctccagcatcttgagagatttctgttgtttaagtcatgcaatatgtagtactttgttacagcagccctagcaaactgatacactcaccaaatcgattttgtgactcactattgggttgtaaccagcagtacatagacataaagttattttttccttacgctttatcttgtgcaatcgtgtgtgtgtgtgtgtgtgtgtgtgtgtgtgtgtgtgtgtgtgtgacggagtcttgttctgtcaccaggctggagtgcagtggcttgatctcggctcactataatctctgccttccagattcaagtgatttccctgcctcagcctcctgagtagctgggactacaggcgcgcaccaccacgcccgactaattttttgtatttttagtagagacggggtttcaccatgttggccaggatggtctcaatctcctgaccttgtgatctgcctgcctcagcctcccaaagtgctgggattacaggcgtgagcctctcttgtgcaatctttaccaccactcaatgggatgtcaaggtccaggggagggtgatacagtcaccctcacagtcatgcaggtgcagatgtcattaatgaaggtctgacagaccctgcaattgtacaatctgaagatgagtatctccttaaatttcatactctaggcactttaccctagcctagactctgttgaagtaggtataactattattctcatttgagggattgacacctgattgtgaacctcctaaatggagtcatacccaagccagatttgcctctaaattctgttttttccccttacatcacagtgttcccattggtatagtcagttacagagggagtaatatatactatttttctaccagtacttgctcctcgccttcctaccccctaaaaggagccaaagtcagagatcacatttactcttttccctcctcctctccaagtctttggggacttgtagctctgacacccttagatggtgaaacctggcttcacctactgtctgtggatgtctgcaggcagagtgggcactcgggagcacatacaaagcacgtgtgccgtgaacacgtatgtgcacacaccttgatcctagcatggcttgttggacaagccaatggacagagtccctgcctgccacctccacccctgctctcccttctcttccattcactgtcctgcagacacagcaaacacatacgcacatacaccctcaatatccttttggcagtaacatgacccccaaatctggggacttctatgtaggatggagacccttctcctttcctcatacctggtttattatgaaccataaaaatagtgcctgacagttactgtgtgtcaggcattgttctaagccttcagatgttttactgcattttattctcacattatgggttaagacttatttgctccattttacagatgacgagaatgaatcacagagtaaattgctcagggttgtgtggttagcagcattagcaggatttgaacccaagcagcctgtatccacagtccagtcttttaactgctatattttgctgtgttcaaaccctctgctgcctggctgggtccacacacgtgcactcatgcacagacctgcggggtagcaagggatggaggaggaggagctggttctggaaatcaattcaggcaccagggggcagcataggcctagctttggcccctcagcccagcccctgctatgggagggaggaggggagtagaaacttcctcccaccgcccctcagacaccacctcttccacacaccggggctctcaggtgtccgggagtaaaggcctctctggatcccttggtctcctccagctcctcccccagcaaaaactgcagaaccctccactagttatgttgatgactcagaagttgagcaagactgtgtgtgtgtgtgtgtgtgtgtgtgtgtgtgtgtgtgtgtgtgtgtgtgtggtgttgtgattgcaatgggctctgtttgtgagcctgcctgcacgtgtgtgtgtgtgtgtgtgtgtgtgtgtgtgtagtcttgtggtcagggaagttgtgcatgtgtgtgtttgtttcttggcgtgtctcagtgtttaccccagaaacatataggaacttggcagataggaacacagcagattcgtattcaaacttgccccttgtgaatctgcaggsagcagctccggcttgtgctggttcccaccacagtctcaggaggggtgccctgtgaggagagagcaaagaccagcttcagtccaagggactcctagagtcttccagaattctgagctgagggttyccctcccccactccctcccgtcagtggtcacgagaccgacctctaaggcgttccctgccggaagggagggggacctaggagttggctggcatcgagctccctggcggctttttagggtcctccactggagggagcgcagagtccagagggatttacttttcctgaggccctggrgagcccagtcccttgtgggtccaaaccccagcccttggcagastttgagtttgggagccaggcagttaggggtggcaaatctctgtttgatattgggtgactttctggagaaaagctgatgcttttgagggggacagagtaagtgggggtcagcctccccccaagcctggctccaaggcctggaccccagtcctgatcccccacgtgttcccccactcggcacaggaggcacacatattcaccccactttcttcctcttcctcctccagcccactttctcttctctgtgtcgtcagagctccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtgktggaaggggggaggtgctagcagggccagccttgaactcgctggacagagctacagacctatggggcctggaagtgcccgctgagaaagggagaagacagcasaggggttgccgaggtgaggggttgcctccgaggtgggtgcgggggcctctatgagtgcatgggggtggattcgtggggggagctctcgggatcctcccctggctgggtggatggtccccaagagatggtttcagctagtgttggtggctggtggcactgggttttagcagtttcgaactcctggaggaatctgggagggtccaggcctcagtactcccctcccccatgggtcacgttttcacagcctcacccctgcacccccagggccatggaaagtcagggaaaggaggtgaaggagtgcccctctgccctgagtcgggggaagtggccgcccctccctggaaggttgatsscagagggcagtggatccttgttaaacccctatcctgccctccactaaaggttcctgttcaagggtgtggctggggcgtgagcaagccccagatgtagacctcatggtggcccagacgagggggaatttccccctcaaaactgctccacgcttggctsstgtagacgctgagatttcccagcggcggcgccgarttaaccctcctcgtgctgaactggctccacctccccgcctgcccccaccgccacattcacgcattgggcaactcagagaagmtgttttaactttcgatcctgtggtcccacaatcagaggactcgggcagataggggttgagataagcgagtttaggccaccaagcgggcggacgaggatcccagaccttgcgcttcccttctgagtttgggaggtaacactggccccgcccctcacgccgtggctcctccctcccttccccttcaaggggctgaagacaaaaggtgcccctgtcctggtcaagccaatcgacccagccttgttatgggttggggtggggaraaatgwgtcctcctgatggctggggaagaagaggggttggatatttctagccagggccatgccaggaggctggtcactctgcaaggggatgcagaggaaagcggwgcccactcactccagaggacctttctctcttgggctagagaaaggcctattggaggaacctgagcaggaggggtaaggattctgccttgaggagaaaagagctggggtaagtgggcactggaggaaagaggggcatgaaggtcttggagcagaaacrtccagagaagggacctctccattttccatccctctgagaggcctgggagaggtgagaggctgaacgtgcaacaggaggacttggggttactgggtttggggagacctggggagttgtcatcccatcctctccctcatctctgggagagggatattatgagaaacgtgaactgagaggcccctgggaaaccactggttacccagtcctccctgaacctggaaatggggatgcaaccccctcttctacttccctgtcccctcctctcctttctacctgttttcgtctctcatctttgccttctagccctccagcttcctctctcttctaggctctttcctcctagcttactaaacccgccttttttccagtctcttccatcctcttccttagttctctctactttccttttccacctctcctccttcaagtctcctcccaccttcccccacttcttaggatgatcagatttgcccctggaagggatcctaacaacacagtgcgatggttaatccccactcagattcaaagcctgctttccaaactcacttactgagtggccttgggcagagtagagaaactccttaagcctcagtttcttcatctataaaatgggatattatatattttaaaaagtgtcgtgaggcctgaaggagataatacactgagtgtaatgcctcatacacagtaagtgcttaacaaatagtagctgttattactctcccatcctcttcatcatctagccttgtggttttcatttttattttatttcatttatttatttatttattttgagrcagagtctctctctgtcgcccaggctggagtgcagtggctcgatctctgctcactgcaagctccgccccccaggttcacgccattctgtcacctcagcctccccagtagctgggastacaggcgctcgccaccacgccctgctaattttgtttttgtatttttagtagagatggggtttcactgtgttagccaggatggtcttgatctcctgacctcgtgatctgccygcctcggcctcccaaagcgctgggattacaggcatgagccactgcgcctggccgagccttgtggttttcaaattatctcatggagtcctagaattttgagaggtttgtctagggatgcctttggcgtcaggaggtggggagagggaagtagaagcagtcgagtttcaggctttccatgcttgctttcaacagggcatcttcggtttcgtaccttttatgtaattgagattccacagattaaaagctgacattgcctaccgctttaaaaagtttggaaagttttccactcatctaacactcatattttatagatgagaagatcgaagcccacaaagggaaggctctttgcccacagaaccagagccaggtctagagctgcaactaaatcctctgccactctaagagagctctcgctctactgccctgtctcccyttgcctccccatccctctggctacagctcagctcttcccacccctgtgtctatcactgaaggagttacccccatctcaggcattgactcaggatgcccctggtttaaggtggtctggccatgagtggtggtggggacrgtccctaggagggctatctatgggaggtccctggctgccccaggagataggycaagtttcttgggcacccctcagagtggccttatttttytcctccaggcaacctccaagtcccagatcatgtctctgtggggtctggtctccaagatgcccccagaaaaagtgcagcggctctatgtcgactttccccaacacctgcggcatcttctgggtgactggctggagagccagccctggtgagtcctggctgctccctgctggtcccccaagtcttccctaactcatcttccttctccttagatttttctcccctcacccatggattcagaacttgagacctgttattccatgtgtagtgacctagatttagcagggagtctgtgccccatcaagaccaggctatgaatgttgacagatggagaccccatctcttaggaggctgagccraagaggaggggggtttgggctgggacaaaggcacttctcataacagctagaagactgggaaacaaggcrcatgggtgaaagctacagagggcctagatggagaataaggagcgagaaaggaactgctgagcttttggctgtggggtaaagggtcaggagagctgaggaagccctggcctgargtagcctcatcctgatcttcctgcagggagttcctggtcggctccgacgccttctgctgcaacttggctagtgccctactttcagacactgtccagcaccttcaggcctcggtgggagagcagggggaggggagcaccatcttgcaacacatcagcacccttgaggtggggcaggaggggaggggacaaggctgggtggggctgaggttgaactgggttgagcattgggccctggaagaaaattggttggatgctggaagcaaattggtgttcctgtggttaactgctagctagcaggcaaattagattttaaaagcatgcaaatgcacaaaaacttctggagtctacagttgtgcttccttatagtatatgtgtgaatgcaggcctggggattggagggattgaaggacatgggtaagagcaaagctcactgtttaccaccctcatttctgtagagcatatatcagagggaccccctgaagctggtggccactttcagacaaatacttcaaggagagaaaaaagctgttatggaacaggtattgtgatattccacctcccaccccaactcaatcccctgagactttggcctgagccatgacaaactagaaagaatttgawcctcagwaaaggctcagtgttctaggcccaggaatgaccaaaggaggttcctagggtcagagtgaaccccaagtcaagctcagggaatctttctatgagggactgaaggtaagaggccggggagaacagagcaagggataaggagctgattctgctaggagcaaggtcttatctccacgatattccaaaaggtcaggaagaactgccaaaggggagaggggaacaagaaaacgctatmtgcagagcagagagtggaggccaggtatagagggatgagcagagtgtttsasttcttggcatctgtccttcctgtgtagttccgccacttgccaatgcctttccactggaagcaggaagaactcaagtttaagacaggcttgcggaggctgcagcaccgagtaggggagatccaccttctccgasaagccctgcagaagggggctgaggctggccaaggtgggggccagggtggttctggggagtgtgtargagtggttgcctcttggatctcaaccttatctgaacctctaatctgtctgcacccttgatttctgcccccaaccctcagtgtctctgcacagcttgatagaaactcctgctaatgggactgggccaagtgaggtgagtaatgggctgacaggtggagaccttggtcaaagtgcagctggagggatggaagctagacctcagaaagacacaggctgaagtagggcaagggaatgccagaggagtgagaaaaagagccgtatcccaggagctgggtgtggaggcagcgtgaggccctggctcaggcccctctctgcccataggccctggccakgctactgcaggagaccactggagagctagaggcagccaaagccctagtgctgaagaggatccagatttggaaacggcagcagcagctggcagggaatggcgcaccgtttgaggagagcctggccccactccaggagaggttgggctagggctgatggggaagagggggcaagctgggggtgggcagctgaccctgctgaaggccctacaggtgagagaaagaagccaggcgggagggccttggagtggaccaagwtgcataaaagccagttccagcggggctgtgcacactgtcgttcaggtcgcatcctgtacaagtgggcctagtggaggggcacaagcggggactcatccaacccaggcttctctcctcaagccccatgcctagaggaataggagggcttttccatttggtttattgggtgggaacacttyccaatttgccacaaagcactgtaagtggtggcagttgtcctgggtgcaagarccgtcgggggagaggcagctgggtttccacagggggtgtaggcactgagaatgaacctcccacccasaccctaggccaacagatcacagaacccccttcagcccaggtgccttgcagccacacccactacccaccccacttctccacacatgatagcctttctccctgggtataggggaagggggtctgggccggagcaagcagccttaatcctgtgccccctgaccactgtcctggccccaggtgtgaaagcctggtggacatttattcccagctacagcaggaggtaggggcggctggtggggagcttgagcccaagacccgggcatcgctgactggccggctggatgaagtcctgagaaccctcgtcaccaggtattcccygggagctcccagtctggcctagaacagacctcgggaagaaaagaagggggctagagctgtggggagggcaccagcagggacctagccsccaactccccttgtgtcctcctcactcccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcgtaagctggrattggacctggggttggagaagggctgttagggtgatggaggcagcctggagggctggcactgaaaagagcaagggatggggagggagggccatgggatgtggagaccctgaatggtcaaggcagaggaaagggagggacccatttagggctggaatggggtgggggcatcatgatttggccaagatggggactcctcccttaagaacccaaacagagacatggagatttagggctggtgacagtgggtagtctacactcacccatgcactcgccacacctgacgacagtgagatgagctcgttcacactctgacctcccctggcagagaaagcactggagaaatcatcaacaacactgtgcccttggagaacagcattcctgggaactgctgctctgccctgttcaagaacctggtgaggggctttggggtgcagtgaggggrgcaccactaggagactgtgggactctccttggagaggatgtcaggaagcccaggaggagcggtctctgtcctcatgacctcgcccttgctctccctcaccccacccacagcttctcaagaagatcaagcggtgtgagcggaagggcactgagtctgtcacagaggagaagtgcgctgtgctcttctctgccagcttcacacttggccccggcaaactccccatccagctccaggtgaaccgtggcccagccctgccccaatctgggaccccgagtcctcctccaatgccacrcacaagggccctggaccctcacctcttgtgactgccccataccccatgtgtctgggattcatgcacactggggcccgggtgagtgggggtgagcaagagcatggagtgcacagggcagggaatggtagtggatagcagcaaacacttcggaascacttcctatagaccagggcactctattaaatgatacatacgcacatgcgtgccagcacacacacgtctggttttcacaataacattatgaggtaggcagtattatcagcctcattttatagataaggacattgagacagagagtttaagtagtttgtcccagtcacmcagctaagtgttggagctggtatytgaaacctggargtctggttccatagcgatgactaataaccacttctctayggtgaggccctgattgagcttcagaacgcatttaataacatggcatgagctttttgattatgatgtgtgagtccaataacttctctgagtgctcagagccagtcccctgaggaaacttcttgcttcactaagaaacccctgtccggctgggcatggtggctcaagcctgtaatcccagcactttgggaggccgaggtgggtagatcacaaggtcaggagttcaagaccagcctggccaatatggtgaaaccccgtctccactaaaaatacaaaaattagctgggcgtggtggtgcaggcctgtagtcccagctgctcgggaggctaagcaggagaatcgcttgaacccaggaggcggaggttgcagtgagccaagattgcgccactgcccttcagcctgggcgacagagcaagactatgtctcaaaaacaaaacaaaacaactcagcactttgggaggccaaggtaggaggatcgcttgagcctgcaagtttaagaccagcctgggctacatagggagatccaatctctacaaaaaataaaaaattggccgggcatggtggctcacgcctgtaatcccagcactttgggaggccaaggcgggcggatcatgaggtcaggaaatcgagaccatcctggctaacacggtgaaacctcgtatctactaaaaatacaaaaaattagccaggcatggtggcgggcgcctgagtcccagctactcgggaggctgaagcaggagaatggcgtgaacctgggagggagagcttgcagtgagccaagatcgcgccrctgcactccagcctgagtgacagagcgagactctgtctcaaaaataaataaataaataattagctggattaggtggtacatttctgtagttccagctattcaggaggctgaggtggaaggatcacttgagccctgaaggctgaggctgcagtgagctgagattgcactactgcactccagcctgggcaacagagtgagatactatctaaaaaaaaaaaaaaaaaaaaaaaaaaaaaaaaaaaaaaaaaaaaaaaaaggaaagaaagaaagaaaagaaacccctgtcctcaccctcttcaggccctgtctctgcccctggtggtcatcgtccatggcaaccaagacaacaatgccaaagccactatcctgtgggacaatgccttctctgagatggtgaggaaagtcctggagttggagggaacaggggcagggtgggttctaacatgggcagtggtgcaggcctgctgatggggtggtgggcatgtttaaatgggtgtgaccttaacactttctcatgggcctgctttcgtgcttctgacctcttttcaccccagtcttaacaactatcaggccacagcactgtaacctagaaaaaacagcatgtttrtgagcgatatcaggggctgtggaggggtaggccacaggcaggtgggagggatgaaggccggcccgaggaataacaagacrgtagcctgcagtgctctcttcttcccccttctccccaggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggtcattctcctgccctttggacctcccacccccaagctcttcatccctggggcactcagggcctgctcagcctccatgcagggaccttccactggattctccacagtgccccctcagrtcctttaggaaggcctgtcatggaccagggaggaaaaaccccaggcctgggggttggctctggagatgcgttctctgacatccctgaggttttggtctgggggccatctgtccttcctctttaccagtgacttgcatgactcacccaggttgtgtgtaaacagagctctgattcaaagtgactttgacctgttggaaaaatagttcctggccgggcacagcggctcatgcctgtaatcccagtctttgacatgccggggtgggtggatcacctgaggtcaggagtttgagaccagcctggccaacatggtgaaactccatctctactaaaaatacaaaaattagccagttgcggtggcacatgcctgtaatcccagctacatgggaggctgacgcaggagaattgcttgaacccaggaggtggaggttgcagtgagctgagatcataccactgcactcaagcctgggtgacagagcaagactctgtctcaaaaaaaaaaaaaaaaaaaggccaggcatggtggttcatgcctgtaatcccagcactttgggaggccgagacggatagatcacctgaggtcaggagttcgagaccagcctggccaacatggcaaaaccccgtctctactaaaaacaaaaaaatagccaggagtggtcgtttgcgtctgtaatcccagctactcggctgaggcaggaggtgaacccaggaggtagaggctgcagggaagatgaaaccattgcactccagcctgggcaagactctgtatcaaaaaaaaaaaaaaaaaaggctaggtgtggtggctcacacctgtaatcccagcactttgggaggctgaggcgggcggatcacaaggtcaagagatcgagaccatcctgaccaacatggtgaaaccccgtctctactaaaaatacaaaaattacctgggcatggtggcgcatgcctgtagtcccaactactcgggaggctgaggcaggagaatcacttgaacctgggaggcagaggttgcagcgagccaagattgtgccactgcactccagcctgccaacagaatgagattctgtctaaaaaaaaaaagaaagaaagaaagaaagaaaaagaattcctgttgcaaaaactgaacaaaatcccacagggacatgtgcagtaataccagctaccacgtgttgacagcttatatgccaggcgctgtgcttaacaccttatgtatgttatctcacttaatcctcccaacatctctttgaggtagatactattattatccccattttacagatgaggaatctgatgctcagagggttatgtagtttgttcaagttcccaaagcaggtgagtgccatggctaggagagaaccacatatttctgactcttgctcttttattttatgttatattatgttattttatgttttggtttttttttcttttctttctttctttctttctttctttctttctttctttctttctttctctttctttctttctttctttctttctttctttctttctttctttctttctttctttctttctctttctctttctctctttttctttcttttgtgtgagacagaatctttaaagagaagaaagaaatgctcatgtgaccagagggtgtgttagctaaagggagcaagacagtcacacccagcaggttaccttcctttgggcgtcacctctgccacacctccttagggagagggtgtagcatagtagttaagaggggctccagggccagaatgcctgggtttaaatcctagctctgcctcttaccagctatgtagacctgggcaagtcattcgacgtttttggacttccatttcttcatctgtaagatggaattattataatccctacttcyatagcctggtaaagagcaaataaatatatggaaaggcttgaaatagtggctggcacgtgtaagcattaggattggtcgttgtcattgatggagtctcaggttcggtctgatcctcagccctgtgattctgtcgtgagggcactcacagctcactgcctgccctaaacaggctccagctctggccctccctsggctcacacctttccccctctccccctaggagatcctgctgggccgtggcttcaccttttggcagtggtttgatggtgtcctggacctcaccaaacgctgtctccggagctactggtctgaccggtgagtccccaccctgggtagtctgagcagccatacaccagtcacctccatmctcactgcccatgccccatcctctccttcatcccggccaggctgatcattggcttcatcagcaaacagtacgttactagccttcttctcaatgagcccgacggaacctttctcctccgcttcagygactcagagattgggggcatcaccattgcccatgtcatccggggccaggatggtgaggccmccccagccagtcctctgtctctgtgcctgtgccctctggggtttcttctgggaatgaaatgtcctgaccttcctgatgccgatcctgatcttcaggaagttcttccagcttctcttcttccttctgtggtctaaatgttcaccttctcactgtgagctctgtgggaacggagactagtgggtctctctccctcaggagccccaccctaggtcctctctcccttgccttggtggagtgagaacaggtcttatggtaggggttggggaaggggaagaaagtccggacagagggatctcagggtctccttcctaccataggctctccacagatagagaacatccagccattctctgccaaagacctgtccattcgctcactgggggaccgaatccgggatcttgctcagctcaaaaatctctatcccaagaagcccaaggatgaggctttccggagccactacaagcgtgagctggaactggcagctctgattccttcctgtcacccacttcctccctgctccccrctgccctcctctccctgcccgygtgtcatcctgatgtcactccctatttcatagctgtgcttctcttacttccccatgatccatgcccaccttttccacctcccttcctccctaaccccagagcactccatggctgtcttttccttctcacaacagctgaacagatgggtaaggatggcaggggttatgtcccagctaccatcaagatgaccgtggaaaggtgagtgtggtggtatggacagtgggtaggtcaggggcttagtgcttatctgyaggaaggaggggtggcatcaacccttggtcagtcacatgtacctccttccctcctccagggaccaaccacttcctaccccagagctccagatgcctaccatggtgccttcttatgaccttggaatggcccctgattcctccatgagcatgcagcttggcccagatatggtgtaaggagctggaaagacaggaatgggagtggtctgtgcagatgggctaatcttagcatgggcagctgggagagctggcactgggggctgaacagggaatcttcctttccatgagagggacacctgttcaaaagcagggtgtggtggtgtccaggagaagggctggcatcagggggtctgttttctttccccaggccccaggtgtacccaccacactctcactccatccccccgtatcaaggcctctccccagaagaatcagtcaaygtgttgtcagccttccaggagtaagtgaaaaacctcatggggataccatcccactctaagggggtgggcatttgaattgttagaagaggctcttctgtgagaaaggagcagcaaatgctaacagcctgtcttcttctcttctgtccactctaatgagggggtagtagttaagatctggactgcctaggtttgaattctagctccaccayttactggtttggggcaaattacttagcctttggtgccttatctgcacaatgggggataataatgctaataataataacctacctcactgcattattgtggagattaaatgagttcataacacttaaaaagctgagcatagtgcatggctcatagcaaaagctgtgtaagtccagtcgtggatcacttaatgaaggagcattttctgtctttggcagtttcataattatgcgaataycattgagtataattacacaamcctagatggtatagactactatacactgaggctatattgtgtagcctattgatcctagctttaaacccgagcagcatgatactgttctgaatagtataaggaaatagtaacataatggtaaatatttgtgtgataggaattttcagcttgattataattttttttttttgagacagggtctcactcactggagtgcagtggtgcgatcttagctccctgcaacctccgcctcttgggctcgagcaatcctcctgytgtagtgcaccacgacactcggctaattcttttttaagatttttctgcagacaaggtctcacttactgcccaagctggtctcaaactcctgggcttaagtgatcctcccacctcggcctcccaaagcgttaggattacaggcgtgagtcactctgcctggccttgattataatcttatgggaccactgtggtctgtagttgacagaaatgtcgttaatgtggtgcatgactgttattattattttctgtcctgcccctgagagccactgtcacttctctgctgtattggtttttgtttactcatctgttttggccttgaaatggcctagacattttkcttcccgaagtatgacactcgggtgcttattaacttagtcaagacacaacatctcccttcccagaaggtgaggcgggagtgaggacttggggacttaagaactaccaaagttcagagtccaaagaaacattagaaattggctaatccacccccataacacgcacattttacagatgagaagactgagctcagagcatagaaatagcttgcccaggccatgactaagtcaggataaggagctggagcttgtttcctcactcagtggtcctgactttgcaccactctgcatttgcctagcctgccttcctctaactgtgctctccctacttccaggcctcacctgcagatgccccccagcctgggccagatgagcctgccctttgaccagcctcacccccagtgagtgacaaagcccctcctgaccccatgtgcctcttctttcctggccttgccccgctctccttatttccattgctggttcctggcaggggcctgctgccgtgccagcctcaggagcatgctgtgtccagccctgaccccctgctctgctcagatgtgaccatggtggaagacagctgcctgagccagccagtgacagcgtttcctcagggcacttggtgagtggcagcttgggagtggaggctgggtggcatctaggggagtgggcgccatgcctactccactgcttctcccatctccttgcaggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacytaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacrccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggrgtctggacatgtggttactagtacaggttttgccctgattaaaaaatctcccaaagccccaaattcctgttagccaggtggaggcttctgatacgtgtatgagactatgcaaaagtacragggctgagattcttcgtgtatagctgtgtgaacgtgtatgtacctaggatatgttaaatrtatagctggcaccttagttgcatgaccacatagaacatgtgtctatctgcttttgcctacgtgacaacacaaatttgggagggtgagacactgcacagaakacagcagcaagtgtgctggcctctctgacatatgctaacccccaaatactctgaatttggagtctgactgtgcccaagtgggtccaagtggctgtgacatctacgtatggctccacacctccaatgctrcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgctcarataggtgctgcrgtccagcccccagctggaggagaccctgagtccaacccaggcctcccgagggggccagtgaagggatcccacacccaccgcccctatgtagggcagggaagaaattgcaaaggacttgggggatagatgggaatgggagggcaaactgcagcacttgttaaattaattaaagaaacaaaccagaagcacaaaaacggggaaggagaggggagaaggagcaggtccagtgttcccaggcccccaattctgggggcaaatgttgccacttttagctggaccttcccagggaagtccccctttcccccttgtccaaactgagtccaactgctcacaccactggtgcaaacctaaagagaatgggagtstgttgtgtgagggaggggaaaaccccagatgccctggaggcagagtccttgccccctcgctctgggcaggggtgagggcaccacrcaccctccttgtgtcctctctccaggcctctgcttgttattgcttgaagccccacagtcttatgcccatggagcaggtggggaggcaggagaagggcagaggaaggatccagggkkgtgactagattccggggatggagagcgtgggggtctgkgkgagccagaagtctgaggkcctgggtctgaagacaccagtccaaccctcactgccggctggcctcagcctccactttcacgctgctcctgcgaccctccaccagcgcgggatggggtcctggggcaggacatctgtccagcagcccttcctcgaactctgcagggaaaagggggcagttaggagactgcagggtgactggctgcagacagaggtggttgggaacagaagcaggggcaaagaaagctgtgaagatgggcwcagtttaggtttattgaattactgcctcctgcccactgcatgtgtatggggggttccattcccatgtgtgtgagccccctcccctccctggctgtgcgtagctctgtctctgtctgtytctstctctttctctcccgcctcctcggttgcgctggaatttctggttctgtcaggagctgcgggggtggtttggctctgacctctcccctccccccttcccaagctctgccacccccactcatccctggccccctcccaggcccctcccaggccactctaccatggccccccaagttttttggtagccaaatcagagggagaacaggaagccagcctccgagctcctccctcaagaagagccccccttccagtccccgcccccacttcccacccacgcacagtttaaaaataccaagccagggttggtggctttgtctgctgcgtcactctcagcccagcggctgcccggccctccgcckgcccactccctcttcccccttccacacacaaagcatsactgctttgggctcctctgcttccaagctgggcatccccatccccatmcccacaactcctagcctgctccccactcctgggttggtggaagtgccatctgagcttcccttattgatgctcctccttcctgctccttcatcctcttttctctgtccccccattccccagttcccctttyacagatctacactaggaccagactttccatggtgggagcagctcggcagggtctgcctctctgcaccccaaggcctggctggctggagcccagccatcctactgccctctctgacgactatatccctcttcctcccacctggccccaggacaccagaattgctgtgtggggcctgagtggccggggtgcttggggacagcactgctggctgcctcacctgcgagaggtggcttcgcaggcacacaggggctgaggcggcccacgcggtcgtgggagacgaggcgggcgagccgcagcccctcgtccatcagtgtctgctgcaggatgtgtcggctccatagcccatgggctggcaatgccagaggcaggtcagcagggggcggcgtcagccttggacatgaccccacagctgtgggcatgggcactggtcaggtaaggggctgcagccaatggaacccccaccctcaaccacatagccagcccacaggcccttctgccccccctccagccaggtctcccaaccctgtttcaggcactgcctcctggctcactcctcccccaaccccctcccctactcccccaccctcaatgaagagaaaagtgttctgaggcacactcaccctgcaaatgtccatccagactctccccagacaggctggcgctgtcctcctccaggctggggcggtatgggggtacataggactcagggcctgggggaggctgctggatttcagggtgactctgttctccaacctgtggatgcccaacatggggaaatgaagacctgccaagggaggggattggggaaggctgcccagtgcccctatatgcaccccggaaaacatacctcttgtttcagcttcttcagtggagggcctcccagttcttcagggtgaagcctgaaaagatgggtaagaataaagtggatgaggctgacgagggccactcgactggcagagcacagaacccagccagaggcatgtgttatttaaaacctttgccaagaagctggccgagaaagagtctctagttcaagcactattgttgtagggggttggggggacccgacatggatgggaggagagaccagacctgagacaagctgacttggccaaaagcaggacatccaggtgggcgggaagcaggcctagagctgcctgagctgaaggttaggacatgatctaactccatagcaggattccagtccaggaaggacctggggaaggggtctcacctggagcccttcaaggaggacaagtaggtgctctctcgggctacttggcgggacaaagagaagagctccactctccgtaataagagygtgttgtccctcatgcagaactgggcagcagcctcgttgatggtgagctgtggagggagggcagccaggagagtcagaattcgaacttccccgctgcctcaccagacctcctcacaccccttcaccattggacaaatgaggcccatccatcagacgcttgctttggttttgacactacatgggagctttctgaggtgggaagacagaggtcagcacccacagcttcctaggaatgcccggggcctcctcctctcctgtggggtcctgagtgacaaggagctgaacagctcggtgctgcctgtatctctgcttccccctcagctgaggatggaagcactgcggccgctggggtaggggcctgttggggaggggatcagggcctggggtcctggtcaagagataatgaaagatagtcggagactgtagaaactcgcagaggtaagcggctggagacctggaagtcaagggcaatcctaggaggcctgggggttctcacctcgtgcaggctgagctgcttgccctcccgccgcttagagtcgaaacggccatagatgatgctgtatttgcggatctcctcttccttctggctgtcattatcatccatctcaaagatgtgcccaacgctccgtgccagcttcttattcagctttagcagggatgtgacctccccagcatccccccttgggaagctccggaagatcctctccacactttccaccaccatgcgtaccatctctggctccagtcggtctggaccacccccagtcccacctgctgccagccccccagccccagtcccctcagggactcctccccctgcagrgggggagaagggsggcgagccagcctcctcttctcctcctgccccaacgtccgactctggagtgctccggcctggccagatccgggggtcccctgccccaggtcccccaggcagtggtgatagcttctctccaagttcaagggggctcttggggctaaaactgcgggcactgcctgccttttcccctgggctgccatgcccattgctcatgctccctttccgggtacccgcagtctcagagatcttgaagagcgggatgctggagacgggaacagcaggcactggttgactgaagagccctggattggtggcccactctctcagtgccttctgcaggcgccggacatggaggggcttggtggccatgcccacaagtgccatgatctccagaaactcctcctcacccgcctcacacagctgctgcacgtcgtcccctccctgctggatgaaggtctcatagtaggaaaggaggttggcgcgctgcaggacccggtacagctgcagctcccccagcgtccgaggcagtgccatggctcgggcactgggcctgagaaggaggggcacaagagagaggcagtcggtgcaagtccccctactgggtaccaacccacactaacaattgttccctctttcctgcctgcttttcttcccctccctcatttggatgctatcctgcccagtgcccaggtctgagtacagactctcagaatcaggcactgctcagaggcatggacaagccagtgccgtcctagactggcccgaagccccaaaagtcagtggcctgtgtctgtaggagtcgaagcgtcttacaaccttatcttcagcttttatctttttggtctggggcaagaagaacttgagcgctgaggctgaccagcaccgacctgggatggctggacctccctctcccccaaaacacaatcctcaccttcccctctaaacactcagcagtctcaacactgaagtgaagtcacccatactaaagtgaatgtaggagcccagtctcccccacagtggacgctgctggccagcttcattccctgtgaaggggccacagccccaggtggctaaaagggagggtgtggcaccttccctggctttcccactcagtgagccaggtggtgccttactcttctccgctcagcttttcccaggggttaagcatttatttatttatttatttatttatttatttgagacggagtctcgctctgtcacccaggctggagtgcagtggcgctgtcactgcaacctccgcctcccgggttcaagcgattctcctgcctcagcctcctgagtagctgagattacaggcgcccgccaccatgcccggctaatttttgtatttttagtagaaacggggtttcaccatgttggtcaggctgggctcgaattcctgacctcgtgatccacccgcctcagcctcccaaagtgctgggattacaggcctgagccaccgggcccgcccggcctggttaagcattcttaacgcacgcttcctctctcccctcagaacctctccacccttccaggctgcccagtgctcctcagtggcccctctcctagcagtgacactccccacttcctcggtcagccttttccttcagctcaggggccgtggcagggggaggggcgcaattgttctgctccggggccgttccgcccacacacactcccacagtggtagcgtctgtaggcgaaaaccgcccaggggctcccgcctactctcctctcccatattttccacccgcatcttcaagtggagtgggggagcggctcaaggcctcttgatgaaggggctgcacactgaaactcccctccccgctctgtgaataaagggacagatatgggaaggaacgcctaaggcctccctgcctccctcgtcaccccccctttcccccgctgatgctcctttaactcaaaggcaccgggggcccgcgcgctccgtgccaacgagggactgaggcaactgagcgtccccccaccttccgcactgatgccagctcgagctccagggcatcccctggtgcttggaggctcccacattctttgcagggggctcttaggccagatggagcccacagagtaaaccaggaatggagatttgggtactactctttcatatccagcttcatcagatgcttgcctgctcccagggccccctaattcgaagacgcacccccttttccatcagtctccaccccccacccccgtcctscttccccacgtcctcccctcgacctccgccctctggaccccattcccaagtccagctccacccatctccactccccgctgcctccctttgcccactaacttgagtctgggctgcagggtccggcgggcgctgtcccctccgcccggcggctgctcggctgtgggggaaggcgctctgtgcatggacggccggagatcacccgggctgcccttctcggtgcccggcgctcggcgcctgctgcgtgctgccctcttccccgcgcacgatgccgtgtccaccgctgtccaggctctgtccctccctccacgtcttctctctccgagcctccgcgcctctgtctgtgcctctgcccccccaccctccccggctgcgcttgccgcctctccgcgcctccgcccccgcaggacgcacagggagcgaggcccggagctgcgctggctgccgggctggcgggcggagggcgtgggcagagccgggggcgggggtgggggcgggggccggggaggcgggcgctggggcctctcggccgcggagacgccgcggcttagagactgggagaggcggagacggggggggagggggtgtggagcaggaggcgggggcggggattcagagccggggcgccgaattggggaccgaggtgaccgaggcccggctgtgcagggcgggcttggggacccagcgggcggggcgaggtcgttctgtgccgcccacgccggatgcacagccggccctcttggcgcccacgtacccacgtgagcgccccgccggcgacattccttctctcccccacccctccgagctgagagaggagtttcacaaccacgcacaagtacacaaagacacagaagcgcacggasgtgcacacgcgcctaaacaactacggggacgcccgttgcccatactcaggccttgtggtgctggacgtgtgaatgttagcagtgagccgggaaaagttagcgaaggctgggctgtgcggcttctcctgtgcgtgcatctgactcccgtatagtgtgcacttaaggcgggcctgagagcgtggggctctgcagggatctcctagatatccccgcgcccctcctcagccccaatggaataatctgagggggtcgctctcagaaacccaggcctccatgctagcctggaaagtttgggaaacaggaatgggagggttatgctgcacgccaccacttaggtgcgcgtgttgattagacgcgtcggcttttgtcagcgcgtaggtcaggcagggattcctccacttgtcctctgtttgctgaggatgaggccctgcctgggaattttgtgtgacaaagacgatacccttcctggggccgtctattagggacctcgcccgagagtctagtggaagatgagtaagaggtcgggagcctacgacgtgacttcctgcggcggagctggaaggaggagcgccttgaaggagcttagcccccgcctctgcaacccaccaccgtctccccctttggtttctcctagccccatctggttcgcattgcactcccgcccacggctgggagggctgttgggggaggcgggggctctaagggcccggcccatagactctaagccccagggaaaggagggggggtgggggccggggaaagcgagcggactggccacaggtgaggtttcccctagtccggaatctcagccccgccccgcctctctgtccgcacttctgaggggctggggtggggcatggcggggcgtggaggccgtggaccrgggctggttttacaatgtggcctagcgaggagacctttccgccttgtggggtccggggagaaggagcgcgttgttggtgggaggatttcagttgctcaggtcctcttctccaacctattaagcgccaaacacagtgggggtggtgggaacgagcagagtcccgtctcccagtcccccgccccgcaactggagggtgcggctagacgggctcccctggggacgctcccgaccccgtacggggtgtgggcgacccctccccccccacct

SEQ ID NO: 12421 - DNA, 60155 bp, Homo sapiens
actatccaatctcaaaagctcacattggtgatcattgcaatatatgccagagattttacaagaataaacaaaatgctctttatactgacagctcgtctctcacagttcatgacctaagataaacataacggtaagccttgtgactggacctcctataaccctccccttggtgcccccagcagcctccatcctcactcccctccgatccatcccgcatgctcctttcagagcaatcttcctgtaaatgcaaacctcatcatgtcattgctggggaagaaactctccagtggtttcccatcacaaaccattaatgtctagatgccttagcctggcacacaagatgcctgtgacgttgcccagcacactcctctccaggccctttaaataaaactccacaagccctccaagcctttgctgcactgtggctgctccggatttgttccatgccattctgcccatcttctgccttctctgttttgccaaccatattccagctctgcaccctggagcctcatgtcagtcctgccctttggatctgcagcttgtgckrgaaattgctctctggctttccctttgaccaaggttcacccggcaaatgactcctggcctctgcttttctgtgtcagtacctggaactgtgggtgagaggcgtcctccaacagaccggtctctgcctttcttttctgcccacctcctgttggctgcccccaaactgccttgtacatagaaatatcttcagtttcttagaagagatgctcttctttaacatctccttacctcatcgcctcgtctgcttggaatttcccccttcccactacctgtcactctccttccttctcactgcacccttcttgcaggtgagttctaattccattagcaatcagccctcaattaaagccccatccccatggaaagtccgccctggcccctactttcctccattttactctcattctcagctgcccaggcagagatgggctttccctcttctgccctcatttggacctttaaatacctttctttttttttttttactaattacactgtaaggtattttgagtgtatatctgagtctctccctggagattctaagactctggttaaggacaggttttatttgccttttgtacctccaggactaagtctagtgccagcatgtagaataaatacaagagttctagactgagtaaatagaaagaagaatcacaactgaacaaaagaatgagttaaatatgccactgagctcatcatgtatgtcttctgtttactcaagtacaaatataaagggtacgttgatatagtctttcacactttcacttactgttttgaaatgtaatgcatggtagcattaaaggaaattttataagaattggtaggtgtaaggccctacccctcacactactgttttctttaccccaggtttccttttattccttttttttttttttttttttttttgcctatatacttctccttggcagatacagaatcaaatgttgtgtaatttttatttgcctttttggttaaaattgtccttttaatattttacacattgctaaatcatttatacttttttagaaggattctaccaatttgcaatgtaaagacacatttttatcactaagattaagtcgatctttatctgattttactccaagttcaattttattgcagcagtaaattttgagctcctagagtgttaaaacagtgtttcctatctctgtattcctggtgcctaacaaacaactgatacttaataaatctttgttgaaaatatgaaggtattttacttattgtatatgtaaaaattatatcaataagtatttataaattatatatgtgtgtgtatatatatatatatatatgaataaaatttggcagagcaatctaatctaagttcttttcacataccccaagcctgagcagataggcaaaaccccactgaaccaaatcttttctaaaagcttgatattctatcctatactcaaagactgctgaaggcaacctcacaaccttctttaatggttcattttaatgctaataattgccaaatcagaaggctgtttgcttcttcctctctaaccaaagttacctacagtacaaagtaagtgtatttttttttcttcccttcccttcctttttctctttctttttctgttcttggtgaaaacaaaccagttggcttctggatataagcttgccaggtcctctctgagcttctcattctcacaaatgaggtaagatcattcactcattttctatatgagattctgggggtagtctttggttttaaatacacttttttctttcctctatttttattccatctgattctagaatatgtgtgctctagaaattgagaatatggttcatgttattctgtattctaatcataaatttctaaacttaaaaaaaccattacaaaatagaatatgatatgatttacaagttatataaataaactctttttagagttggccattcaaagtggtatatatttactggagtcatttgaaagaagggccatggtaagtctgggtatagaataaaacgtagctggtgactgatccactcagaatcctgcctcaatgggaagcatcccttactctgaaaaatttaccaggctgtaactgaactctttggaaatctagaaatttaatcatttatgaaagttaaattcactgaagattgaaaaacagaaaccacagtaacaaaggagtcattcgcaataagaaacatcgtcaccagccagggagcttgcgcagtctggtcagcccaacttctgctcaggccagacacacgggagtgccagggagctgcagggcagctggaataagcctagggatctccctgccagccaccttgaaataccatgttcccaagtcactgctccacgaaggcaccaacgtatgcttcctgtaactgttaagaacacaggcttcaatgtctaacagagctgtgtgaaaatcctggagccatcgccttaatatctatatgaagttaacaaatcatttatcctccatgagcccatttcttcacttgaaaaacagcgtgtcataaagttgtgtgaaaaatgtacataaggtacttggctacatgtctggcatataatgtgggtttaataaaggttctggtttcttagggtgatgctacacaccttcatttgatccattatatgggttgacttaaaatttatccctctaaggacaatcttgtttttcttctttctatctttaatcattaattaatcactcattcatacattcacttattcaacaactgtttattttgtgctaggaactgttccatgcactagagacactgctgtgaaaagaatatatagagtccttacccttatgggacttacattctactggtgaaagacaataagcacataacaacatacagtatgtcgacgtatacatttaatggtgtaatgatttatttttcccataacttatttaatcagtggtattttccctttcatatttctctgatagggtctctcatttcattttcttttagtcattgacttgctttcatgtgattttttagatttcagtgatttgggtttcaatttagagttgatacaagaatgatagaaagaaagcagacatttgctcccctgtgaagaaagaaaaatcaggaaaaggaaatcatagtgaggaattaccaggcatttactctattattctctctctagaaaggtcaaagatgttgcctagtgctgactctgaggtgaaatttagtcacactaatatataaatgacttataagaacataaattgctattcctcttcaaaatttttgcacttgataattaaaatgttgcacttaggaacattgggattgactgcatttgtgtgttagaaaagtggatactggaaccttctataagtatgtagatcacaccctataggcaattattaacttccatgtgcttccaaaaacggaacctagaatactctttagagtcctagaggtgagaatattttctctctattggtcccagaatttcttaccgtcattccttccactccaatgttcacttccatgtctgtctttgctttggggccatcataatgaattggaacagtgtttaaaggagagaaaaagggaagaggatgaccagttgaagggaagtttcaaagattctttttgttcttcaattttggcagctgttgaagataaggctctagaagacaggagaccatataaatgcaaattttgaaaaattattgcaatatcctattcctttcctgaaaccaaaaagcaatgattactatatgtttgtacattcattcattctttttttttaacaaacttgattaagtaacattttttagaatacagtcttcaaacagcttacaatttagttgaatgaatctaatctgtggttttcttttttcttcttctgagacacatgttttgtctatctcacagtacatgccagaaattctgtttgcatgtgtgtattagtccattctcacactgctataaaggaatacccgagactgggtaatttataaaggaaagaggcttagttgactcacagttttacatggctggggaggcctcaggaaacttagaatcatggtgcaaggcaaaggggaagcaggcaccttcttgacaaggcagcaggagagagaagatcaatggaggaactttcaaacacctataaaaccatcatatcttgtgagaactcactcattgtcatgagaacagcatgacggaaccacccccatgatccaatcmcctccctccctcaacacatggggattacaattcgagatgagatttggttagggacacagagccaaaccatattaatgtgtgacaaactcttgttcagtgcctggggttgtacactagataccaaacattggctgtaactccaccaccttctcttccatgcaaagaaagcatatcaaaatgcaacagagtgagaaagactataggaattcactgtattcactataggaataaccttgaatctagtctaaaatcaaaattaggatttgaatccacatctagtggatgccaagtggtgcttgcagatgtcatgctatatgtgttactccataacactgaaaagtttatacatagtagtagtattgtcagtcttttgtagattaaaaaaaacttgatattcagagattaaatgacatacccaacatcacacagctaggaaatatctttttaaatatttagtcttgctttgtctgactctaagtgcttttcccaccatatgacaccatttcaccatatcatctctggatccaaatccatcttaatcagacccaggaaaaacaatatgactccaattaaccagagtacacagagattggggagttctggctattgttttggttaacgaagacgtaactcttgccttaattcatccaaaagctttctaacagttaccagttcactttccaccctaagtcagcacagtataatgtaatcttgccttgatgattcaggatcttatgtgtctcagagccatcattatgaacagcagttgctactaagaaattttgaagtgaatgcaggagatacaggcgattgggttgaatgcatggggagtttgggattacttggaagacaaattcaattatactgtaatcatctaacttttctgtaatcagaatggaaaaaggcccccaaatgaagactaatcaaatgtttcagttgagttgggttcaaatcaatcaagtttacttcartttttgtaactagctgaccaacttcattaaaagtgactgtttttctccttttgccacttggtaaataacaaaaaaaatatgaagctttccctgattcctgtgtacagttgtgttaccccatcatcagggagagaaatgagctgtataattactgtttgagacatgaatcatccttgctcggagggtccagacctgtttgactctataaaaggagctcaaggtcgaagtgcaaacgtgcactgtctgccatcccccaggctgatataattaccaagctactgtgaggggatgaaggtgctccctgcatctggccttgctgtcttcctcatcatggctttgamgttttccactgcagccccctccctagttgcagcctcccycaggacctggaggaacaactaccgcctcgcacaggtttgtgaatttttgcccaattccttcttgctcctctgccctagaaaacctaaaagggcatagtgagaaaataagaaaaaaattctattgttcttttaaaatcattttatataagtccattgaagtctaactgatgctatcttctgtccacctagattggtgtctggtgcatattaggtrtaccatgytacatgactgaataaatasatgagkatatatctacctagctatcttgcttcataaagaattccaggtggcttgtgaaaaccatgcaatataaaaggagcaaacaagtacttcccgggaatgatgtaggaggaaaaatagaagcagaaaaataaaaaccgaggcataatccacacgctagaggcaggttgtgaatttagtgctaagctttagcggtcacaacaaggagatttcctgtgtttccactttttaaatggctcttatattcaaggtaaccctgatcaaaatttaaagtggactaagttcttcctgggtgccaacccacttctcatttgaaggccttttctccctaaagcatattccccaatgaagtaaaagtttatgtacaaagtacataacaaagtttatgtagtaagtataaagtacaacgtttatgtacttaaactttgtgtattttcctcttttgagatctctcctctatgactgctggaaagggtctgatagaaatgatccatattcaaatatttcacaaagactgcttgactcaaaatgatttctacatatatatatatatatatatgcttccaagcgtgttttgtttttaaaagaagggtggcatccttaacctaaagaaatggatgtctacrgatggaatttccaacattagtgaaagatatrtagaggaaatgcttttgcacacaggcctccctttcaagagtctgccaacattacagcacatctgtgatcaccagctccgcctcagggctgctttcctgactgccaggctgcacctgtgtaccgcttggctgtctgcatcgtagagctgatttgcacccatgtgcaatggcatgtccctaccgattgtttctgccactcatccttattaactggtcagttccccggccataccagtcattaaacacttaaatatcagccccgcagatgaacagcacagctgatgcccagcayaaccatgttgaactgaacttcttttgactttagcccacttttagatgaactaaattcaaaataactcaggatactgggatccttattcaattgtattttgtccatgccacctagctttaggtgccttcttcccaaatgtaattttccctaccctgcctcatgccactgtgattctgaaactaaagaggttttgtgacctccagaaggagagccatgctgaggccagaatggatctgaggtgttgggagaccccccttctaatccacagttcaggaaaactacagttggccctgccccttagtttacagattgtctatgattgcttttgtgccacaatggcagaggttagcctagaagcaaagaatattaattattggtcctttgcagaaaaaattagtcacccctgaccagtctattaaggaataaggctagaccagccaagcaccagtttcatrgaagacagtttttcatggacgtgggaagtaggaggctggaggggtgatggttttgggacgaaactgttccacctcagatcatcaggcataagattctcaaaagagcatgcaacctaggtccctcacayrtgcagttcacaatagggttctgctcctatgcgaatctgatgactctgctgatctgacaggaggcagagctcaggaagtaatgctggcccgccactcacctcctgctgtggggccaggttcctaacaggccacagactggtttccgggtgcagcccaggatcaggggacccctgggctagacactcttgggtggagtcactcttgctattctagctggtcaggagtcagctaggcacgtttagaaacagtagcatggcctgggaatattggggacctttwgtgattccttacttcttcctctccaaaataaatcaacccttctctgtctcccttatgacatactctcagaaagaccttagaccaaggagcagggaaacttgtccacatctcctcacctgacacacagcacctttgcttgcaatggccctggtcctcagctctgggcagggacactcaggagcctggaatgatctggctgaacctctaatgaggatcacaatgacaggaaacaattatttaataacatcccaccttataatttatagaaacattatataacaacctcatcagcctcataaaatcacaaacaaaagcagtaaaataggcagcataagttcatgtattgaatgcttacagcatggcatatgctggagaaatatgagagaatcaaacaaatcaagcccctgttcttatgctccttccatgaggatgagggagctggtgggaaggtgctgggagaagataaacaagtcaaccaatgagtgcacaagatgtttcagaaagtgatcagtgagcctggaaagaagttaatcaggatgacagagwgttgctgactgggacagtggtctggtgagggagtatttttaatggcgtagtccaggaagtcctctyggaggaagtgaactttgagatgaacctgagctgcatgaaagagccagtcacgtgaagacctggagatrgggcagtccagacggaggaaacagcagctgcttggaatgcaatcatcaggcccatgtgactagagctcagaggtcaggaaagagggtcccagaggagtcccaaggacaggtgaggccagcaggtcctctggtgcctggtggcctgggtcacgctaagcagagagagtgcttagggatgctctcttcttgctaagtgatctgttaggtcactcgctaagaaagaacaaatggctcctggaaacaccagagaggccacgtttccaaacaccatacacctctccctcccctaaaaaatctacacttgaaaagataaacagcttcttgatttatttaatgtccacttgtgtcctttaaattctgatttgctaatttgcctaaatgctttgaaaatggtaagatggcaaaatgcttacctattctcataatccaggattttattctgggtttgtttgtttgttaaacaaaattagtgtcaatatgacatttaaaacatactttttaaattatgyttaaaaataaaaattttaactaccacattattatgaactcataactaaggaaaatgaaaatacacactgttaattcaggtgtttttactaccattttattttctatgataaagactttttaaaattgttactgtcttcaaaatgtggtttttacttttctaactattatgtcataagaaaattttgrttttatactattttcataacatcactttaaacagtcagaaatattccagaatatgagttataatttatttgaccatttcctttaacaaatagattacttccatatgaataaggcttctataagcatctttgtacatcaagctaatttaaacaattattttttcaggataggtttccagacatggacttaatgagtaaaagggcatttgaaagtattttgtcacatttaaaagcattcatattgaggacctcattggatcctcacactcacgtagccagtagggcagaaaccactctatagatgagaaaactgaaaccacaagaaattaaaagaattgcccaagcgtgttagtgacacagcctggactagaacctaggatttttcagacagctttaaaagttctcacaaatctatttgtgtgactgtaaggaacatggctgtgctgcagccaagcgggcataggccaaggtaaacatcctgcgtgactcagcgagtttagggtgcaggcgtacatytccacttgttatcacagccatgtagccataacatgggaaggccatcacttagctctaagccactattgtctgtaaaaggtataattgccctgctgacattgtacaggagtcctctcacccagagaaatagagagagagccaaaggtatccatcttgcaggcgggtaggagggagccaggaaccggcttgtgcccagagagagaaagagttaagctgctgaccctgaagggtgggccagccacgcagatgtgtgtgggagcagccggctcaagcagccgaaacagggcggacagtgtgagaaagctgctgatgagagagctgctgaataaaaccatattcatctgcctatgccctcaccccctccctgaggattctttcagctatctgccacccacccattcccctcagacctcagcatgggctggaacctgacactgagmatgacatttagtgtagtcgtggccccaaacctgaycctggaacctgacagtgactttgccaaaaaagaaaaatgttgaggaaatgtaccttaagtttcaccctgtyctggagcgtacttaaactgagttttaaactcttaagtctcaggaaggacactaggaaaatgcacggaataagggcttggaagggagacctaagctgctagcctgcaggaatggaacccctggcctcctgtacttttatctgtcagataccagaagagaagtggagagaggaccacctgataattgacccaaaaattctacaattttaacaatgaggaagtggggaagattggagggaaatgggacaactctggtgaattctgaattctttgtcccagtgccaacattaagtgctgagccaacatatgcaagtgttagagcatcacatgaaagcaattctaagtacacacctaagtgcctgatagaatattgtgacagtgaaaagtatgccaaaaccttgtcagtaactttagcaagaaagtgcccagagttctgagctctcagtacttcaggatatctgataattcttcaaggaaacatactttcatattttgcctaaagaaaaagmgctcaaacattaactgagcatctactctgagcctagaactgagtcaaacacagggtttgcatctgtgaaggcaaaacggtgcctgactggaaggaggttgcaaacaagcaggtgagagtgataagaaattggtaggaagtgatggtttatggtgcaatgagacaagtgttttactagaacaagaatcacatcttatggaagcaccaactagggagagattttgtttatatcactgcagtgatgaatttttgtttttaagaaggaayagtttctaattttatttttacttcattaaaaggtactatttcaatcctgcctatatgaccagccagaaaccttttgtgctctaagactaacattttgtgcatattttaaagaaacaaacagctggttataaaaattacgcaggttcatagtaaaaaaaaaaaaagtaaaagccctatctttaaaaatacatcatcttaaatccattattaaggtttaaccactgttagtcccttagactatatctttcataatacttttctrtgattcagggccaggattagtgtgagacaaccaaagcaggaatgcatcctgtatttaaaattttgaaattttgtttatcatggatttttttggcatttattttgttttttttaattctgcattaaattatgatttatcttgattacggagtttttggtaacccaccactggcctcatctcagccctggtgatatgactgggatggtgtgactagataccacttatgtttataaacatggctcatgttgtaacagcagtggtaaacacggcaaacatgytttccacttaatttatcatgagcatcttcccttatataacctattttgtgaaacaaaaactagaatgtagagtgtaatacataacctaacaggagaacaaaatatttgaaatcaatgatctcagagacacagaggacctggtcttatacatggagcttaaccctgaggagtataattcagacattaccacaagcattgcattatcacagcatcaacttgcacagacaggaacaattcatcccatcaacctcatttgcaaaaaaaaaaagatgagaaacatcaatacttaaggtggtctaactagagacggaatggaaccaaatagtcgcagctttgtttcagaacacctaggctaggtttcagagcctgggcaccccatgttccctctcccttttcctcctcttggcttctcatctcacctaaggtttttacaagggacaacaatggggaaagygatcttctctcacaggaagggcagggagtaaaggatcagctgatcctgcagtgaaaaaatagcgtaccctctccaaacatgagtgatacttactcctttttattttttccccagcagtaatggttcatgctcattgtaaaaacttttggaatataggaaggaataaagaataaattaagtcatctgtaatttcattacccagacataatcaacattaatattcaggcagacttccttttattattgtatgtgtgtgcrtgtgtgtatatgcgtgtatatgtatgatttattcagaaaattattattataaccttataaagatttctcctcttcttttctcagtatattgccattacataaagagcattctttcataccattaaatatttatttttcaaaactgatcttagtagaggcctagtactgtctcatataaatatargataatatatataataaatcccctgacatcagacattaaggttactyccaattacttattatctttatatatatgttaaaaatatgtgtgtataatatgtaagtaaacaatttgcatagtttatatgtggtaatatatggttaatatataggctaataatatgtaatttatatctaataaataaacatgtctatactatataaatataaaattgtatataattaaatacaatcagtgctctgtatccatgggatctgtacacatggaatcaaacaattgtggattgaaaatattcaggaaaaaatcgacggttgcatctgtttcagggaagacatgttcaaaacagacattttttttgtagcttttccctaaacaatacagtataacaactatttacatagcatttatattatagtacatattataagtaatttagagatgatttaaagcatacaggaggctgtacttaagttgtatgcaaatattatgccattttatatcagagacttgagcatctgtggatttaggtatctgagagaggtcctgggaccaattcccccatggacatgaaaggaggactgaacccttagctgctctttggttattttcctaaaatcagctgagtaggtgaaattcctgagccaaaggcaggcctcaaccctgtatttgcatgcccctgcatcactcgttttaccctaatcccagccctgagtcatagaaaagtgttttgaacaatatatactgaggggctttatgtctttttgtgcaaatgaaagccttataatttatggcttattttatttgcttcaagagacaaagagccttgcctaggaaagttgtctcatggaaacaaaatccagcccacatactaaacacatctgaactcattaaaatcctcagctgaaaaaaaggtggaccctytgcctttgtaaagtgtgagaggctggaatacaatgcctttaagagttaaaagcatactgatcttgcattatgtacaatggaaagatgataccaataactgtttaccaaagaaaccagatagcctttgttttgcaaattgggtaaagaacttcagtgacaaataagtgatccatggaaataatgytcacatcagcttccttccctgaatttttttcttttaaaaaaattagaagcaaaaaggygtatttgttatattcattgcattgtagaaaaactataaaatgcaggtggacaaaaggaaataattaaataatctataatccccactacccaaaaccaatcatcgttaataatttggagtatagctaagctttatgtaaacaaatatgtctacttttttcataaatgggaaaatactctacacactgcttttaatacatcaggaatgctgtcccctgccttacctgagcatgagtatttcccagactacgctgtagacgcgtcagcctgcctctccatttcaggcgtatcttgacaaatattacacaaataaagaaggacaccagattggtgagatggttgcaagaggaagcaattccatgataaggaagattaaggagctacaagcgttctttggcctccaagtcaccgggaagttagaccagaccacartgaacgtgatcaagaagcctcgctgtggagttcctgatgtggccaattatcgcctcttccctggtgaacccaaatggaaaaaaaatactttgacatacaggtaatgagatcaagtctttccaaattcagagaaaaacaccacctctmtctttttcccttttcttgaaaaaatattttccttctcatccgtataaaaatcctgacacctcacaaccataagaataagaactttttacatccatccrtcaggcaatgacaatgggcaattcaccagaaaatacggttttaggattatcataatgactggctattttaggcattccaaacaattttaccagctagaaacaacacaattatctttaatctagtctaggattaatgacctggcagtacaaaccagttttcttaaaacaacctgcttaatgagaaagaaaaaaataacctactaataaagtaatttatttcattgattccaaaaatcttttattgatgattcaagaaatgcattccatttgagggttataaaggtgaacaggtcaactttcttgaccttagggaactcacagtcctttaaggaragacagacatgcaaacagacagctgtagctctgtgtgaaaagtgcaaaagcatagctctaagcagtgaactgtgggaccacagttcacatggacagagctaccaagtggcccagggaccagcagtaacatctgagcctgattcgaaggcaaagcagaagcagttccactcttagccccaagctcccctcactccttccctgccctctttcttccctcccctaatcctctggcttcatcccttataaaccaaggggacacacccarccagaacctctgtccctccctgctgtgctcagggtacggagtctggaattccctctcccacagccagacctgattctgggagccagcgcagacttcctccccaggttggtccaaccaagggcaaactatgtatggtacctgcccctcagcctgaggtaggggtggatggtgcctgcctgcgtgggcctcatgcatgacagatgggtgcaggtcagaaaagaagagtggactccactctttgtggtcctgccccaggccttgcacatgtaaggagttttctaaggagaaaaccagaccaagcatatagcagcagagagtggacagactggcatgttgatgggcagcattcccaccacaagtgcctagtgcatgcggctgcagcagagggtgcaggaagggcaatggcaggaaatgagctggaggggcagcctgaagggcaactagagcgtgatgtcaaggagtttggactttatccccagggcggtggagagccaggccaggaccaggatcagatttcscttttaggatgagcacatctagatgataactggagatggggaaaggctggactcgtgcaatagtctaagcagtggtatggtagagctgccgcctaatagctcacagaagccaatccttaaaatgtcaggaattttgcagccacttgttaagctcccaagaattttgtgagctggttgctaagacagccattgttaaattatgtaaatttactattaaataaatcatattacattacattaaataaattaaattatattatattaaataaattatattaaataagtatattatttcatatttatatttattattaaaatatatttttgtagtaataaatatactatttattaataatatattattaaaacattattttataataataaataaaatackttatttattattatatgttatattatttaatakgtataattatttaataaattacattaaattatattaaatacattatattaaataattacattaatataataaattatattaaattatattaaaaataaaggtaataacatattgcctcytatttcactacattttattattttctctgttcatgaggctatgtacatctgtataatctgagtggttcattcatgctcatctcttcacaacctggcattcagtgatggtaagttggtagcttgaattagccatagtgagaatatttacaacacagaaatcagcaagtcatgcaaatyaagtgggttttttttttctccttgtagagccacttgttaacctgttccagcacaccagtgagtccatttgatcaaaggaggggccagaatccagggaacagtcatgaatcccctaggccacttgttacctgctatcagccaataaatccataaggtggcaggctgaacaaaaaaacaaagcaattgggggagaaaaacctcataggagttgaacacaaaagtgattctgaaatagtaagaataagacaagaaaaatgtgtacgcatcgacagagtcttttcatagttttcttaaagtaaactgtgttctggaattttagtccatgactatgtacaacaaagacaagaagcctgggtcaagataatgtgatgcttagggaagtataatattcttgtgataagctgggcagtcttaaaaakccctcaacacacacattgcctatccactcttgctccccaataactctaccatcgcctccccatgaaaaaggacactagaggctatcacagtactctgcctgtgtagctactgactttcagaataacttcttacaacataacccagaggattacaaaaggaaaaaaaatacagcatagtgcttatatrmataagctttggagtcagacagaactgggctcaaacctgactaatcataacatgtagatgatgatgatgatcttcctcttaggggtcgaagtgaggattagataaatgccacattaaaaagtgcatacagcaacagcacatagtgtgacttcaaagaatattggctagtattactattgctttatcaagctccagaccctgattcggggatccctttttccatgttctcttcttctctggtgctatccctctctccttccttgtcttctccaggccaacacacaaagtcagctcaaagatatggctgacttaccaaaaatgcgagggcatgtcaaagtactaagtccacctagttgtgataaattgcagactcatattatgcagtgggcttggcatattttgaaagcattaaatagtccctttaagggtctgtctggtatcccccttcaattctatagctctcttcttttggccccaaacctggggttaaagagctccttgttccttccctctcaagtcctgaattgagctatttgctatcctttctgtrggcacagtcctttcatttgggaccctaggattactgctgttggtttctcattgaaattgcaccatctgcattataataacctaagatacctttcaaaacacagatttctggatcatacctgtatttttaacaagcttcctaggtaattatcacaggtcctaaacttcgagagccactgagtgggccctaaaacagctagctttaattctttaattcattcatttatttatcaagcaattgctaagcatctgctatgtgcaaggcactaaactaggagctagagagagagagagaaagcagggccggtccctgctcatggggttggctctcacagacacagcttctcactttgcatcatattccagcccagcccaaggtctcgggtagaagttgccctycctgcctttcctttgtgtgctgccagaaatccccagaccctgggcttcagagcagaaagttctaacaatcaccaactctgactccacccacagtccaaaaagcactacatttttctgccttcaggtgtcatcgtcacaccagtaattgctgaaaggctcacccttttttcarttccagtgagcctccgtttttaaagctagcccttcctctttaagaatgtattattttgggctgggggcagtggctcacgcctgtaatccgagcactttgggaggctgaggagggcggatcacctgaggtcagcagttcaagaccagcctggccaacatggtgaaaccccgtctccaccaaaaatataaaaattagcccggcgtggtggcgggcacctataatcccagctactcaggaggctgaggcaggagartcaattgaacctgggaggcagtggttgcagtgagcagagatcatgccattgcactccagcctgggcgacaagagcaaaactccatctcaaaaaaaaaaaaaaaagaaagaaaagaaaaagaaaaaagaaaagaatgcattattytgagggaaaaaaaaaccttccccaatagccctggggaaatcctgaggagctttgaataagaattagcaaaacttcaaaactccacatttctattttttataattgaaaacatccagtccctttggggaaaaagaggtcctctctcaatgaaaacgactttaagaaaaattgactacttactacctgtaacatttcacaagttttatttatcttatttatttatttaattatttttgagtgaagtctcactgtgtcacccaggctggagtgcagtcgcccgatcttggctcactgcaacctccacttcccaggttcaaatgattcttctgcctcagcctcccaagtaactgggactacaggtttgcaccaccacgcccagctaatttttgtatttttagtagagatggggtttcaccatcttggctaggctgatctcgaactcttgacctcaagtgatcctcccacctcagccttccaaagtgctgggattacaggcgtgagccactgcgcccggccacaaattttattcttttaagtcggtggtagtataataacaatgaaagctaaatggtttcagtaccggattatcccaactgtctctcatctctccctttcatttgtcttgttgtttcatatgcagaaatttaacatataataaagcaaaataagaattattatttcagagaaaaatytaaattgtagatttacatttaacattttttgaatacaacatataattcttgccttcttcggagcagttactgaaaagaaaacatgttccttccgttttcacagaatatctaaatacayaccttccatgagttctgtcgaggtggacaaagcagtggagatggccttgcaggcctggagtagcgccgtccctctgagctttgtcagaataaactcaggagaagcggatattatgatatcttttgaaaatggaggtattgtggtacttggattccatctactaattcaaaggagagttgtcccaatactgttccttctacatctttaattcgagtgatcacacactcctccttcgcacagtgctgtgatgggccaaggccaagaccatggcaaagccatgatcttcatctggccagaaaatagaaccaaaggagttcttagcatgtcttgtcatcatcagacacagctgtagagtagattcactgtaacaaactttcattatgactttgccccactaggggacaaattcttgcagattttgctttcccgttagccacatgacctcatccattcccatgatagtgtttatcacttatataaccccttctatattagccaaggatatcctaccatgaatcctcactgaagcaaataccttccacagtgaccttgaagcagctttccccctgcagcaatggttaggaaagtatcgtttctgtcttgcccacacttgcagaccaccttctgggagatatgcaagaggtctgcctccaactttcccacttcttctccattccattgctcaccctcctcagataacatttctagtgtccttgtcatttcaagcccagatcttaattttaatctgatgtcactggggggaaaacatgcttaggagctagaaaaaagaagatcaagcaagtcctgagaataaagcctttagaaatggccctgggcgtgacctggcccaggttatgtcctattcctcccagaagagaaaggccacccctggtgaagtggcagggaaagcagtgtgactcggggtagctttgaaggccaaggaatgaatgtctggctctctcttgatctttcaagcttacagtctgtcccctaatacacaagccaaccagggactgtgctgccattgcatgaagtcctcggtgtgtgcacctgagtagactgcatttcactgaaacctgagaaatgccataccaaaactttgttctgtcggcttttwaaaaaaaaaaaammaactaaaactgggtatccttactaagatttttttaagtggtaaactatatcccttattttgttcttcctcctcctcttctattaaatttgtaatgaattgttagttaaaatagwtaattaaacaaaaacttaaaaagctttaaaagttaggattttataaacacctttatgactttcatatgttttccacatgaaagtatgtcaaaattacagagagatttttgacacttccttaaactgtattgtgctatagaaacagaaagcacacacttgttcaattcactatcactgtctcagctgaatcaaatttgaaaggtcattctgctaacaggttcacattccaatcagtggggtaggttttgctatcgaatgccgccccmccgccgccccgccccrccccagtcgttctcyttttgtaatctgtggcacatgcaaagtccacagtatcctatgtgtcagttaacagatgtcatgatagcaacaataacccaaaacaggtgtttttttattgctaatgcttactatctttgcagtatgaattagccttttttatttttcaatgggctgttactcattgacaaatgaacttcccattataacaaataaatactgaaaagtgaatttaagtgtcaatgctactcaaaaygtcccttttctgtaatatgatgcgcccctcagaatttctagaaggactcaatcttgttgrcctttctccccacttgtttagatcacggggattcctatccattcgatgggcctcgggggactctagcccatgcatttgctcctggagaaggcctgggaggagatacacatttcgacaatgctgagaagtggactatgggaacgaatggtatatatgcacaattcaccataacctggaaaatattgtaccttcttctgggctccatcatgaaaccttgaggttcaacgtcccaagccaccctttaactaggggggctggctaggaaaaacaagtaagccaaaaatccaaaagggatcacataagggaaaaaaatccaccccaaattgtgttgtagacttgtctgatctgtttcatagcatatcatctgaagaaccagtcatccccttctcaacgcactgctctcgtttccttcaacaacctagtatttatgatttcttacttattcttggaaatgggctacattcagaaatgacccaagagaatcagtactgtcctgagaagtgtgttggggatgggaataaagtttccagaatatcatacaggtcatctggaaatcttcagtgtgaaacgtgtggatcaaaaggtgtaggctgtaatagcagggaactattaaggcatttgtggtctaaatttatgaattattgccaaatagcattgccactatttgttccaaggctctgctttatcagtctaccaaacatcactgatgatgaataaaatggattgatgtgcatttctgtcctcccccacccccaacccccttctagccaaggggggaagaattaaagtcaccaaagctaagtgccagaataacctaccaacctttgaataatccagttaggagaaggagatgggttaactgtaatgtgggcataaattatactataaagatggaagatggagaaaacaaaaacctgtgttgatactgtttttttctctctcatattgtctaggttttaatttgtttaccgttgctgctcatgaatttggccatgccctgggcctggcccattccacagacccatcagcactgatrtacccaacttataagtacaagaatccctatggattccacctccccaaagatgatgtgaaagggatccaggcattatayggtaagattattaccttctttgatgactcaccctgaaattggcaggcattcagtctccgaattaaagaaagtgcattttatctgcattggtaaagatcaatctagaaaccatarccccarctatgccttcytgtgaagagctgatttgctagttataaatatgtgtgtgatgtgtgattaaattttgcatctttcctttacagcatattagtcctggatagccttagaaaatatagtcatttgtctgtttrtttrtgtttttcctttgagtgcaggttagaatttacacattgggagaggatggatatagtttatagttcatatatgtggtgcttacccatttgcagataagtgaccttatctccctaaaaatagcaatcatgattaaaataactctgcacccagtcatgtagccaatctgcagtttacaaaacaggttcatgtgtgtagtcttacaccagcctcacaaccaacctgtggggtgtgaagtgttttcctcatttgatagctgagaaagctgaggtttgaagacagtaagtatcctaagatawcctaagrtaagttacctcaagtattaatattcttccaaaaggtaataagggattattagaarctctgtatccaattttccttaagggaaaaacaaaccaattaatccatcagaaggaatcttgaaacatccttagaccttgacaatttttctttaatggataaaaggcaaaaagatctaggaaattgcttttcctttgagccctggagacctggttattaggcttctgattatcagagcttctccccatcttctcagtgcctagagacccagatcccccaacagcttcctggggtgcyaggaatctggccccaggggatctggagggtgggaagcccagaaatgggcacaccattcaaaatcagtcagatttcacctgaggcacaaaagacaaatttcatcccaagaagctttcagccagctctatccatttccaggagggggaaagcaccagatctgcctgacccttgagggacaggaaaaatgccatgaatgtctccatgtcacaaactcagctccagagccttggtggcagtgttccaatgggaagcgattcctgtgggccrccgagaagggctgagctcaaacacttgcctttggaggtccttgtgccctggaaagtcactgccttcggatggccactgtcactcagccagraggcaaagcacatattttggcacagctattatgacacaggtgaacmaaatgtgaaaacatgggtttatgttacaagggagcattcatatcacccasccgatcgcttgccgctgctgaccctctccaatttccagcttcgatattctcccaaagcctcaccccgcctctgatcttcgccttgatgctaaccctactycatccctgayctcaaacctcatctgacccttatcagaggcctgaacctttcccttccctgtgcctcattccttccctgactctcacctgtrattatgacgaggcttcatcaaagagcaggaacctgccagaggtgacagtccaagctgtgcaggctcattcttctggagctgggacacagtcctgagagatgcagagcaggagaggagactcactgatagctctcgcaagatttgggtccatgttttccaagacgatccaccagaagatacctttaaatagcaaacaccttcagtgtacttcagtttcacaagaactcgctcagtttttcctggatgcctagtaaaagacaaaagcacagggcaggatgccaaggagtctatgaaaataataggaaaacacacaagaaagttttcttattgagaaaaaaagaacttaattacaaacaaacaatccatgccaatttttaaattacatttctaatttggaacacttgtagatatcaaagaagttctataataaaataataatctttagaagacttactatgtgccaagcactctgctacctgctttacaggaattatttaattctcacaacagccttctgaggtgagtactattattatccctcccttttaacaagtgaggaagctgaggcttgcaaagttgaataatgtgcctcaaatcacacagctcagcaaccaggagagccrggactcaaacccatacctgccctcaacagccatgatcatgrtcacatgtccagcgtgaaagtgtacaacctcccctggggctctagagcagaagtgtgtgaactccaaattcccgttaccattttgaccaactcattttgaatcctaggacctcggaaagyattcctggggaagcccamtctgccccatgccccccatcacaagccwtccatccctgacctctgtgactccagctcatcctttgacgctgtgacaatgctggggaaggagctcctgctcttcaaggaccggtaagcctcagacacgccaccgactctcattgggcctcayctccactcccagacaaacgtcgtcccacaggtccttgttgctgccttgtatgaagatcatgcagaaatgctgtcctatgcagcagaagggtggkaggcaggggtctttgggggagatagagaactgccaaaactactgtttgtggtgcacctactgtggtcttgctactgtgctaagttatgtccatatatggacaatatttattgtaacctttttcacygtagagattagaatccctaatgtgcagataaagaaagcagctcaaagacagcaagcaagtttcccaaggtgacagttaaatggctgagctaggacaccagcctgaattgatctgatgtccattttgtttaccactttatccctagtgagtgtgcatagcaaatgctcaataaatatttggtgaatgagggttggctagctggacagatggacagataggagattggataaaaggatggatggatggatggatgatcagatggatagataggtgggtagataattccaaggccagcattcttccgaaactgctccttttcagtgcctccgggcctttcacagagaaggcagatccctcttctcccccaactctggtwtcttggggagtaaggctgttgtctccatgatgctggttactccaaatacttctttccatggaggcaaagagaaacatagcaacattcaccccattcctccctttgctggggacagaattcaatcacaccagaataggcagaggcatctcaggagcattcatgygtggcattattttttcttcttcttcactattgcaaaagtgtttatggagcccattgtggttttcaagcagtgtagtctcatgtatgagaaggtgtatgagtaggggactccaaaagccctgcaagatagtgagacatgagctctaaaagttaggcccatgaaacaaaacaagaagcaagtacctgggaagatctagagagagttccctgaggagcagacgtttgagaaatgtgatgttccttatcttgtatgcttttggggatatattgttgagctactattataagaatactttttgctccttcagcacagagagaaagtaacaaagtattttttaaaaagcaaaatttacccagaatcccaccacctggagtgtatcagtctgcaggagctgctataaccaagtaccatagaccaggtggcttagacaacagaaatktattcctcacagttttggagggtaagaagttcaagatcaaggtactgcaaggtaagtttcaccccaaggcctcttttcctggcttgtaggcagccgccatcttgctgtgagctctcatgatcccttcatgtacagagagagaggactgagatttccagtttctcttcttataagtgcactagtcccatcatggggcccccaccctcatgacctcatgagtcaggaatgtcctcttccagcactaaccctaattacttcttgaaggtaataccatcccattgaaggtwaaggcttcagcataggaatttggagggcacataacacagagcattcccattgttaagcatattgttttatgtccctcctgacgttttctctggatagagagctagatattgtacatatgggagtagggcgcaatgatttctaaaaaaataggattttactagtggtgttgatttataaactttttcactcacaaaattttattttttcctgtcaacggattttaattctcatcctttatatattatatgttattccaatgaatagatatatcattacttaatcaatcccatactggattatttctaatttttaaaaattagaaacagyttgaactaaatctttgacaatggacagacattcacttttcaaaggcaaattagagctgagcccargaacccaggctttcacagcagagtcagtgggtggccctactgcttactgatgaggtgatccccagcaagtaatgtgccagacacatagtgtcaataaatggcagttactattcttaagagtgggaatcaaaaaatatttacaatggcagggaggcttataaacaacttcaggtatttagagaacccaatttattcttttgtgttattaattttctgatgattttttatttttaagacactgaccattgacatttttcttgaatattaccaaaaagtacaccaaatggaattggtaagcaatgacccgggagtggtagaccaggcagggcaggaggagcttggagcacagatctgagtaaacttggcttcacctaagggatatcattgtcaggctccacactcccagacactgaaatagcatgtagcactcattcagtgataaagcagtgaggtgctagccatcatgcagggtgtagcttattcttgtggtaaatatcagaggttgcagtgggggyaaaggaggyrgtgaagtcaracatatgataccatttcattcaatgatcattgttttcttaaaaaaaagcaaaaaaaaaaaacacctctgtttatcaaactgtgagcatttagcaattactaatgactacttaaagtcaatacatcttttgacatagtcttgattataaatactgagggtgataacagactagtaagtgagacattggtgcaagagacgtctagaaatgaaaaatcagcagagggacygcaggagagatggcctgctacmatgtacgtatctgcttagtcaccaccttctcatcttcttccatttcagattcaatgagctactggggtagggcagatgattccaaagaactagaackagctataagcaggatggggagtcaggagtggtcccagcactggacttgccactaactcaccgtggcacctggagcttctcttccttttctataaagtgagggagttgtctgtaataatagtgacttaaaagtgttcagtacttaytatgcaaagcactatattatcacatccttacaattcccctgtgaggcctgaagtattattccttttacaagtcatagaaaggataagcaacttgttcaagagtacatagctagtaaggggtggagstggaattcaaacccaaactagcaaacttcagartccgtgcccctaactaccctgcctcctaaggtgctgtccagagctggaatcccatgactctatagctctgatcccctaccagctgccgctaaawgtcccagagtgcttgctaagcctggacaaagaacaaagaattctttcaagccacagttctaatggcaaccagggagccactgattatgaaagcgctcccagtctcttctctcccactcaacagcctggaattccccgtcaccaacaatgatctgttgatgggacatttcaagctgtgggcataataaccacatggtttgtttccaaagcaagatggaatgcagtaccttttaaagtcaccgtgagatttgtcagatattctccatagtgtataaacgtacattcaaatgttctgtgtgaagagaaataagtgttagctataataagttgagaggcatatatatagctagatatacttaatgaacatacacttactttttataatagatgacaaatttattaaggctatatcasatttcctcagtcacttagggaaaataagagagaaatgactggaattgtagccayaccaaaattatatttgcatctrtcatattatgttgggttttgcccaatataattttaagggtaaaatcaagaatatcacacacaatcatctataaatcttagaagtacaataggttttacaaatagagtaagcataaaggttgatcatatccaaatccttcagtgtagagataaggaaaataggcacaggtcttttagcctcagcagaccctcccatgagacccagatcttctgactccagtccagaatctatcctrgcactaatatagaaagctttctgcctatgaaatggaaataccaagaaaagcactgaaatttaacctgaatgaacatatgcccattgactgttatgcrtttgagttagtaggaagagcacttccgagctgttcctttgcttccacaccctctgcttgcargtggggcaaccagccacaaagaggaggatgttcatagactatctaggtttcccaaggatgtctaatatgtttcttcacatttttttttccaaaataggattctatatatttttttaatctgtcactaattgtcacattttaaaagatgttatgtgtcttaaattagaaggcaaagaaaagcatttttggccgggcgcggtggctcaagcctgtaatcccagcactttgggaggccgaggtgggcagatcacaaggtcaggagatggagaccatcctggctaacatggtgaaaccccgtctctactaaaaatacaaaaaaaaaaaaaaaaaaaaaattagccgggcgtggtggtgggcgcctgtaatcccagctactcgggaggctgaggcaggagaatggcgtgaacccgggaggcggagcttgtagtgagccgagatcgcgccactgcactccagcctgggcgacagagcaagactccgtctcaaaaaaaaaaaaaaagaaagaaagaaaagaaaagcatttttaagggttatgcaagtaggaattggagagaagaatggatgtattaataaaaggcattctgaggactcaccagtgggattaggacactaatttggtgagaagaacaatggaaaagggaaagttaaagcaggtagaagcctcatggctgagagtataatatacagcattgttcacttagaaaaattcagaggatttgttgggaacacgatgtaaaacagggttagatgtatcagatttaaagcaatgacaattttcacggagtttcatagaaataagctagtgctcagggaagaggtcacagttggaggcttcgtgggttttgaatctcccacataaaggagacatttaaagatgtggagatgaaaaacagctctgtagagagaatgaggagaaagaaaaaaagtctaaagaatgagcctaggaaatggaagaaaaggatttaataacaaccagagagattcagcactccgaaaataataacgataagaatagccgacacttcgtggtcatttgcaacgtgctatgtgttgtgctaagaattttacagatattcactcatttaatccatactgtcattgtcctcagctggaattataacttagttctgtttgacatcagagacaaaacccctgtggtgaaatcccaaataaatctgggaaaaaagggtgtattttttttaagtgattaacagtggaaaatgttgccaaggtcaccagactgaggactgaagaaaagggactgagtggccaggatagtttggaatatagtcacagcagagcagtgaggaagaaagccagatcatggaaaggggttaaagagcaaatggggccaggcgcartggctcacacctgtaatcccagcactttgggagaggcggcgagtggatcactggaggtcaggagttcaagaccwgcctgggaaacatggtgaaaccctgtctctactaaaaatacaaaaaaaattagccagatgtggtggcagtgccttgtaatcccagcttctcaggaggctgaggtgggagaatcacttgaaccctggaggcagaggttgcagtgagctgagattgcaccactgcactccagcctgggtgacagagcgagaccctatcttaaaataaataaataaataataaaaagcaaatgggrggaaacamaagagttgagayagatcattcatttgagaagcttgttaataacaaaagaagttaagataatagttggcagtggcagcagggccaagacaggatttcaaagagggaactgttcatgtttgaagacagtggagaaaaagaaatacaagatgctacaggaaggaaaacaataacagtaaccactatttctggagagtagatttgaaattgggaattcccaggatgccatgggcttgaggtaagcccaccatggaacaggaggaagtcttcctccttcgcattctccctgggaatgtgtcttttctggctgtaagattacttccctgaaagccaacaaatggcattgtgtttacttagagcggttctctgtgatctattaagaattcagataaagaagcagaggtgaagtaacatccctgactcattgtcatttcttctgaaccacctgattctgagagaggaggggccctttacatgttcacaggttatggcttatgaatatggattttcacgggctcttcagatgggtacaaacattcttaatttaagggcactatgcacagctttgactatcattaatccacagcactggctacagatgggtttttagttgtatgaactatatttttcttgggttcagtgaggtggatgattcatggttgatttcttggcttctgactcatcatgaactaagcagccctggttaatgagtcccatagaatgaatggcttctcagccmatgacatgacagtttgtacttcaaagtttccagtgaagcaaactaagaaggaaacttggctatattgataaactctaagtttatattctgcatatcatctattaataaatttgtggagtaaaaacatgtctttttaaagtgtctacaaataagaatagtcctgaatttataaaacactttcatatgcattatttcaaytgatccttttaagtgtttgtgcagatattattctcactcttatttgacagtaggaaattgagtctcagaaaaattgaatgactcacacgaggtcacacagccagttataaaacaaggtttcaagcatttcttgttctgttcactgcaccacatcacctgatctcaggggagtgagcagtaattaaacagagaatcaaaaagatagaggccggcatggtggctcatgcctgtaatcccagcactttgggaagccgagrcaggcagatcacttgaggtcaggaattcaagaccagcctggccaacatggtcaaaccccatctctactgaaaaaaatacaaaaattagctgggcaggtgtggtgacacgtgcttgtagtccctgctacttgggaggctgaggcaggagaatcgtttgaacccaggaggcagaggttgcagtgagctgagattgcgccgctgcactccagcctaggcaccaaagcaagactccatctcaaaaaaaaaaaaaaaaagatagaagaaagacaccccttcccacaaataggaaagaagatgacagagatcagaatctaagagagtgtgagactaaagacgatgaaaattgggccactcattcagcttgtgctgagttgccttgattgtccagcaaataaagggtgaaggcatctcctgaaaatgaaagtctgatggggtcagcttaggtaggtggagaatgatgactgggtaaaacaaaagaagacctttaasgctcaacaacatgcatcaagtccctggatgcaccaggcagcatgctaagcccaaggataaaaagatgaataatacatgatgctggaggaggaattcaaggaactagcaaagagctgcaagaggccaggtgaaagttatcagagaccraatctcaaatttgatgagttagttactgttctttggtaaaagtgaatgaaaattttaaagaatatgaaacttgttgatcargtaagttccaatcatctctctggcacccgttcatttagccaacaaatgtgtattgaaccctgactatgtgccagcatagcataagatagtgggtacatgaagataaacagtgcagctaaatatctaatcagcagatctaaaatatcaataaactccattgttttgccttccttatcaaagatcaaattatagactagtgatataatctgtttattttcattccaatacatcctgcagctgttcttttccaagaggcttatagatttttttgtttatattttaaatccattcacagatgtataaggaagttacttgctatcattgtttttgtgagttttacttcacttattactacaatctatargtctaaggatgcaaattgtctgagtatgttactgttttattgccacaagacatcatttttttcattagtttactgaaatttttcatgactacagattctttttgaaatttgtgataatttggccaggcatggtgtctaygcctgtaatctcagcactttgggaggtggaggcaggcagatcacctgaggtcgggagttcgagaccagcctgaccaacatggagaaaccccacctctactaaaaatacaaaattagccgggagtggtgtcacatgcctgtaatcccagctactcgggaggctgaggcaggagaattgcttgaacccaggaggcggargttgccatgaacttagatcacgccattgcactccagcctgggcaacaagagtgaaactccatctcaaaaaaaagaaaagaaaagaaatttgtcataatttatataagtgatggatagcatttatttctatcctatgtgcacattatatacattacactacatcatagtggtgtttaaagcagggtttcttaacattgacactactggtatcttgagccagataagtcttagttgtgttgagctgtcttttgcattaggatgtttagtgrcatccctggctgtactcattagactccaatagcactgctcatccccacctgtgacaaccaaaattgtcaccagatattgcctaacgtcccccagggtgcaaaatcacacttgatttacaatgactacttcaatttagtcctcacgatatcctacatcaatatttcyttagtaaggaatttgagagtctaccacttgtgaaaagtttcaagagtacagttttcctttgcctgagctcgtaactactaccctttactacttctcatgttgagtcattcmagatatcactgtcccaaaacttcaactaaaaagtaggacttagctttgcctagagttgsttgttgatttttaagtgagaaatgcaagaaaatgcatctggctttagagtgatcaaagagaaagcagctggaagtctactacacctcatcagagacatcattcagacagagcctagttttgggaagacatatctgctcctctacctccccactttccccacatggcctcatcattataatattcttaaatgcacactttgtgtcttagcacagcaacttataagagamaacatttcagagctatgtattgaattgcattaattggaacacacttgctcttcaggtttcatcccaggttcccaattaatccaagaagtagttgcgggattctggatacccaaaactgtattcattacgaggtggtggagagaaaagggaaaagggaagcagtccctctggccttcagaaaagcccaggtctgattggacaaagggtcaaagtacaaacaaagaaaaaaccagaggtcacgagactgagcatgagcaagtaggtgagatcggacatgtgactaacctcaaggcagctagagcctgagctgggccgtctctgcccctcaccaccagtgacctttgggccagcagcccttctggatctcagtttttcatcagttaaaacatacgctttagataaggctgtgatgtttggggcttgtgtattgtctatggagggtgcccaattaccaggaaattaaggcctaagcaaataataccttttcaaactaacagtatctatccatatggcaccttacagtttataatacactttcatattcattatctcattttatccttataatggtctcatgatattggccaggaaattatttttsccatgtaagctgattaaactgaggcttggagaggctggtcagcagtggagttaaaactctagcccacatcttctcaaacacaatgtgtttttccttctgcmccatgatgcctcttacgaaacatgaggaaatatttatcttttcccaatacattccttttttggattttatcatcagcttaagttgcctcattagggatacctttattaagcccctaaatgcaatgggatatacttcttgtgtgttctcaragtatcctgaacttaactcttcgtagcaccaatcactctgatcgttactaatcagtctctactattagattgtaaacatattgagggcagggccgacatcttcttcagtgtttcatccttgatgtccaccacagtgcctgatgataggtgctccataaatatttgttagattaactgaataggaaaactctacataaaatttggagaattcctaaattagccactaggaaagttcaatgtcaaaattttattacagtttcccagtccccaaataatcctgtgaagtaattctgggctcctaagaagacaagtaaattattcgtgttttataaaaaatgattttcatcttcaaactataaaatagagcacattacattgtcagtttcaatccagtaccctcatgggtatactgccacaattttatgactataatattgggtaaatggatagatgaattgctaagccttaaatcaatatgtgtgtactagattttctgttaactagccatcagactcaaagatgtaaatgcttccagcgcacaattatgtaggcaacaccataacttatgattattaatgttttcgctatttttacagggtctaatcagcatgactcaaccatagacttctggttcatttacatactattcacaatgtccaccttctggatcatagttacctttgtaagattttaacttttaaaagatcagaaaaggaaagagaaatttgtatcaagtgatatttggaatgggggggtgcatagcttaaatgtgtaaataattgatactattactttgctatattctttcattattttgaacatccttaaataaacgaaggagaggggatcacagaaatgctaagacaatgaaaagggagtagaaactgtttaccaaggtccaaaaagttgtgtttttccttaaaaacatggcaagggtggratggacatggtcattcatgtctgtaatcccagcactttgggaggccgaggcaggtgggtcacttgaggtcaggagttcgagaccagcctggccaatgtggtgaagtgaaaccctgtctctactaaaagtacaaaaattagtgaggcatggtggcacacagctgtagccccagttattcgggaagctgaggcaggagaattgcttgaactggagaggtggaggttgcagtgagccgaggttgcagtgagccaagatcatgccactgcactccagcctgggccaaacagcaagactccatctcaaaaaaaaaaaaaaagaaaagagaaaaaaaacaaggcaaggcaaggcaagagcaaagggcatttagtgagtggcctctgagtacatttcagtcaaagtgcaattttatatgtaaatcaatcattgatcttgattttttttttttttttttggaatgtcccatwggattttctggagacggcaggttcacttgcggacaggaattcggcccagcactattaccagctccttcccccagctcatgtccaatgtggatgcagcttacgaagtggctgagaggggcactgcttacttcttcaaaggtaccctacagatccctcaaagaaagaaatggcagggctgcagtgccccattcatttggcatatctagccytgccagcatttttccagtcatcatggagcacatttcagttgctctttgtcctcargttgggtatgaaatgccaccctacatttgttatacccgacattgtgtaacaatggaaatgatggcagtggccctsagaaccaagcctgttaggctagtaaggcactgtgttaggtgatagtgcctagggagctagaaacatggtccctgccacacaggacctctgctcagagtgacagtgtatactctactgacatcctttaataaataaaagccagtgtggaactcagtgggaggtaaacaatacccttacttctatgctgtggtcagaagcagccaggagaggaggacgcctttgacttcaggaggtggacacatataccaatctctggctctagccctttactatttgagtgactttggaaagttatctaatggctctgagctccatttcttcctctgcaaagtgattatagcaatataaaccttgaagrtgcgttgtgacaatggygagccaatggaagttatccagtaggtgataactatcagttttagcttatatgttcttgatactgagggataaggttagaaagcaagtgccaatttaagtaaaaatcatgacatttgcatgtcacttgcccattctctctcgtagatctatgaaggtgaaatgagattataaatgaaggatatcttgaaagacatagtatgttaaatgtaaaacacaattttatcaatgttattgctttcttaaggcataactagggacttttgcctccagggaagtttgaagtcttttactgaactgaatagttagaagcttatatctcttgttrggttatagccatggcaagtatcccataaactaaccccatttaagagccttcatagaaatctttatgagagaagtgcatcaccaagtggtgcagagttttcgtaaactttaatttctgttttcaggtccccactactggataacaagaggattccaaatgcaaggtcctcctcggactatttatgactttggatttccaaggcacgtgcagcaaatagatgctgctgtctacctcagggagccacagaagacccttttctttgtgggagatgaatactacaggtatggcttttttcctttttactrtctatctttatttaatgagaatgattttaaaaagataaaaacccttccacgaaagaatgcaaagcaagtttgcgataggcccrttgactcttctcggccactggggtgcgatttacagatggttgactgtcttcaagatatggaaccatcaaaatgatgagtgaaaccttcattcaataatcccattgtttggtcygtaggacttgacacatcctgatctttcaatgcactcattaaccggacacctagtggcctaaaagcgtagatgcagcatcaccaaatccctaactacccactgagaatgcctgactttgctgttwtgtgascatcaaatgcatcccacaatactccatgatttggggcaaaatggagatggtcctgaccatgggtctctttgaaggatagttctgctggaaggaaaaggccttattgcttagtccttttatccagcctagaatatgaaaatccttcttatccaaaggaaamcatataatttcaattcctgtcctcaggggcttcgtatgagcaagtctgaatcwratgtcatctgtcatccaatcactgcacatagggtyacaccttatcttagctactgagtttctatccttagttgactcatgttgaggaatgagwggagctccttcaaagatcacctctgcctctgcacagctttcctctgttcccagttttctcttttttgcctgtttatctaaamatccgaagagaaamgcamaagcagmttctaagcaggtgacaatgctagacaccttaggctcatgaaagggtsttgaagaaaacaggagagcacccaactttgttccaagagctttcattttattttctatcacgtattttaaataatcatttttgtggtataaaagaaatttcaaaacaaatatttgtcatcttattctatctgattcatattttcttccccaatttggagttgagaaaataatataagtgaggcacataaatatatttcataagaaagcaaatttcttttataaagaaggaattgcaaacaaatatggactctgctgactcttctgggccactgagagccctggaagcattgctcagtgtcatgcggtgtcatgagctgtcacttccagaccagtgtttaagccactagrccagctatttttctctcagaccttcctttttaaaacatgatgacaggaattcacttattaaggccctaatatctgcaagacagagtatgattctctaaagtctttctttaagataaggtggctgtagtcacacagcagatatacaggaagataggtattgagaaatccaattcccctggtgaattttcagagaataaaatcaagagatgcatgtgtaagcacgtctgttggagtatgagggcgtttatgttaggattattcagttaatgttttaaagggtattcacagtgtgattctcaatgggggaattatccactctcccattgtctctcttgcccatttatcacctgatctttggtctaatctaccacccaccagcacctgcagtaaagcatataccttcagccaggctggattgaaacttaacagctaagttaagagatgtgggcagaggttcaaaattctctgtaagttttaggatggggaggtcaaggctctctgattttagtgatgctctttgcccccagagaaaatcgtactgtacctttccaactgggcctctgtgagtgtctactaaggagaagtcttttgtaatctagataaatagattcaccgaaaagttggtctagggcattaactaaaatgttaacaagctcatttttctggttaaggaaggaaaccatcgtaggcacttctaaccttctcaggttacagagggtattaagtgatgtaatgcatgcagacacagatacctagcaaggtctgcatagagcaggtgctcaaaaagagttattcttcagcaacagaacttatatggtaactaacaaataatttcttaacaagttgtgatgcataacaaattgcttaaacctcaatatttctctgagcggcgattcagtcaaaaatctggtcaaagggaatttcctttttaaatactgaaggcccctaacattggactgaaattgctgcttttggcaaaacatagacaatcccttcagcaatggcagtcttctactttacgcactccaacacatacactggtgtatgcaacaaggagtaagacaaccctcacctatagctcaaaagtttagagaaacctattgtactggccctattcataaacacccctgaattctgcacagtgtgctttacagggcctcatatgtgtgacatcttattgtcatatgaagccttctattggtttgaaatttaatttagccactagtatcagagaccccaaaataattgtggcttaaacacatgagggtttgtttttctcatatgtgtaaaaagtctgacagtttagagccagtatggcaggctggtgatcaacagggacccaagttcccttaaacattttgctctgctattcttaacacatacttscattctcgtggttgcctcatgactygaggtggccaggggagctttagtcattatgtccctactgtagaaggatggaactgagaagaaaggacaaaggagataaatgaagttttgtaggtaagcacatggccatactcaaaaatatggaaggtcccaagcctcaagttatggaataagaatttcactacattgacatccactgaaagtgtgttaggtyttatttgtcttagacatttctcaagttcttccttgctcctcatgctagttcagtctgtgacgtaagtaatgtgccaagggaagaaaagtctctrgaaattctgcaagaactcccagagtttggacccagttttagtgaatgaaatgccatgaggaaatgaccgaggaacttcctccacagaggattgaaggttggcttggggccaggttggattaggctctaaaagggaggacccatgtctctgtgtggtagttacttataggggagcagcgcacagaggaccacaatgtcaaatccaaataggaggctctactatgttgatgccgttacatgctacatcagcaaatgacatattggttaaactttgccaactagaaccacttccccttacttttattccttcctattctctttctagcaggccctaatggttccatcagtttttcattttttacattatttccactacctatggctgatttctccttttacatattcttccttgcctaccagtagcagagcagtggctacatcaagggatttctggcagcagggggtgtcaccacctccataattcttcaagatagtcaatgatttctgaattttatgcaaagtgacttgcaaatctgcagatcctaccccttttcaatcatattgcccctctaccctgaatcactctttctgtacagtcagactcggggcatcattgctgcaaagtagaatacgtcttccacattctcttcttcctgaatgcctcagaaatactagaaatagatgtttttatttgaggattttatagtcaccataartaaataaataataagtaataaaaataagatgaaatagggttcaaaaatcttgttttttcatgttttaaattttaaaaaacttatgactaaactaccacattcaacctacatttattagacatattatgtgtcagcctgtgtactagtgacattcaagagaaggtgtagagtttsctggttaagaatgggcagaagtaaaaagtcctagtgttaatcttaactctaccaacaattatctgrcaatttggatcacctttctgtctgtttcatcatctgcaaaatgggggtagaaatagtatacacttcctagaattatggcattgaaagggaaaaatgtgaaatgcctgtcacataataagcattcagctcatgttgggtgttattaatgccstcaacagatcttacagttgagggtaaatatatagataaataactaacagaaatccaagtgccaaaagtgctctgatacaagacttcatgaagatcagtgggtcaaaacaaagaggaaatggccaacttagcaaaattatcaggaaataattcttagaggaagtgatggctgagctccactttgagagttgtgtaggagtttcccagacagagggtgaggtgcgggtgggtggcttccaggcagagaaagcagttgaagcaaatttactgatgcacaaaatagcatgtgagcatggggaaaacctcaaacagttcagtatgactagaatatagactaaaatcagaacgatggcccaaggaaaccaggttacagatcatgtagtgtcaatgyctttctagggagatcagtgtttattctgcagagaagagggacatgttaaataccttccataagggagaaactcaataagattaatgttataaaaataacactcccctagcaatgtgactgaattagagggaaacgagacttgaagccagataaactagttaggccaaaaggcagtggaaagcatactcaaagttctcaaagaaaagactcaaccaagaatcttatatccactagagttatctttcaaaaatgaaggagaaataaagacattcccagagaaacaaaaactgagagaatttgttacttgcagattgcctgaccagagatactaaagaaagttctttaggctgaaagcaagtgagcttagatagcaattcaagcccccacaaaaatccagagagcatcagtagtaagtgtaattatgtaaaagacagtataaatgcatatttcttcttctttattctcttaatttaaaaatggaaaatcaattatattaaacaatgtgcatataattgtataattgtattgttaaggctatgacatgtagaaatatacttgtcaataataatatgaaggaagtaggtgggagcaaaactgtatttggctaaagaaaagacactagatggtaactaaaattcacaggaacaaaagaacagaaccagaaatggcaactaagaaacttaatataacaaaagctgcaaatatatacatcttctcttttctcttctcagcttctttagaagacattaaattatataaaataataattataacaattaatttggggcttcagatgtagatagatacaataggtataacaataataacacagaaggaaggggagagaaatagagttatataggagtaatgtttctatatctcactggaattaatttagtataagtcttaagcagatttttataagttaagatgtatatggcaagccctacatcaaccactaaggaaatcacttaggaaaatacagttaaacaattataaaagaaattaaaatgttacattagaaaatttttactaatgcaaaagaaaacagtgaggatgaatagaggaaccaaaaagacatgagttatacagaaaacaaaaagtaaaatggcaagcataaattcaactttatcaataacattaaatgtgaatagattaaaccgtctaatcaaatggcaaagactgccagattggattgtaaaaaacaagacccacctatatgctgtctacagcagatacattttaggttcaaagatacaaatagattgaaagtaaaagaatggaaaaaatatatcatgcaaatagcaaccataagaaagcttgaatggctatactattatcaggcaaaacagactttgaaataaaaaatgctactagcaataaagaaggacattttataatgacaaaaagtcaatataccatgaagatgtaattataaacatatgtgaatctaacacagggccccaaaaatgtatgaagcagtaattgacagaaatgaagggataagtcaataatgaaacaataatagttaaagatttcaataccccactttcagtaatggatagaacaaccagagagatcaacaaagaataaaagacttgaacaatactgtaaaccaactagacctaacatatatctatagaatgctatacccaaaaagagcagaatacacattcttttcaagtgaacatggaacattccccagaatagactatatgttaggccaccacacaagtctcaacaaatttaaaacaacttaagtcgtacaagtatctcttctgatcacaatagaataaagccagaaatcaataccagaaagacaactagaaaacttacaaatatgtggaaattaaacaacatactattaaacaaccaatgggtcaaagaagaaatcacaagggaaattagaaagtacttagaaataaatgaaaattaaaatacaacataccagaacttatgagatgcagtgaaagcagcactcagagaaaaaaattatagctataaaagcctatayttaaaaaggagaaaaatctcaaatcaataacttcaccttccactttgagataatggaaaatcaagaacatattaaacctaaagcaagaagaaagaaggaaatataaacattataatggaaataaataaaatagatgataaataaacaatttgagaaaaccaacaaaactgaaggttggttctttgagaaaataaacaaaggtgacaaactttctactagattgatcaaataaaaaagaaacaattttttttttttgaggcggagtctkgctctgtcccccaggctggagtacagtggcatgatctcggctcactgcaagctccgcctcccgggttcacaccattctcctgcctcagcctcctgagtagctgagactacaggcacccgccaccatgcccagctaatttttttttgtattttttagtagagatggggtttcaccgtgttagccaggatggtctcgatctcctgacctcgtgatccgcccacctcagcctcacaaaatgctgggattacaggtgtgagccactgtgcccagccaaaagaaaaaatttaaattactaaaatcagaaataaaagaggagacattgctactcaccttacagaaataaaaaaggtcataaaggaatactatgaacaattgtataccaataaattagataaatgaaatggacaaattcmtaagaagacacaatctagtaaaaccgagtcaagaagaaatacacagtctgaatatrcctacaataagaaaagatattaaagcagtaatcaaaaactatccacaaagaaaagcccaggcccagaagggttcactggtaaattctaccaatacattgaaagaagaattaatgtcaatttttttacaaactcctccaaaccttagaaaagaacagaattaataccagtttttcacagacttttccaaaacatagaagagtggaaaacactacctaactcactgaagtcagcattatccttataccaaaaccacacagaaacatgacaaraaaataaagcttcagaccagtatctattgtgaatatggctacaaagatcctccaaaaacaccaacaacctaaatccagcaacgtatgaaaagaattatacaccaagaccaagtaggatttgtcccaggaattcatccaaaaatcaattaatgtaatgtcccatatcaatagaataaaaacaaaaatcatatgatcatctcagtagatacagtaaaagcatttggcaaaattcaacattatttcatgataaaaaaacattyagcaacctaggaataaaacctaggaataaaaataaccgttttcaaatcaataaagagcgtctatgaaaacccacagctgatggcatagtcagtggtgaaagactggatgcattcctcctaacatcaaaaacaaaacaaaaatttctgctctcatctctccattcacattgtactggaggtcctaaccaagagaattaagcaagaacgaatgaaataaaaattatccagataggagagaaagtaaaactatttctttttgcatatggtattatcttttatatagaaaaaccctasagaatactctaaaaaaacttttagaactaataaatgagttcagaaaggttgcaaggaatgaattcaatgtgttaatcaattgtgtttttatacacctgaacaaacaatttgaaaatgaaattaagaaagcaattccaactggaatagcatcaaaaagagtcaaatacttaaaaataaatttaacaaaagaaatggaaaatgttgttttgtagtctgaaaactacaaaacattgttgaaagaaattaagcaagatctaaatggagtgatatctcatgttcatggatgaggatatttttaagatgatagtagtccccaaattgatctgtagattcaacacaatctctttcagaataccactggtttctttgtagaaattgacaagtttttcttgaaactcgaaactcacgggcctagaatagccaaaatatctttaaaaagaacaaagttggaggattcatacttcccaatttcaaaagttactacaaagaaacagtaactaagactgtgatatttgcataaggatagccatacatgttaatagaataaaatttagagtaaggaaataaagccatgtatctatgggcaactgatttttgacaacgatataaagtcattcaaaggagaaaaatggtatcttcaacaaatgatgctggaaggagtggatagccrcatgcaaaagaatggacttagaccccaacctctcaacatatacaaaaattaactcaaaattgatcaaattccttaaatataagagctaatctgacaaaactcttaaaagaaaatgtaagataaatcttcgtgatcttggatttagcaatgaatactcagatacaacatgaaaagcataagccaaaaagaaaaaaaggacaagttggayttactcaaaattaaaaacttttctgcttcacagtacactatcaacaaagtaaaaagacaacccagggaatgggaagaaatgtttgtaagtcatatatctgataaagaacttgtgtctagaatatataaacgactattcaattaataacaagaaaaataactcagttaaaatatgggcaaaggatctgaatagccatttctccaacaaagatatacaaatggccaataagcacatgaaaagatgctcaacatcaatagtcatgaggaaaatgcaaatgaaacccgcagtgaaatacttcttcacacctactagaatgccataatcaaaaagtcagataataataagtgttggtgagaatatggagaaatcagaaccctcatacattggtagtagaaatgtaaattagtatagccactttggaaagcagtctcctgctcctcaaaaaattgaacatagaattatcatttgacccagaattccactttcttgaggatatacccaagagaagtaaaaacataagtccacataatagctgtatacaaatattcatagcagcattattaataatagacgaatgctggaaacaacccaaatctccatcaagtgttgaatggatatataaaatgtgataaattcatacaatggaatattatttggccacaaaaatgaatgaaatgctggtacatggtacgacatggatgaatcttgagagcattatactaartgaaagatgtcagtcatgaaaatctgcatattgtataaaatgtccataataggcaagttaaaacagacagaaagtagatagtgattgtctaggtctggttgagatgggggatgaggatgtggagtatggggacttacagtgaaaaggcataaggtttttgtgggggcgggtgatggcaacattctaaaattgattgtgttgatggtagcacaattctgtgactatagtcatgcatcgcttgcttaacaatggggctgtgttctgaggaatgtgtcattaggtgatttggtcaatcagtgaacatcctagagtgtacttacacaaacctagatggtattgcttactacccacttaggctatatggtataccctgttgctcctatagctcctacagacctatacaacatgatactgtactgaatactgtaggcaawtgtgatacaatggtaagtatttgtgtatctaaacttagaaatggtacagtaaaaatacagtgttataatcttatgggaccactatcatgtacatggtctgtcatttcctgaaatgtcaacatatggcaaatgactgtgcactaaaaaaccactgaattgtttaaataagagagagaactattgcaagaattctgccagagatgatgggtttgggagttggggtagatttgattgttcttcaaacagtagaaaacataggtctggatgactgactagttgggggtcatttccttaataaatgggttttcaattttggcatttatcaagacagtaaacttaagaaatgaagcagatttaggggaacaagaagcagcttcaatttgtacatatggagtttgacatgctggtgagaactgagaagaaaaatatcagaagagatttggacatacaggtcttgaactcaagagcagtcaggctggaaagataagtttggaattcatcatgtaatcagatggtgattgaggccatgtgaggatataagactgcccaggaagatggggtccaaggacagcatgtgatgtttgttatagaaaacacagaatgtatgaaaaggaaagaaattcttcaatggtcaacacttgcaacatcttttgatactcatttaatatttttcttctatttttttcctgcagttttccccatttttaagtaattatgtatgaaattttgtgtcctgacattcttctacttaatactataggatacatatttttctatgttgttacaaattatttgtcccagaatctcctcactatcattttcctcatggggtcctgtttcctgaccctcatctgggattgtacatggcagcttcctcctctcctgccttctcttcattcccgatcactgtcctacctgcccttctctagtatagatcacaaagsccacttcattcatgaaagtcatgtgatttctggctgaaatcattaacttcaaaatggaatttcagatttctatttcattgtccctcctgacccacactggaaaggtcaccttgagaaaacttcctgaaaccatcttagaaaccttatcagtaaattcccctttttgccgccctttcttgcattctctttaagcatcctttagctgactcagttccccatttagtgcttctaagagggtagaatggagtcagttatgcccttgacakgtgactgaaatcagcacaatcaaaacaccaaaaatacctaacaaatctaagttctaagcatgcagattaggttaaacaaaaatgcaggcactttatcaaaacagtccctgagtccttagaatacaaatgtggagagtaagataacrtatctgaaaaactacatcagatatctgttgcaggcaatgatttatttaatatatattaaatgtaaataccttgaatcaatattaaatgatgtaacaaatgcccacaaaggaaataaacataattcagatcactatttctagtttggtatttaggtttcacaaacaagacctcagtgatgagaggatatatgcaatgattttagcagatactcaagatatagttgattctcaataaaaattgtatttatttccttaatattgaaattcagttactatttyttgatggctggcttactgtgtgccaggaatcatgctgagcgttttctcatattctctcattgtcccatccacctttcaacaatcttgagaagtaggtatttcttttattttcattgaacattgtgtctctgaggggttacatgattcactcaagatcacacagctacagtggtccatctgaagctgtatttcatgtcctctgaattcaaattcagtgggccttcccaaccaccacatattttcattcttcaattctcttcatcatttatttattattggtaaaaatccccgtgatcttcatcctatcatataatctccttttctgttactctctcagtaaaatcctcaccacaccagcagacctacttcatcttaatcccctctctgacttggttctctggactgcctccaacactttttagccctcctttttcaccccttctcaaccttgcctaccaccgcaaatattatcttgtaaagtaagtttaaagattaaactccttagtgacttagaatctcagatcaaaccatgaagttcactcaaccttacactgacaagtcagagttaattgttcttggggccagaataaatgacaaagactgctggcttgggcctactcttggtgctacatgtgccaggtgtgtgtgtgtgtgtgtgtgtggtgtgtgcgtgtgcatgtgtgtgtgtgtaaattgtctcttaccctcatgaccaatgttttccagatgagaaaaaccagggctcagagctcaaagtacgttttcctgatcacggagtcagcaggtaacagagtcagaaattcaaacccagtaccatcagactgtatctgttgagctctttggactataacagaaatccttaaatatctgtccacaaacaaagggctagatcatcacaaagttctcaccagttcacasctaaataaggacagcacaatattataaatcagggagctgcagtctgtgtcagcataaaaacagattattggcgagaaccatcttttattctcagtttatgtccttcctgcctttttggtgttaacgtttctttgtctttgtgaaatgagtgtgaaaacaggtggtagtagttcttttgatggttaaatggtaatgtycttacttagtaaaatgaaaagtaggtaacctcgtgtttgttatgcaggcccctgcataatgtctacacataaggtccacatgaaatattaatggttatagttaatatggataatatgctgggacagttagcttccacccctagctccaaacattctgtaaagcagctcagacttgcacttagtttcagcctgagtacatctttttcaatgtttgcctttggctcaacatcactagagagttatccctggcctgtgtagtcatagccacacaagagggacatttcaagagatggtgggtggatctgctgccacaggaaatttttcagtagcccaggcactgggagaaattgtctgaccttttggtgggaaaggagtggggtgtccacctgggagtgtccccatttggaactctgtgctaatgaagaagggactttctcaaactttaaatgaagtctgattctcatacaagtcatgctgactcacacagtcacagtcttttttaacaatgagtagtttagatcacaaagagatatattaatcaatcttcagagttatcattgaatgctggttgctgatccagaaaaagaaatcaggtctactattcagtcagtcatataagctttccaggaaacaaaagcaatggaattcaagtaaattggtttaaaaggcagaagttcaattattacatatttacttgcttcttatttacttattgttcacacatttctttattcattcagtgtgcattatttgttcaaccctttctccatggatacatagcactaagttcatgaataaaagcacctatgaaaggctttcaatgatttgatgaaccaaggaattgatagagaaataattacaacaataaataaggcaataaaaaatatagagagttcctttcaaatggcaagtttttttttgagttaacagaacatgttgctataatatatagaatgaatatttctaaacaatgtatgtggaaactttttggagactgctttaagcaagtgacttccaagcttgtggtaccagaatctcaggaacatgggagcatagtgataaaggtctataatctcttttaggtattttaagagcccgatttaaacaacaagggccaggcccagtggcttattcctgtaatcccagcactttgggaggctgaggtgtgggaggattkcttgagaccaggagtttgagaccagcctgggcaacatggcaagaccctgtctttataaaaaataaaaattagccagggtgtggtggtacatgcctgtagtcccagctactcaggaggctgagacaggaggatcgcttgagcctggaaggtcaaggcagtggtgagccatgatggcaccactacacttcagcctgggcaacagtgagaccccatctcaaaaaaaaaacaaaaacacaacaaagaaaaaataaataacaacataaatgcatgtgtatgtgtatgtgaaacagagagagagaggaacacctaaataagttatgtgtccatakgcctgaccagtatagtgtcatctacaaccagtaaaaacctcttagtaatattatttatgaaataatactttttctagctacgacgaaaggaaaaggaaaatggaaaaagactatccaaagaatactgaagaagaattttcaggagtaaatggccaaatcgatgctgctgtagaattaaatggtaagtgtttccactgaaaactttcttcatgaaaactatcataagaaatcttggctttgctttaacacaacagaaagtggatttccaagtgggagtccttggtttttatatttggtcttaggtcctttcataagtttatctaaacagattgtccactagaaagagtaactgtaaaagttctggtattttagttctctctttcctaatggaaagtttttgtttgtttgtttgtttgtttttktttttttgtgtgtgtgtgttgttttttgtttttgttttttgttttttgttttttgttttttttgagacggagtctcgctctgtggccaggctggactgcagtggcgcgatctctgctcactgcaacttctgcctcccagattcgagcgattctcctacctcagcctcccragtagctgggactacaggcgctggccaccaggcccagctaatgtttgtatttttagtggagatggagtttcaccatgttkgccacctaatggaaagtttttaaagtatagcttcaatcgattagtcagctagatcataaagtctaccggggtcaagattaccttttctatctttaaaatacacatagtcttggttgggcacagtgacacacacctgtaattccagcactttgggaggatgaggtggtaggatcacttcagcccaggaattcaataccagcttgggcaatatggcaaaactctgtctctacaaaaaagttagctgagaatgatggcacacacctgtagtcccagctactcaggatgctgagatgggaggattacttgagctcaggaggtcgaggctgcggtgaactgtgattgcaccactgcactctagcctgggcaacagagtgataccctgtctcaaaaaaaaaaaaaaatctgtctcaagcttctcagtgctttttcccactccatcatccaactcctgcaatttaacacatagctaggaaagttgaatagaactttgttgaatacatttaattaaatcttctgaagtagtcagttagcacactcttcttgaaaaaatagcacagggctggacactgttcagaagtgcaaagaccattccagatgtggccactgctctcacagaatggttcacccaacacagatgaaatgactggaaaacagacaatctataatttagtgttgagtcatgtggtagactgcacaataattgcaagagctgatctgagaattaaaatatcagaatcggcagcagtcattggaaattttatagtaggacttcagatgggttttgaagattggccggaggcttaactagggaaagaaaaggggagtggcttcctggaggagagcagcctgagcagaagcacagtacayaactgagcatggcacattggatgaccccaacaagaaggccttaccccggctggaacaaggagaaagctcagaaatgactgagaagttcaggagtcaggttctagggcatgaagacagaagacaagctaactgccacctgacaaattcacaattccyctttggtgacactttaagaaagtgacagtgacaaattcttccatttatatatgtgctggacatcttcagtaacccaatttcaactttgtctcttttaggctacatttacttcttttcaggaccaaaaacatacaagtatgacacagagaaggaagatgtggttagtgtggtgaaatctagttcctggattggttgctaaatagaaaagcctagtcttctcaagcaatgaggatgactacaagcagcctctaactggatcttaaggactaaagcagaatgtaggagagggattcttccaaaggccttcaaatcaaattagaattcactgagaataataatacttccaatttttttcatagttgtataatcagaatttcaatccacattagaaaagtttttatatgggcaactttatgcgaaatccaaatcaacacaatgcactctgcagttagacaccattattttttcttacctaatatactgaagcagattgatccgtttgatttttatttccaggaggaagactagtggtggattccatgacatatattgtaattcttttcataggaaatgtcattacagtatgaattataattatttacaagcaatggcttttgtggccatcwtttggccatcatttgttataataaatataaatttcccaatttttacttaaaagacatcacaacaaaatactgcataagagtggtttcttgtgtgtttaactttgtgtctactcactggtatctgatgtaggcttaggtggataaacctattcaaacaaattttcatagtaggcaagagatgggcactttgcaacagaaaaattttttaacaatagctaataaaatgttttaatagaacagttcctcatttcttttttctgttaatatttactagcttctataatactttaattggctacccacacatcctgtgtacctatagaaaaattaaaccgtaagataacatcataagtacacagacccggaaagaaataacagtaactcattctacttcctgcttcctgaaaacagcctcagtgaaactatcttttacccagctaagtgagtgtcttttgaatagtcttccattcaggggagttcatctttttgttttagtttttcttacgtcaagctaaacctttttcccctacctagtcatcagaatagataaaactatggctctgtcattcttataattttgctttaatcttactctctagaatgtaaagattctaaaatattttagtgattctaaaattgaatgataagatacttgtaatacttcatagacctcctgatacatctacagtgtttaacagatgctactattgttaccatcatttattaaatttgtttcatatagtcacttaaaagacctaatattaagaaaggatggggtagttactcaagattattctacactttccatttggtttctgttactgaaagtggccacttatagtccaccagatgttgaatatttgttgaagacaaggtctggcatccttgccttctaatgtcaaggtgcttctatagaggagaaaagtcacttttgcaaaaactgctaagaaggacttcttactatcaataagcaaggagaaaaacaggctggcaatttcttaaaatatttaacgtagacttaccctatgacacagcaatttcactcctaagtatatacctatgagaaattaaaacatgtctacacaaaaaacttgcacataaatgttcatagcatcgttatttataatagccaaagagtggaaaaatgtccattgagtaatgaatgaatacgtaaaatgtggcaaattcagacaacagaatgttattcgacaataagcagaaatgaagtcctaacacatgctgtaacatggatgaagcttgaaaacatcatgctaaatgaaagaagccagacagaaaaggtcacatattgtatgattctatttatatgaaatgttcacaataaaaaaatctatggagacataaagcggaccagtgcttgtcagtagttgggggagggggttataaggagtgactactaatgggtatggggttcttttttttgggataatgaaaatgttctaaaactgatgatggtgatggttgcacaactctgtgaatatattaaaagccattaaattgtacactttacatgagtgaattatatgttatgttaactatatcttgataaagctgttacattaaaaaaaagaaggagatcaaagtagtgtgatgatccatggaggtcaygcattctggcaactgtgtcagggaccacatgacaatgaagcaccagcctgaggacatccagtgctgcacgcaaccagccagatgtcctcctcatgtccagcactagcccagaatcgtgcatacagaagacacttcactagtcaatgaattcactgaaagcaataaagcatatgctctcaggtctgactgatggattcaaactccagatcttctattttcaactgtgtgatgttgaccaaattccctcatcctcattctctgtctcagtgtcttcctttataaaattggaataatggcagtttttatctcctaaggatatttagagccttaaatatatgagtcaaaatatgcaaagtagtccctggcactctacaggggctctataattgttgtttttgaagccattagagttcattttgtttggtgatattttggagaatttgtatatgtcccttgagatagctaaacatctgatgagctataatatcacaagaattgataatcaatgacctgaaatttttctcttccaaatgtcaaattaaatcaaataattaaaaatactatgtttatcccccatctccaaaaaataattcttataaatcattattttttgttgagttaaagaattcttggcttttaggccaggcataggggcttacacctgtagtcctaacactttgggaggccaaggtggatggatcacttgagctcaggagtttgagaccagcctgggaaagatggtgagaccctgtctctactaaaaatacaaaaaattagctaggcatggtggcgcatgcctgtggtcccagctacttggaaggaggtgggctgaggtgggaggaccacttgagcccaggggtcagaggttgcagtgagctgagattgtgccactgcaccagcctgggtgacagagcaagaccctgtcttaagaagaaagctctttgctctcagatataaaattagtatgtattttggaaaaatacagtctctctaaagcacaagaaggtgtgattgtgtcataacacagagcacttatcctcatatgatacaagaacgttgtgcagaaataatttataacataaactactcatttgacttcagagtaactgagtgcaaacatgacttattaaataacagttttggacaaagtgtggttgaagtactcccttgaggatcacgaggtagcaaaacagagttcacttcctgatgaattctatgcattatcctattaatctcagtgatgactctttgtgggctgaacctttgaaagcactacacaggctactaaggatgaatggattcacctccttggggagctttcctaacagctccatattaaattttctctggtataaaccaagccctcttccatttagcctagtcctaaatgaaagacctaagtttgcctttgggtcttctgtttcttttcaaatgtttattgcaaaacaccttagatgtccatttcacaaagcaaatggcaaaaaaactatgcagtttttcattcagaattctgtgtataatatttttaaatgctcacagggtcttcagggtgcttttatttatatattatccagatgtttttctttattcctgttagttatttttcttctacagacaatgatattgaaggttctttgtgaatattcatagctaaaattacccaatgaagtgccatttgagaggaaatgcatactgctggccaataggttggtgttttagactaccataatggagcttagaagagtccaagccaaaagatcgtcggcatttctccccagtaggtctgggtaaaaagtagaaacagcatcttctgatcatctgtcatctgccaagtctcctgtctttggtctcattccaatccctacatggcttgtcaacacgatcagtttaaaaggtatcctgttatactcaaaatgtcataatttcaggtttgctcccaacacctagacccttggaattgaactagaagcagaattgggaagcttgctggtaaataaattacaatgggaaattagtgaatggctttgggatccaaaataggactctttttttttttaatgcaacatctcttcattttaatgtcttctccattagtcttaacattctttcctttaatctaatgtatcatttaacatgtttggagatgaaagtaaacttttgttgcacaatgcagcatgttgttctgacaagagtttgaggagagatgagaagagaaaacatgggagggagttaatgagaaaacaattgcaaaacatcagttaagaaatgtaacgcttaagtccatctcagatcatttgcagtgaatgtccataaaaaaaagaatgtctgtataaatagttagcaatttgtttattcttggaaagtcccaggtctgtaatgcagtgataaacaatgtgagtttttgagttgggtattaaatgtgtttacagctgcctctatagagaatggatgtcaaaagtcccattacagcccattccacttgaactgcagactgctcaatgattgtagcatgtcactttgccagattttaaatgtatttccatatatgaatcagcaatttctgtgagtaattttatcagtggtttcttttgaaatgcttaatttctaaaattagttcatctttacaaacagccaattcagcctttttgaaggatctagctacccccccatctctatccttaatattcactctcaattcactagaaaataattactaagcgcctactttgtgctggcaccaacctatgctcagctgctttcttgcataaactcctgccctcaaggagcttacattccattaaagagacacacaatattcaaatgaatagagatctataatgaaagatagtgaaagtgctttgaaaaaataaataaagcagtgcaagtaataaagaacgttggagtgccattttataaaaatatgtttaggaaaaggacatactgggtccagggtattcatgcagaataactaaagggagggaggaagctgtggaagtctctagaagtttcaggtagaagaagcaataagcgcaagaccttgaggtaggtaggaaggatctgcacctgttttaggcacaccaggaaggccagtgtggctggagacagtgagggagaaggaaagtagaaacagatcagatcagagaagcagctaaccaagctatggaagccttgcgggtccctgtgataagaagggttttcagcaggttcataacatgatctgactgctgagtagcaaacagattataaaagcacatgatggattcagggacactagacagtgccatttgccagggtaaaaatgatggtggcactgaccaaagaagtggcagtgaaaatgctaagattgtcagattgaggaatattttcaaggtaaagccaacagtatttgtatctaaagtgcatgcagaatttaataaaaagagaaggatccacaatgactccaacgtttttggcctaaacaagtgaaagagtagtggtgaaatggaaagaccaaagtaagagcaggtttacgggggctggaggtcaagagtgtaattttgaattcattgagtttgagatgcctattacacatccaaggggaaatgtccatacataaaaagcttaagtaggtagatagatataaaaagcttgagttcaaggaagagtttgagacccaatagaaatttaggacttaagccttaaattgttatctacattccttttgatttcctccacattctatgtggaatttaggacaacgtaaatcattaaaatataagaaggcaggtgaaaaatgatctcaagattttaattattgtccggtgttagtaagcgcatcctttcccacctcaagaacatagtttagttttcaacaaaagttgcacactttttttgaagtttttgttttttagtcttcatttttctatttcttgtttccaaaatcaaagaagaaatcagaaaagaaaatataaaatcttcaagattgttctgaatgaaagttgttgaaaatcttaaggattgttcttcaggaactaacaagatcctatgctaataagtattacttattaatacagtaataagtagcctaagaacttattaatactttaataagtagcttaggaacttactaagaaggataaaagaatttttgagatttaaaaacatctgttttattcttacagtaaaaacagttctgtttgttatctcatcacgtcctatagagaaagtgagtagcaagttcccttaataaagttttcaaataaggcagttttttcaattaattttttaattaacttctaatttaattgcattatagtttgagaatgtggtctgaatgatacaagcttttttaaatttgttgagacttacctaaatttgtcttttgacttaccatatgattacaaatttttgtaaatgctgtgtgttcagatatacgttttcagtaagtgaattttcttttgc

SEQ ID NO: 12422 - DNA, 32572 bp, Homo sapiens
aaactcagatcatactcctggcccatttaagagatggttatcaaattccaattaaatagagaagtgggtatatttcaaagtgtatcgtacagttcttgtgtaatcaccctcctgttcctccctgaaaatctggcaggtgtatggggtggtggccacgaggctgcagggacatttgcccaggatgaaacagttcccagtgaaagggtcatgttggtcagggttcagcccctctcaaaacccttctgcctggggtaaagcagaaaagtccgccagcaatccgacagcacgccttcttagccacgggactgtggctgagcagtgggcttaggccccttccctctaagtgttaccaataatcctgcactgggatggattcttaacagaggtggggattaacagagctggagctctggaccagcaatctcagttcctctgatagtgagcgaagaattgcagactaacaccaaaatgcaagctcaaggcaaagtgtattgaagcacagtaatatactctcagagggagagcggaatgatttctgcgaagtgaaataagcccctctttacagggtttaaggtgcttttatggggtttgtggggaggagtcaaggtttgggttgtgtctgagtaacaggatgatgtcatttgattggcagtttatggttatataactaaaattaaactggcatggttttacccatcatttataaagaaaagcccactctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtatgtttgcattttttgttgtcagtgactaagctgacacataattgggtggaaaatagggtacaagtgtgattgcaagccttggaaatattaggaaaaaatccaagtaatggcctcatcctcaatgaagatagaagacaaaggagtgcttagtcagatagtattacagatagacgacaggtcctcggaggttgtaacaggtttgttggtatagacttttaaggagtatgcaattgactgtgggctcgaccctaggattgacagcttattctggtcggttaacagaagtgggggctggaaatgtttctgattgattccactcagaagcaggaatggaaatggctgatagacctctgctagggaaggtgtaaacacagattcaacagtttctgtgatgttgtgcagtccgttgatgttgtgtttaaacaaggttttaaaacttctttgatggtagctaaatatgggtgttggaaaaaaacattaggagaaatgattgcaagggttaatctagtttaaaaagcaaaaatattggttactgcatttaaaacagctattttagcataaaaaattatttcacccattcaggaggaggcaattgaactgcaaatatatgagaataactataacaatccaacttaaagctaatatttaaaaaaaggcactagggaaagtcagtgggcattacttattttttggcagtcttttaaagagaggcttgaggtccactaaagtctcacaagtgtatttgtctgtggagacatcatcagtttgggcagccctctgtggttttacataggagtgtggatgcagctggcaatccagaatacacagcactgagatcaaggtagtctcgacatcccaatatccttgaccattaccaggagagagtgtcccctgctctttagatggaggctccgcctcccctggggcagtctgtgtgtctctcaagttgtacctatgtgtggaccatggctgtgcccagcatggagaccccttcctacagtgggtactacagccttgctgaaaacatttgtcccctagattctgaataaaagtggttagaaagaaagaaaagaaatgaagctctgttcaaaagaaaaaggaaaaaaaattgcaaaacgatcttcagaagctgtgctgctgcctatggcagtgtggcagggagggggcctcgggtggggtgagtgcccaaaagggtgggcraggacgatttggggagttctccaaaggttatgacccactatgggcctacccttcgttcccggctgtaaacctctaaacttagcatttatccaagctatcccatgatctgaatcccaatcggctctcttaatcagtaattttaaaaattgcatccagccaaaatgcccagtctaaagggagttgagggtgattcctggctctgtggccagagcataagaaaccattttgcctctcaaagcttccctgggctgttaacaagctctgggcttcaatggccactacaacctaatgaagttgtttaatcacgttaaacagctaattaaacctaaatccagagaagatttctctaagcccttctctaaaagttattggtggcatgttgggggatataccccctctctaatgcagcaaatacaacactcattgcaacttctcttagccaagcagcgaaacatagcacaaacatcttgacccaaagcgaaaggaagcattttagcaaaatatgtttcagttccccaagctaaaatcaagcacatattaaaagccatgctgaacgtaaatcatccaggtcacagcactaagatattaccaggaattctgcgctgggatggatcctttaactgaggagattaacagagctggagttctggaccagtaatctcagttcttctgagagtgagcaaacaattgcaggctaactccaaaatgcaagctcaaagcaaagtgtattgaagcacagttagacactctcagagggacagtgggctaatttctgtgaagtgaagtcagcccctctatatagagtttaaggtgcttctgtgcggtttgtggagagaagttgaggttggggctgtgtctgagtaaaggacgatgtcatctgattggcagtttatggttatataactaaaattaggcaatgcatgtttttacccataattttcacagaaaagcccactctggggcttttgtataataaaaccacattttattataatgatggtataatgaacttggggtgacctgagggcacagtttcatgttactgggcatgtgcccctttagggaatttccacctgtgccctagtttctctttcttcaggatgtgctggccacaaactataccaccaacttcatcagttaggggggtcttagaatggctctggggctgaacttaggtgggccaggagctgttgcagtgacaggctttctgctctcttttctcctcccagctgctaatgtctacttaactgcctgttgggagctgaaaaggccaaagggattgtgaccaactcagcatttcactggaggctatatgatcaaacagcaaactgtttatcatgaatgcgggatgtgggtaaactcacactgcacccgccgccagaaggtttcctgagggccatcactccctggtgctgggctccttgaagttatctgttgggatatctagcacctattatttgaaggatgcagtcttgcaagcctgctgtgaaccaaacggctgactgacaattacctgacaatcaccccccacctttttctcgtcatctcttttacctaataaactcagagagcttgaaaagctcagagcccttgttcactagaagcaaggaaccccctgaccccttcttcctaatatactcttttgtctttgtcttttactcccacatccaccccccactttgttcagtcaacctgggactgtggccaattacaacagcctaacaaaagtgccacaggagtggaacatggggcagtgggctctgctgaagaggatgctagggggcttctcaggggaggaaatgctagatttgcattctgatagaggagcgtgacttttccaggtgaaggtagcaggtgctcctggcagaagaacccacataaggaagtgtccagaagccacacaggtatggcgttcgacaagagcaggtctggaacggtggctcatgctgaggcaggaggatcatttgaggccagagtttgaaaccaacctggtaaaaatagtaagatttcaccccttcaaaatcattttttaaaagtagccaggccgagtggctcatgcttgtagtcccagctactcaggaggttcatttgaaccctggaatttgaggctacagtgagctattattgtgccaccgcactccagcctgggtgacagagccagaccccatctcaaaaacaaaacaaaacaaaacaacaaaataaccccaacagcaatacaatcaatatgcaataagcgtccacccggcatgtgtgatggactgtggtaatgctgatggcatggagggagtgaggtgggcatctggggagtgtggtgttattgggggtggggagtaatctggagggtctcatagtctttcagtggtaggtctttcttcctgaagacacagcaaacccccaaccctaagtatgggaggcaggtgggttggccaagaaggacgtctggggctgctcttggatcagcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttggtaagttaggggtggtctgaccttccccatctccccatcctcacagcagctctataagagaagggtcattcaccttttgtagatgagctcagagaggttaggtaactgactgaggtcacatctcggtccatggcagagcctgaatttgcacccaggttttagctggacttctccctccctctctctgggcccccaaacagtagagacagaggcagaatcagctcagctgggttcacaaagcttcctagggctcagctctagttccagcctgcgtgagacatggcccggtgaccccagaaggaaggcagatgttgggactgtccattcctttagaatatttggaggaaccagagaaggtggaggacaggaggtgatccagagcctggcctgtccttcttgtggcctggccaccctgaggctggccccagggtgctgctgctgaggcccgatggggacagaggatttcctttgagatacaaggaacctggctgggcgcggtggctcatgcctgtaatcccagcactttgagaggccgagacgggtagatcacttgaggttaggagttcgagacctgcctggccaatatggagaaaccctgcctctactaaaaatacaaaaaattagctgggcgtggtggcacaagccagtaatcccagctacttgggaggctgaggcatgagaatcacttgaacccaggtgatgaaggttgcagtgagtcgagatcgcaccagtcactccagcctgagtgcactcctgacagagtgagactctgtctcaaaaaaaaaaaagagagagagagcgaaaagagataacaaggaacccagaggttgtttcacccaccctgactctgagcacctacttgagccaggccctgtgggtaaactgaggccatgggagatgagtgactcgctgagggtcccatrtcaggaagttgagcaggtagatcacaggactccatgtccctgacactcacctggttccttttcaggcctctgggtgatagagaagaaagaagctgtgctgttccctagtgggaaagatggcccagacaggggcagtgagaacggcatgttgcagaatggtgtctgccacatgatcccagcttgacaatcatgagattaaaagtcaaactgtggaagcgtgagcataactgtgggagcgtgagcttagccctctgtgtttgtagaagcagaaacaaacctggaagattttggattattaacattatactttcttgcttcaatstcagagtcaggaggtcaggtgttgaccttccccctgccctccaagaggtgtgtgacactggggaagtcacttcccctctctgagcctcagggtttttcacctgccwkagggggttaggatgccctaccctgctgacycccagcaggctgctgaccccatctggggtgaggtgggaggcggggcagtgcgagtcaggggaaagttgacattgcagcccagatgcctgcaggggctgcaggaaagtggggagagctggaggcctgcatgggcttctcagatccaggtgatgcccagcaggtgagagggtgggcctggctcctcagagctcagatgacggaacatttgctataaactcaggtgcaattacatttgacatgctggcaaccaaataaaaggcaaaccttgcatatgccacacacacactcacaaattcacacacacacacacacacacacacgcacactcacacctgctattcagatttcacttcatggagccctgtgtttctcacctctgtgtcgtggcctcgaagggtctttgattctgtgcagcttcttttcctcctcatttctttaagggaggcatcgcattcattagtcttttttttctgayggagtcttgctctgtcgcccaggctggagtgcaagtagcaccatcggctcactgcaccctccgcctcctgggttcaagtgattctccagctcaccctcctgagtagctgggactacagaggcgtgccaccacgcccggctaatttttagtatttttagtagagacggggtttcaccatgttagccaggatgttctcgatctcctgaccttgtgatccacccacctccgccacccaaagtgctgggattacaggcatgagccaccgtgccagrcgcattccttagtcttaatgggcatagtgttagggacccgcctactccctatggcaggagatttagtgatttctccctttttggtgatagaaacaacgctgcatggcaccctctaaagcccctgtccctgcacacttgccctctgctccctggaggctgagacctaggagtgggtgctgtgccatgacgtgggggcactttgtaaagtgtgctgagtatcgctgacgatcctccaggacaccagaacctttcacactccatcaacagtgaaggggcttgtgccacctttacctccctaacagtggacattattagtcactttaggtttggcttatctaatgtttcaaaaacgtatgtctctgtgatcacttacatatatggttcaaaagtgagcttgagtgccttttcatatggttaacgttaatttctatttcttcagatcctatcttttacccatttttaaattttatttatttatttatttatttatgagatggagtctggctttgttgcccaggctgaagtgcagtggcgcaatctcagctcactgcaacctccacctccggggttcaagcaattctcctgtctcagcctcccaagtagctaggactacaggcgcgtgcctccacacctggcaaattttgatatttttagtagagtcagagtttcaccatattggtcaggctggtctcgaactcctgacctcaggtgatccacccgccttggcctgccaaagtgctgggattacaggtatgagccaccgcacctggctatatttttagaaacttgatttcagtcttttcatgttgatttgagcatttcttgtggattgtggacagttacctttgctttaagtattgcaaaccgtgcttcctattctttcattttattctggctcttgaatgatgttctttctaatttttaatttgtaagaggtaaaactctattcaattttccctttaagtcttctgggaattgagttttgattcgaaaggtcttcccaactcaacattgtttttaacatttcttctagtatagttttaattttttctttctggggtacacttagatccctttgggattgatttacttatttttggagaagaatttgtttcttcttcttttaaatgtaggacctatttcatgggtacctactacagacaaagaagaacaagacttttttgtgtgtattctaaggcacaacaagtgcaggaaggaaatgacctctttcccgtaaaagtccctggcagtagttggttgctgcataagagtgtcatggacccggagggagctgggcccagatgcaggcctgggccattgccgtgggggaggggaggcttggaaaccatggctatgattcagaggttagctggctcgcgtgtttttagaaatttcttttttctttcycctcgtacaaaagtaataagactggggaggacacgggagaaaataaatggaaactcagaaacctgatagagccaccaaaagtacatgaaatcagagtcatggtcttatttgttcttccccaaaaagagatgagcatctagatagcaaggaaaaacattcaatccctcaactgaaagtgaaactgaagctgggccatgttgtccagaggctggttgcttttagtccaagtgctgcctcccacacctcggatttcagccaggctgtgccacggagggcagaggccacccaggtcagtcataggggatgcagctgggaacaccgcagggtccctgccggatgctcagagtttaacggggagacagaggcccaaagagccacacagaggtagagctgcccccggaaagcagagtgctcagggagcctggggagggctgggggacgctgcagggtccaggcagctttggctgagcctctgaggatgggtgacttgcacatggtggggaaggtgggggaggcattccaaggggagggagcagcctgagcaaaggcctgaggctgggaatgggagtggggggagtagatgggctctgggaggcagggaagcagggcgtcagtgtgtacctggacccaaggtgactgtgtgggcagggagcagtgaggaaagtaggagcccgtgtgcccagttaaggggttgaacttgaccctggcaggtcattaaagattcctcaggagacctaggtattgtggctcagggctgtaattcccgtgctaatgcacgraggctaatgcaggaggatccctcgaacccaggagttcaggacaagcctgggcagcatagcacraccccatctctgcaaaaatgaaaataaaaagattgactgacatagtgatgcacttgtagttcccactactcagaaggatgaggcaggaggatcgattgatcctagaacgtcaacactacagtgagttatggtggtgccactgcgttccagcctgggtaacagagcaaaaaaaaaaaatattgaaaataaaaataaagattcctcaggaggagcacggtgtcttcacccctctctccctctctctctgcctaaggaggaggccccacagccacttgcagggagctgctttgctgagagtctctgtcctctgcatctggagagcttggctcagagctgaggcaggagggagggctccctgtctgggcctcctccaggaactaaagtccctttccgggaattgaccaaactgcaggcttgcccagrgaggacatgctgtgtcctagttcagctcgaggggcagtatccagcttcaaccctcagcggatgccccagacaagattccgagccaggccaacaacgcctaaggaggacgagaccctgggtgtagctcatcagaggtgtcaggtgtggtctgaggccccagctctctctgccctcctgctcctctgctctgtgctggctcctggtccttatggctcatgatgttgagacagctgccctggcctagggggtcacacactgaacaaagcaggaagaaggggaaggggagccctccttctatcacccttatcccttacagcaagaagcacccagaaacccctcagcacactcccctagtgcctctattggcctcactgtcaccatggttgcatgggggccccagacaatagacacctggatgcaagatccctaagacagaggcaggaaataggaagagggaggtgagaggctttcgatgaggatgcttctacacatgaccttgagratgaaaacgcatcagggggtcccgggaaccactgcgttgttaacataaagtctgggagcaaagaccagcggctggaatggatgtgcctgggagccagctgaaacagatgcagccgaagccacagtaaagaagaaagagataggggcctgcttggagccaacccctacctttgaggggcctgacagggccacctcacagctgcctgggcttgttgttgcctcctcactacagaaaccatggaagtctctagagtcartgtttccaggctggggctgccagatcactcctgtaggtggttgaaccagttgagttcattcttctcagtgagggggacacaggtggaggtccatcggcacctccataaggggtgcgagaaggaacctgttagaatatctgggttctggctgggtgattggcaggagggcctatgaaatggagcccactctggattgggtgttgcagaaagtggggggcaagtctaccagtgggtatctcagcaaatctcatctagagagagggagaccaggaagaggttagagttgacttggtgtagaaaaaacaggcattctatttagccaggagagggagtgtttggtattttgtgggtggagcagagactcagtttctgtctatacttagacagtattatgaagtctaattgctctgtctcatttgctcacaatctcagagtcaccctgtgtgtggttactattctgtgacattatttctgtccataggagaataacacagcccttctgggagtccacgccagcttccaaatgtctgtggcagctcttccttcattctcaacacttacgaacaggaacataaataaatagaaggaaaaatatccatttatattaagatgctcttcttgttaaaaccaattaacaattaaacattctctgttacgataagtctttgcatttcaagtaccctgttttagccttttctgtatacttttctcaaatgttctcacttgaatgttagtatcaacccaaggcctttcacagattcatcttggaccaagtaaacatgatcataataatcacaatcaattattactrttgaatataagcggtataaaccaaaagtaagattctaagcctccccctcatttmaaggacttcctcctcagccrgggctcttaaaatttaacctgaaagactggttcaggccrtgaagggaaatgggggtcagacatgcttcattatgcctctctggcattaatatcaacacaggctttcagtctaataagaaacattttacagcctgtttctctgtgaagcctgctagctgaaagcttcatctgcaggataaaactttggtctccacaacctcttatcrcaactcaaacattccttcctattgatctccggtctttrgacaaactcaaccaattgtcaaccagaaaacgtttcaatttacctgtagcctggaaacgcccactttgagttgtcccgcctttctagaccaaaccgatgtatttctcaagtgtacttrattgatgtctcatgctccctaagtgtataaaatcaagctacaccccaaccaccttgggcacatgtcatcaggacttcctgaggctgtgtcacaggcatrcgtcctcaaccttggcaaaataaactttctaaattaactgacaccwgtctcagattttccgggttcacagcggttgggactgaccagtgggcatccctttgaacactgctctgaacatctttggaagcgtccttgctttctggggtaacacatatcacagtctggggaatttggttccccacaagacgtcttggttcctttgggtggaaaagaagcccgtatgttgagtggcaaggtgccactggaaattatactgattcaagataggagttcactctgattatgctgttaatattaacagtttaacataaaatgacaacatccgtacttttcttagcagcttggttaccccagccaccgaggtttctctgaagctgacatttctcccatcaggaggcaggtgtatttctctttggcacttgctcacacttctccatcaactttaaggtggtggcaccacaatccaaaccattattgaggttagcagttactaactactataaagtaacttctgttttgttaaaatttaaaaaaatcaattaataagtgtatacggttcagacaaatcatttaataaagagggctccactcactcccttcccaattaaaagcagctaattttgatgttcagattttcctttttttwttttctgagacagaatttcactcttgttgcccaggctggagtgcaatgtagctatcttggctcaccacaaactccacctcctgggttcaagcgattctcctgcctcagcctcctgagtagctgagataacaggcatgcaccaccatgcccggctaattttttcatttttttagtagagacagagttgctccatgttggtcaggctgctctcgaactcccaacctsaggtgatccacccacctcagcttcctaaagtgctgggattacagatgtgaaccagtgtgcctagccagcttttctttagggagtaaatcattttctttacataatattcttatgctagcagatgaaatagagtgagagtgcatgctctggagattgggcacttgagtttggcttctggctgtcactagctaggggctccaggtgaattacttaacttctccaagctttagttttcccctcagaactattaagatgataacagtgcctacgtaggatggttgttgtgagaactaaacgtgagtttatttaactttatttcttatgcccttaactgtagccagtatttcttgactcttcactttacaaaatggccatattaatcctccccctccttccttcagtgtttcacctcccacctttaccatggaacattaattatactgactggtaacaagtagatttagttctcatatgtaaatgttctgttttgttctaaaagttaaaagttaaccaagtgtttacattttggtgacgytttaaatcttgcttactgttgagctgagttgtacaatatggttgcacatgttttgctgcacggctttagtttttcctgatgtttctaattgcctttgttttttccccctcttgtactgtttgccttcatgatttcctcagtttttctcaaactgtgaattatatgcaatgttctatcgagtcccctttccctacagagccctttccttcttattctatcctggactggttgctttctaggcctgctgcatgcccagctgtgatccttgcatttccttctccctgggttgatttttctctttcacgtctttttctctcttggttttccttatcccctctccatgagtgtgcgtgcacacacacacacacactcacattcttcctcctctcagcctccacagctcattctcaagtaactttcttttctgttatttacttgtttttcttttaacagagacagggtcttgctctgtgacctcttgggctcaagagattctccccagtcagcttccagagtagttgggactagaggcatgcatcaccacacctggttcatttttgtattctttgtaatgatggggtgtcactatgtggcccatactggtctagaactcctggactcaaagaattctcctgcttaccctcccaaagtatggggttataggcatgagccaccatgctcagactcaagtagctttctatgtaattattatgtatggtaactttcttattctatatctagctctgtttttgtttttgtttttttctttttctgtcatccttttagttgattttctggaaagcttccttgcctatctttttgaatcttgtcctagagttgtttattttctcaatcaccttttaattctcaagaagtcttttttgttccatcatctttgttccttttcagtacataatgttctcatttatgaataaaacatttttatgtccctgaggacatgggtttgagtttttaaaaattattttctattttcgcaatcatccatttcttctggactcattttttacttgttatcttgaccttttccccattttttgtctttctgctttatctgatcctagatctattcatattaaagaaaggggcaggtccactggcagtcttccctgtagagtgatgaaatgagaactccttggcatcaggatacaaagatattatttctggggcctttagatgcagttatgaagtctctaattttttccattggtgtagactcacggctactgtgaatcctgtatgggtcgtggggctggtgaacttctcccctctctgaggctctgcttagcaggcaattcttggctgaatgtgctcttggtgttgctgtggattgcagatccctttacccctctctattcagttgtcacttcttcagccagttctgtcttccaaatatctgttgaagtctctgatctcctgttttcctcattcaaattttcatatgtatatattttttgagacagagtcccagtctgtcaccagggtggagtgcagtgacccaatctcggctcactgcaacttctgcctcctgggttcaagcgattctcctgcctcagcctcccgggtaactgggattacaggcacacgccaccacgcccagctaatttgtgtgtgtgtgtgtgtgtgcatttttagtagagacagggtttcactatgttggccagcatggtcttgatctcctgacctcgtgatccacctgcctcggtctcccaaattgctgggattaaggcgtgagccaccacaactggtccattcacattttcattggcagcagagggtgcagaggcagtgtgtgtgttcttgagtccgtctggttgggtgggaacccagtctttacaccttagtagatttctgagattgggcaagtcgctgaacatctgtttcagttttcttatctgaaaatggaaatacaaatggtacccacttaataggctcttggaagaggactgtgagttattatttatamcatcttagagcaattagtggtgcaaagtcgagtccacaaatgttcacccctatttctcattgactgttattatacctataagtgccttgactaacactgtagtcagatcttgaagggatagtcaataaatgttcttctaccttcttagaacaatgcctaaacataatcaacatttgctttcttttttctcatttcccaaggcaagatcatcacaagcagaatgtgaagagtgtttctctgtataaagatcagcatttatttaggctggttgtagtggctgatgcctgcaatcgcaggactttggggggctcaggcaggaggattgcttgaaaccaggagttggagaccagctctgggcaacaaagcaagatccacatttctaaaaaaaatttttttttaatgtgcctagcgtggtggtatgtacctgtagggacaactacttgggaagttgaagcagaagcatcacttgcagccaggacatacaggcagaagcaagggggacaaagggtgtccagcacagcaccagtgaattcaccaagacagacacttgggcatagagtgcaagacacagatttggaatgaggagtcatttacartaagcatgtatgcatgagtcaatatttttatatatttaagggagtrgagcccagtcatggaagacatgggatttgaatcagaagtcctggctctacccctattgtgaaaacatggcaaggttgcttaacatttgaggtttcttctgtttcaaaatgggagccacrgttgcacccatctcctggcctgtgtgtgatcatcgaatgaggcacatatgaggagccctgcagatcacagacacccagtacacactggctrttatcaattagttatcacacatgttgccaggcccaggtcattgtcagaacgttccttcccatctctatttcggtgtatagactctgtagtttctgtgattatcagatgtccatcccttcctctgattatcttctcttcatacccctacaggacaaaaggaccctgccttggtgtgagagtgagggcagagggagctggagcaagtagaatttctctaaataccagctggctggggcccaggagattaaaaaacaccgggctaggttggtcttggcatttgctgacacgcaaagggattgcagagatccagcccctccaacctccctctgtccacaggtggctcacattcagtcccacaatttgctttctcctcctcaagggttaagaaaaaaaacgaacccttccagtcaggtcagtgactggagagctccawggaaagtctctcagtgacctggctgctggcaccatggactcaggtaggcttgcttcttcctcttccctggctggttcctactcgcacctagaatggagggtggcgtttccacaactcagtsagccccagaggaacccggatggtcaagcaggccgatgagtcttccctgagccccaaaagaggccacatggagtcccccgacccaagggtctgtgggggcatctatgtcctgacctctcctcaggggagcatggcccaggtgcccacttcctccctgccctggcacctagcaaaygactcaagtggggcaccacagccttggggaagtggaaacagcagggtcggggagtagggggagagcagggtccaggaggtgcggagggctgagagaggaggttgaccagcagycccgacctctgacctcccgctctgctcccagctgaccctggggtgtttccagcacaggccagtcccctccctccagctcttgccctgcaccagcccctctgctctgagtggccctgtgaaaagagtgactcagcgtcccactgaactgagccccattctggccttygccacgtcttctctgtgtcacctggagcttcttacctcccctcacctggaatgcgagtataatatttccccatgtggtcatgaggatcaaatagtacatgggtacctggcccagccagtgcctgccacacagtagggcctccctaagagttggttcccatcccctttacctgccactgttgattccaggtggaagcccctttttgtcccccagggcgcctgccctgcacggcccatcacaagcacctgcttaccagggatgactgcctcaggcagggcctcattcccatgatctcaaataccccttgtcaaagaaaaatctgaggtccaatcgaattttgaagactttatttgaggaagaagcaagtcatgaagtgggaaacatcaaaatgaaagacatttcatgttatgatggaaaagtgtcagaggcaggtatttatagggtgaatatggaagtggaataaggacattatttgatttgttgcagttgtcaaattatgttttttggtttaccttgttggaaaattcctagtcgtgtacccgtctgtcagctggctgctcatgactggccgaagttaagttttgtttgtgcctaacgtaagcacccatctgaaacgactccagttaagttccccatagttggcagtttaaggggggttacagccwttctgaaggcctgtttgcttttgtttgcccaggtgttcattttaagtttgctttaacaccctggtactcccaccccagcaataaatacacagatctagtgctggaggttccctccatccaaccctggtttccttcatcctttcagtgaaggaggaaaaaataaaagcaaaatacccstcacccaagtcagcactgtgttcatttccctaaggcctgttttctcccctcactgagttgccttggcaaccaagtcacatctgctcaggagccgccctggacagcaaactgggctctgctgagtcctgtccaagatgaggagagggcagggaagattagaagccgggacctaccagccaaccccggaatccttcagaagggcttggctgggaggctcaaggaagaaactctstctccgaaacaagatgatctgtggtttaataacgcggccagctgggttcagaggtgatagtggggagccatgtcccctgagaccagcctgcagaggacagaggtaacacagaagggccacagggatcagtgctgagggtcttgctcccctgcccgcctaaagaaccccctccactgcccatctgagagcgcccatgagcagcaggaggaatcctctgtgcatggtagtttattcaatggtgtagggttgaaatattctttttcaataaaatgtttaaaatcccacaggtatactacagtggagaatgcaggaaccacaggcattttcaaaatatatggagtcttcaaagtaatggcaagggaacgctggccttgagtcaaatcctgagcttcctgcttgctgggttgggtggtgtctttcgctgtctgggtctcaatttctccttctgtgaaatgagaatgaggcctcgcaagtgtgtccacggcaggaaacgattttacctcatgtcccagtgcatacataaatccatactgcttcccagtcccttctctgcagttccataattcccaaatccctgcaaaccacacatttttggggcaactcmtctgggcagtaatcctgctgtgtactaagatgctttgtactgataatattatgtatcccatttaaggtgaatattcattggtttctctgttgaaacatttgtacctttgattacaaggttgaaacatttgtagcgttgaccagtgtgggagtggtcagtgatacagcatatgcaccctgtgtcatattgacacagattgaaaatgctgccatcctaaacacatctakatcccaggaatttacataagggtatatatatatacacccttatgtatatatatattatatatatttcaaatatcttacaaaagaawactcactcttgctgtgttcaatacactctgatattttcaatgctcttttctttttaaaatgctgctcttgacaaaatgaactattttcataacccactgatgggtcgaaactcagattttgaagacactggtgtaaagcgtttgacaataggcacatggcagraggaagcgatcactggaatatttcccgtacatggggagaaarcatggtggaaagctcactttctggtgattctcagctgaaatagatyggttcctccacaaagcaccrtggcacttccctggtgaatcactcttctcaggatgccttagtaaaacgccacaggctgggtggctccaacaactgatgtattttctyacagttctggaggcaaaaaktccaaggtgaaggtgccagcagggttgatgtctggggagggctctgctcctggcttacagagkctgcctcagggctgtgtcctcacatggccttcccagtgtggggggtgtatgtgtgtgtgtgtgtgtgtgtgtgtgtgagtgtgagagagagagagagagagagaaagagagacagggagagagggctggaaggcaagagagacagcgagggcggggtggggtgaggagagagagagagatcttctgcctcttttttttcttttaactagacaccagtcctgtaggattagggccctacccttacgactctctttaaattaatgacttccttaaaggctcaatctccaaatatagttactggggtttarggtctcagtatatgaatttggagggcacacaactcagtctatagcactgatgcctccatcaaaaataccccatgtgacagctggttgaggaggattaacmtcgaaccaccttattctcaatgccatttaggctgtagcacactttcttccaatcttatgctttttgtttccaagtagaaaagaaacgctttactgaagaggccaccaaatacttccgggagagagtcagcccagtgcatctgcaaatcctgctgactaacaatgaagcctggaagagattygtgactgcggctgaattgcccaggtaacctccgtggggttacctccatggggcgccccggctatgccatcctgatctcccctgggctagttttctctggcaggcacacctcctccaggcagccccctctgctgaacttgagaatgtccctctcagcagtccaggaggaatatttcctccaagtccttcgctggcagtgagtgacctcaggctgaggggagaggaagcccacaagggcagggtcagttctgccatctactggtgatgggagctttgcaagctacttgactactttctgccttcctttcttcatccattgagctttattgtgagaaaaataagctaatgcatgtaaagtatttagcataatgactgacacatggtaggtgctccgttaatgttaccttttaaaaagattgctggggagagaccaggaccaaaagtgtttttctttttttttcyttttttttyttttttttttttttttgagacagagtcttgcttgtcccccaggctggagtgcagtggcatgatctcggcycayygcaacctccgcctcccggtttcacgccattctcctgccccagcctcccaagtagctgggactacaggctccggccaccgcatccggctawttttttttgtatttttagtacagacggggtttcatcgtgttagccaggatggtcttgatctcctgacctcgtgatcctcccgcctcggcctcccaaggtgctgggattacaggcatgagccgctgcrcccgaccaagtgtttttcttagagttggatgcccagcaggactttctttgaaaaaagccagaaaaatcttgacctgatcaatgtgtgttcctggagatgctgtccggggcccttttcttccacctctgaggaactgcacaaacacagcaggatcctcctgctgacmcagaacacagagaggctggaatggagttggacagagctgggggtggatcttggctctgtccctgcacagctctggggctgttgttttatgtcttggagactgggacctgccatctctccaatgctaatagtagttcaatcagatgggcrtgtggttaaagcctgagaatgaacagcaggtcaraggtggggaaccaagtagcatgatgccatscaaagacccagagagacgtttcaggggcagagccaggggtcaggatggggcaggggtgggcctgggttggaggagcagcaggaaggctcgggcaccaaggctgggagtagggtgagaagagggaggcactgagggcatgaaakgtaacgtggccatggacttgcagaggaccagtgagtgggagagggatatttcttccctccctgatttgatcccatcactgatgggcatagtgggccatgggtgactgtttccctgacagcatgcctgggaactggggcrttctgaactgccatttgggaccctcttctgttctacatagagtagaggaagtgtttcttcgggccagcttggagagttggaacaagtgtctgccaactgggtaatttgaagggttctcaggagactcacaagtccccaaccaaagagaaaaacactttctctatcatcttgtccaaatgcaggtcttttcagcattagtgatttatagagatgattttcaaagtctcatgagtccataagaggttccatgaaattgcacatggcattggyatgcacacaggtgaagctgtcacctgctaaggcattagtttggctggygacatgtgacagtgagaccctgaagcttggaggtgccaggtcaggaggcmgtcaagtggcttgagagttcatgtgcagccaggactaatagccaggcctttcacttttcagtcaaagggggcagtggctggacccagtggccttcagtcagaagatcaaagggcatgtggcattggaagagagaacatgccaggcaaggtgatctcttccagtctgaggttttatttgatagcttaaggactcagagttagtcaaaatgcaatgtctgaaggcacccttcyttctgacaccagttgcagatttgaaggtgtttcttaagcccccactcaggtttgataattcactacaaagacttacgtaactcactgataactgttattgcacgattgtggtttatcacagggaaagaacacagattaaaatcagcctaaggaagagacacacagggcagagtctgggagggtttcaggtgtgaagcttcgttgtcctcaggacgctgtgttctcctgtgtgaatgtgggacaaaacacatggggtgttgccaaccagagaagctcacccagttaaggaaaaattcctgtgaatcacattagatcaggaagcctttattcaggattgttgttacaggggagggagactgagcccagctcccaatatagtaaagacagagggggagtcacagccaacaccagggtgaggagtgggagatggaccagttctgactggagacaccagaatggggggtttctgctaaactggcctaacaagctgctcaactaaaggcaggtaaggagcgggtgaagaccgtgatcagacagcaagaatgctcagacagcaagtggggaggaccctccctaactgccttgggggattcttgctgaactggggcagtacaggcccagcaagcacgggatgggcatggaaggtcagcgcctagaggagaaaaggctcagagcagcctgactggagtttggccaaggagaaagtctttctcaacctatgcctcaatgtacagagctctttctggggctggatcacaagctgtcctgatggctgacatggagtccccagcccctccctgaggtctaacacccttagttcccagttcctttggaaggcagaaaagatacgtaatagccccaaaacccatcacccataacattgctatactgtgctgtagccaaaccaccagggaaacaaagatgttcctaccaggcaggacattccagggccccagagatcccttcccagggcccaaagacaaaagaacgacctctcttctaataaagttaatccttcactgttctatgatcctctgaatgaaggtctttttgctccgaacccacttctctttgttcatctacaaaatttcccctctccacacactattggagggatgatgttgacctctcttgcttgaggagccatctttatcgaatacctaccactaaagagcatctgaagatgactttaagttttttattcccatacagaataagtactgtggcatatctatgatatacaaaacatgtttaaccttggaaaaattattttaaatttttccatttaaaatttaaagctttatttccatttgactcatagtaatagctctgtgatttatgtagaacagatcttattgagctgattttacagataagtaagctgcctttcttaatcatctgtcctttattggtacagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctggacttattcgagtcattccttggtctcctggctcctttctcgctttgggagcaagttcctgtctgaagtttttgtctgaacagtggtaaaggtgatggtgatgatgtcagcagacagcaggaggacttgacaaatgtcagccctgcttggggccaggatacactgagggaacgatgacattccaatgaaactccaaattctgtattggaaaagtcattgatttgtgaagaaaaataaaaggaggctgggcacggtggctcaggcctgtaatcctggcactttgggaggccgaggcgggtggatcacctgaggtcagtagttggagaccagccaggacaacacagtgaaaccccttctctactaaaaatacaaaaattagctgggcatggtggtgggtgcctgtaatcttagctactaaggaggctgaggcaggcggattgcttgaactcaagaggaggaggttgcagtgagccgagatggcgccaatgcactccagtctgggagacagagcgagactccatcccccgcgtcccccccccaaaaaaaaacaaggaagagaaaagcaaaaccagatgccaggaaccaatcaaggaactttgtggtgcattgaggagatgaaccagcctgcagtcaagagaccccgcctctctgagcctcagtttcctcatcagctgggaaagaggggctggacaagatgatatctcaggtccacctggctctctcctcttgtgttctggagatctgggttcaagcaacactgatctatgcctgtgcctttgtggtgctgatggatgggctcccctgggctctcggtgcctgacttcacttcctcatgatccttcttccagggactcagggagctaggcctccatggccccttctgcttgttcttctggtcggtcatttctgggcgaccccagtgcccagtggcctgtgaggcactcagggaaagcttgtagacatctggcttggcccaagtgcaggcatggtccccatctagcagccagggcccacgaatgacatgggtcacacaaggctgactaaaatcagaggggcctgtgtgtaggttgagagaaagtccatgagaaatagaggaacagagagagatagccagacagcaaacaccctcatccagtctgcaaacaccctcatccagtctgcaaacaccctcatccagtcagccctctcatttcacccagactcctgcaaaagcttccagaatggtcttccctgttatacagcccttgccactatccctgcccatcctccacactgggccaakttgccccgtaagaacatagatttcttcaagcccatgcttccatgtcttcaatggcttcctattactcttagcacaaaagcccagagccttcatgctgtctaatgtaggctgctgtggcctgagttcccctgaagggagagccctaggcaaggctcccaggcagaggatttgtttgggaagtgattctaggagcaggactggggtactgggaggagtgacacagagaaggacagaaggctgatgccgggagaaattcttgatagggtcacccatgtgggcgactggagacctcctgaggagtcttcaaggagcgtcttcagaatgttcctctacagggaggagagagggaggcctgtaaccactgctcctgtcccccatggccttgccccagtggacattaattatctgtatttccatgcatagaatatagaactgctgggcgcctcagctggagcccagagcaggggcaagagatacagaatgcacaaaatcaccccagaacctctcctaagtcactcgtaaagtgcacccagggcctacttagtccttttttatgtagcatcctgcagaacacttgcctcagtccctgtaactctccatcagccaaggcttccctgaccttcagttgattcatctatttcttcctgaagaagtcaacagagcaacggccaccgacttgcctaacgccagaacattgtgtttcatttgtttgtcaattgttcatcaattcctggataattcccattcttttcatacatttcacttaagctttgaatgtttctggcactgagtaatttacttcttcagtgatccagccagcatttgccctgacacttagagttgaaatgccatcaggctacctgcatttgatgcaattccactgtactgctagtattgyttaaaaatttttcaattgcaagcaacagaaacagaaactatctgtcttaaacaaaatagaagattcattggatgaaaactagagcaggtcagaggatggaaggaagaacaaaatctacagaatttggaaggacaggagcagaccattaccaacatcaggaatatatggtttgccctttcagggctctgcctgcacctggcttagctccacacactttgattcctagtgtctctgattaaagtttcacatactcagtagacagaatagcttgggttagtgactcttcttgaactaatcagtgaggctatggtatcaggaatggggatgggtaacagagacacaaaccctaatgggaagcctctggccaaacagccacctgaatttgtgctcattgtatacagtcaatcgcttgctactgcacacacactcttcttctcatacaaacaaaaagaactctccttatctgctatgaacccagccatcccaaggaaaaaggcaaatgcacttgcctcttccccagtgagagccacacacagcatctccaccttctgcatgctgaagttatgtcacaggaggagggcctcagcacacgatcaatttttcttttggtccattggcagcttctgtctcagaatttttgtgtgtgtatatttgtagaaaataaagaggtacggtcaaggctacagccactactgaccattgctgccaccatcagaagtcttgaattgttccactcaatgttcctcttacttatgggcaaagtcattctcgtggtgtctaagctccttgatggtctggcctcagtaagttggtgaaatttcctattcacatttacactaatactctaacactttagagtattacaaggagcaatcctaggggatccctcaattcctcctgtcctgctgtgtaataacaacatgagcttccctggaggaacatgatgcatgattatatccaacccagtgacgtcattgctatccctacatcagggagcatgagaagccagctatggtttctgctgaaacaacttttgtcaaccttagatactgaaacttccagacctaaaagtctgtgagttaggagtatgtatcataaacaaaatttttgaaagtggtttattgtgggtaaccatagagctatcaccctcatcttaacctctgactgcccagctccatgaattctggctattacaggaaatggggaaaattctgggtatggattcaaaacatatcacatcctaagggcagctcccagcctctgatatggagctgagtcccctttgggccatttccatgggacctaaggctgtcatttccggggttgagattcactgggtgccaagtggtcagccttgatgagtggggtccgtgttgtgtggttacatagagctccacattaggcaagttggttaatgagcccattctgaaaatgtcaggctgcctggggaacagaggagatttgagccttaaagagtgacttcttcccttgtttattaacagcctctgagccaggcatggtgactcacgcctgtaatcccagcacattgggagaccaaggcgagtggatcagttgaagtcaggagttggagaccagcctggtcaacatggtgaaaccctatttctactagaaatacaaaaactagccaccagacatggtgacgggtgcctgtaatcccagctactttggaggctgaggcacgagaattgcttgaacctgggaggcagaggttgcagtgagccgagattgcaccactgcactccagcctgggcgatacagtgagacccagtctcaaaaaaaaaaaaaaaggagtcttttttgatggtggacatcttccaatgagcattcacatgggacagatttttttttacttctaccgttgttctgaaagctctatgtatgttcctcttccctaaaaatctttgtcaccaagcctccagatttattccttctaaaatgttgaaattccagctaattccttagttgttacccaggaaacaatgcagatcctggtccgaggatgcagctccttccaggcagcctggactgtgaggtgtgctccattgctcttcaggaaccgtccttgagaggcgttccacagcaggccagacctggggggagcaggtgggccaggcggaaagcacagcacaatttgagagatgctgagtactcatgactctgtgtaagcacctgaattcagccctcatggtcttttctgagctgtcagtcatttatctctatttagtcattttgcgaattggagttagcttccttccctctacactcaaagacggcatgtcaacattttaggcctctgggtggaatgaactcccagtttcctgggagggagctgattggcatctattcgcctcttcctagttttgtggggtttcccagcatgtggagtcatagagaaagactggtcccaccttctatgtaatgcccaagagaatagatgactctctgtccacccccaccctggcatccagggcttctggacaagacctaggctggctaattggctgcttccacatgggatcctgaatctggagcaagtgaggcaaagcccagggtgcttagaatccattctcagtgagagcagcaggactgcccgggaggggaatagagacggggacgaccgagtcctgcaccagcagagatgacgtccgcaggtggcagggcagcgctgtggccgtgtcactcctcacaaagcagggctcttgtgctcgcagccttcgataccgtctcactgtcttggcttctatttatcttccaagccaatttccagcctcctacacacgtggggttcttctggtatcattccagtgaatttcatgttgttttctgccctaagaaaacagagttggtacctctgctcgaccaagaagcctgattgatacagactgagagctgcaggctgtgtttatttgcttcattaacaagaacaacttaggaatggcaacttccattgatgagcttcctactttgttctgcggttggaaaacaaacagttgtttccctgttgacgactggccacactggagaggtgaacaggtgagtcacaggaatcactgcttctgctccctttaaatcttgatgatggcagaaatctctgtaactgcctctgtaactcctccatgaagttggtgttgactttgagtaaaatatttaggcaggtatgtaaaaccaatggcctccactggcgtatgtcactgaaatagtccccgtccgtgggtctgggtgaacaatctgaagcttccaagagtattctttccagttatccacccaggaatttgaaaaatgatgaccaggtgagggtgggaccctgatggacttaatcaaaggtaaacgaatatagatattcactaattacttgtgccctataatctccccctctgacccaggcctaagaattgggtgacaagcagggactatccagcctgatgacctgtgacaggtatccactcaccagattgggggttttgtaaagtcagtggactgtcttccagctctattttggaaccttgttcctatcaaatgtcccttgagccatgatcatgcgccctcctggtgcgtgacctggcgcccgcactctcttttcttctggcagttacctgcctcccctacagtcggcctcttggaatttctcccaccctaaagagaccagagtcccagcccctcccctattatagagagttcctggttatccattgactcttctcgttaaaggagcgggaaatcttttgggccctggcaggaaacagtgtgggcaggaagtgcttgagaaatcaaatctagcatttcagcctcctacacacttt

SEQ ID NO: 12423 - DNA, 19197 bp, Homo sapiens
tctgcaaatgctaacacataaaccatgacctaacttttgtcaccttggatatctattgaatgttaaacatctctaataaagatggccaccacttaatgtgtggaaagtgatggccttctcgtgggccacgcgtttgggtgtgagtatggccttgaccaagggtcttggtgctttattcacttttagagatagggtcagttgcccaggctcgagtgcagtggtgcagtcatagctcactgcagcctcgacatcctgggctcaagcagtcctccagcctcagcctcccaagtagctaggaccataggcacatgccaccaaacccagctatttttttaaaacaattttgtagagacaggatctcactgtgttgcccaagctggtcttgaactcctgggctcaagcaatcctcctgcctcagcctcccaaagtgctgggattacaggtgtgagccactgtgccaggcccttggttcttttaaaaaattaatcctgtcatgtaggatgtccttacagaatgaaaaacctagcaagcttattccccaacagaacctaataccttggttggattctattgctaattgaaatgagaattcggttctatggtcattggttcagggtgtatgtattgtgagctgctggagacagaacggtgaacaggcatgcctcccggagagccatatgcaaagcacggagagccacatgcaaagcacgtgttggcaacatagcacatgctgctgctcaccaggctcacctgggatgacggtgtggatctgagtcgctggccacgtggcgacgtctgccctgccctagtgtccaaggacggtgaagggtcgggtgtcaccaacacctgcagccttctcaccgggcgaggcttgggttgtgggaagtgggggacagctggccctggtccccagccctgatggacatccggcattttgctggtgcaggctgtcctgaagccagaccctcccgagactgctgtctgggaggagagcgagccagcggcccagatgccttggtcgcggggaggtgcctgtgtgtaccgtgagtttcccagcctccggcggcaagtgggaaagccggtacaggaagagtggtgcctgcaggtgctcccggtcaccaccaccccttccagacgccatccccagagctcacatctgtgctggctggagggtcagggctccactctgcccgacaagcagtctggtgcaggggacgcaaatgtcagacccagcagggcccggcacttggagaagtgccacatgccaccctggtggcctccgggcaccccactgtccacgtgtctgagcatggagctgtccatctggggcattggccttgaacaccaaggacctgccccggtttgccaggcacatctgaacacaaggtcaggaggttagaacaggacaagagaaacgcctggaggcctcctcacaaggcatcctgctctttggggaaaatttctccccagcagaaatggggatttacaagttttacaggtccttgtcatttccgtgaaggaaaacaaagcaaagacagttacgagttctggtgagcttcccactgagctgggcgacagagttcaggtctccaagtgccgggccctgctgggtgtgacatttgcgtcccctgcaccagactgcttgtcgggcagagtggagccctgaccctccagccagcacagatgtggacgaggggcgcagctggaccccagaggagagttcgatccatctgcaggaagtcctgatggtcccagttttctttgatggccacatctggacttgcctgtgtgtaaagtggacacaaaagacggggcccctgccgtggccgagaacgtggcggtggctcctgctgcttgccaggcagcacgggagctgggtctccctcggacccctcaaaagatggttcctcaccgtcttctacaggctgatgtaaaatttctgtgaggcgaaagccacatttgccagctctgggtacgaagttcacttcacagtcggtccttcgcttggtgagctttgggagccaggctgccgtggccagatgtttaggagcacgacggtggctctgcagagggcgatggtgtgcagccgggctttcctgtcgcccacaccttgcaggccctcacccctccccgtgccttcacccagctgctcctccagtgccattcatcccagcaggcagcaaggacatggcagctgagaaaagatgccagcagaacgcacttattttataatatttaacaactgtcagtgccaaactgcattaacacagtcatcctcagatttttcagagggctgtgtacacatctgtgaaaataaatgttaacctctaagatttgaatgaagattctctgaagatgggcagcaggtgacctttgttttacactgagcaatttttcaccatctcagccgctctggccattttgaaaagggctacaaatctgctaaggatgagtcctcatgcctggttatcagaagtttggaccgcgtgttcctgaggattggccaagcaaatggctcatttccaaaaactgccctgtggagagggggctgggggacactcgtgacacctgtcgggcggcacatgtgatgggtggagcacccaggttctccaagcagcaggaggctctgatggacccccctcccctggcggggggacgctactgctagaagcagcgaagggcccggtgccccaggtttcagctgcctgccttctgccgtaagttgccccagcaccttcgtgcttttcaggagcgtaagctgagcagactcagtcgtcccagtggtcagtgtggctggggcagagggacacacggtccacaagatgtccatgctctcggaatgctccaggggtttggctgtggggctccaccaccattgcctgagcccggagccagaggctcctcccacactgcctggtctgccccacagagcatcagtgccacgccaggtgaggacagcgctcaccagacaaccaggcctgccgccccactgacgctgacttccggacctgcagaactgtgagaaagtacgtttcgcttctttgtaaactgcctggtcagtggtggcagcacagatggaccgacgtggacctcgacgcgaatggcgggctctgggcgctgacccggtggcggcgtagctcaccgaacacccagggggaccagaactctctgccttccactcagttgtgacttgtctatttttaaaatgttaaaaaaaaaaaaacccacaaggtgcagtggctcacacctgtaatcccagcactttgggaggttgaggcgggtggatcgctcaagctcaggagttcgagaccaacctggcccacatggtgaaaccctgtctctaataaaaatacaaaaattaaccgggtctggtgacacatgcctgtaatcccagctactcaggaggctgaggtaggagaactgcttgaactcaggaggcgggggctgcaatgagctgagatcaagccactgcactccagcctatgggatagagtgagattccatctcaaaaaaaaaaaaaaaaaaaagtttaaaaaaccctacccctgccaaatgcttttccgaagtagccgtgccattggtgtttccaactttgcctggcaccttccatcgtttgctaagttccagcaggtgtatttcatttgcatttccctcatgaataatggtgttgagcagcttgccatggtgcctttgcygcctgtgacctctttggtgaaacatccggaggtgtcttctgcccacgtggaggcgcagcctgggctctgccgcccacctttcacccgaggagcctgcagcacgtggagagcatcagggtgtgctttctttacagtttggggcttttttgagacagggtctcgctctgtcacccaggctgcagtgcagtggtgccatcacggctcaccgccagccttgaccttcacctcagcctcccaagtagctgagactacaggcatgcaccgccatggctggctcttttttaatttgtctttttctaaagacagggtctcactgtcttgattaagctggtcttggaactcctgggcttcaagggaccctctcagctcggcctcccaaagtgctgggattgcaggtgtgagccatcatgcaagtctggggttgttttttttttgctaaacaggatgaatagaaatctcttttgggggatctcttagtccaaatcctttagctgaatgcgcgtgtcccggtgaggctgctcctctagatgctgcgggcattttgcagacgtcccaccaactgccatcagcgaccaattagaagatagggacagctgcacatgtcacacagcccttctgaccttgtgtgtgcttcaagtccgagattcctgacacaaagcagcgtgtgcccccccacccactctgtggccacagctggagtcctgggctgctgggtgctccaggtgccataccccacacacgcatagagcccgtgggctggcagcgggcacccacagtggcctctgcaaagcctgcctggctgcggctcgtttcctcactgcagcatgctcataggaatgtgggagtttcgcttgaagtgtgggtaaagagttctggggttgtttgagccatcccaggccacagggcctccaggaagtggaggaaatggtaaatccagggtcctcttggccactgcgttggcctctgcacacttggcccctgcggaccctggggcttctgctttactgtctgtgacataaacaagtgacgcttgccaccttcttgccgggaaagccaggctgggttttctcatttccaccttttccctgttttacacgagggcacgaggatggggctgcagtatcagtgacgcacctgtcaccagcgggccacagagctttgtgttagcccctctcaagccctttagcttctggaaccgtttaaattcttaaaaattatacaggaccccaaagagcttttgtttatgtgagctttatctattgacatttaccatactaggaattaagaggacatttaaaattatttagctacataaaaataacaataacaaacttactacctgttaacacacattttaaaatgaaaagtggctacattttccaaaacaaaaaacgtgaatctttagctcaatcaatgtttcaaatggaagcattatgacagtcaaaagctggcaactaaacataactggcacaagctctgccaccgagacaatggaggcctgagtagtaggctccctgcagaatgaaaggactggagctgccagcatcaacaccaacgcatctcccaacaagggtgagtgaaaacacacacctaaagacctcagagagcacgtaagcacacagctgtgcatccactctgagggtgagccaccaagcacacggtgaccccggggagcgcccgaagggagtgaagtatctgaaggaaagaaggaagtgagcgatgggcaaaggagaacctgaggaccctggcacagtctcagctgcaaacatctagtcttgcttaactggggtgcagaggccactgcacctcagggttctcacgaagcgcctgacctctctattttattactattattattattattttttttttttgagaaggagtcttcctctgtcgcccaggctggagtgcagtggcgcaatctcggctcactgcaacctccacctcccgggttcaggcgattctcgtgcatcagcctcctgagtagatggaattacaggcatgtgccagcatacctggctaatttttgcatttttagtagagtcggggtttcattcaccatgttgcccaggctggtcttgaactcctggcctcaagtaatccgcccgcctcggcctcccaaagttctgggtttacaggcgtgagccaccgcgcctgagccctctaagagcccccgcctggcgtcgctgtaggcaaatcccaaagaacgtgtcccttcagcagccggctggggcgccacaaacactatctgttgtcttcgctttagtttgtgtcaaagtgactcaaagttacacaacactggcgggcgactgccgcctttttaccctgtggcctttcccatccaggcgtccagagggtgagcccctgccctccaggacccctcccttccaggaccctacccgtctgggactcaggccttccctgactcctccctcccggactcacccctcccagatccctcccctccgggaccctctcccctcccgggccccctcccctccgggaacccctcccctcccggactcacccctcccagatccctcccctccaggagcccctcccctctcgggacccctctcctcccggacccaccccttcctgacccctgccctcccggacccctgcgggactagatgtatacagctgagaccatatcacggttctcaccctcgctctaccctcccggacccctgctctcccggacgcgtggactccagctcccgcctgggtccccaaagcgctgaacccatggtcacttctatgcgtagccctggtgcccgccgcccacagccggaccgcactcctcggcctccgcctaacccctggctcagccacacgagtgacagctctgcccgcccgggcgggcgacgccgaggggtgggctcggccccacctgagcagttccccagcgcccctctgaaacccgcctgtggtccctggcgccgcctctaggggccgccgccgctcccctatgacacagcaacaataggggccgctctggtccaagcgccctgcggcccgcgcttccgccggaaaagagccgccggcgcgggggcggaccggggaggagcgagtgcgatggacggtcgccctcgccaatcgttggcaggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggtgcgggagtcgccgggcctggggcggccgggggcgaccggaggcgggggcaggggctgctggaccaaggatggggcgggggcagccaagacgagaaggtggccggcgcggcgggtggggcctgcgggggccgggccgggcgggggttctggggtctcgggcgccgccccggttccgcctgcggctctgaacgtggggctcggcgggagctcgggcgggtctgccccgcggagcgggtcgccggggtggcgcgtcgaggctggtgccccgcggagacggcgtcaagcctagggccggccccactaggcttggcggggctgccccggcccagcgccgagtgcgggcggtgcgatcgtcgtgagcggggcaaacgcggaaaggcagcccggcgtgtctgagtctgccttaggcagctctgggcgcaggccccctgctcgcaaacaccccagggggcgggagcttgccggaccgcaggcgacagtgaccgccgcgtctcagcgtcctctccgcgctttcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgtgagtgtccctgagccgcagcagcaggacaggcgacttctcgggccctcggagtcctcgctttggagttcgcggtgggggcttggccgcatctggggaccgctcgtggggccgtcatcgactgccctgctgatgggtcgtcctggtttccgcggtgacaggggcatctcggccactgtgtatcttgaactgtccgtgtgaggtgcctgggttggaggtgtggccctggagagcccggagctctgtgcctggccttgaactgtccgtgtgaggtgcctggggttggaggtgtggccctggagagcctggagctctgtgcctggcggcttcactcagtcttctttgtttttcaaactcttagttgttctttgttacatttgagagcagttcagcgttgactttttaactactctgggaatgttgtttccagcacgtctcagaaaccccgttgccatctgaaaggcccctttccctgctctctcccccggccttgcctttcatgggctgtctctgaccctggcttctctgccttgtggagaccctgccagcgaggggtctggcggcttagctgccccttgcgcaccccacccggttagacccagggctcagtacgctctcctgagactgggcacagtgatgccatctgcgccactgactctctcttcccctggcttgccaggacttgatcatcttccctgacgactgtgagttcaagcgggtgccgcagtgccccagcgggagggtctacgtgctgaagttcaaggcagggtccaagcggcttttcttctggatgcaggtatggggcaggccttggggttgtgcctttttgttgccctgcgattcggttaggaacttgcttacagtgtggtgcaattggcttttataaaccagcaggcgccggccacacccggccacacggcctgagatgccacctcagggctgcggtgcatgctacctggggccgaggtcctctcccagagtacggaggctcyaggctgggctgcgggcaaccgattgcggtgtgaaatttccaggcagacagacatgctggccctggttctaacgatgcccagtgccctctctctgccccttgccgtgggtcactgaggcccccacagcagaggcagaggcccctgtgtggcttccctgctggtgctcacagaaacgaagcatcctgctcacactttccacagtcctgccccttccctggcagtgtgtcctggaggccaggggtgtcagtgcccagggtttctcttacccacagctgcagagcgtcttttgggtctagaggccgctgctcattctgccatctgtcagtgaccattgagcttgttgccgttttttgtgctgttacaggcagtgttgcaaagaatttcccggtacacagatcattttccataagccagtatcatctgtaggtgaaaactggtggcgggcctgtggtcaggaagcgtgtgcatgcgtttgcagtgtggagagagaaggccatgctctctgccagaggtggagctgctgtccccaccccaccccccttggcactttcaagagcaggggtggccctggctgaggtctctgtggagcacatggtctgtgttgctggtcacctgtgcaagtagtgtgcagcggcctgagaaaatgaacaggcatagccaaactccagttaaactttatttgcaaacacagatggcggccacaatttgccacctgctggtgtagaacgtgtttttccacggttttgccaagaaatagtgtccaactgttaccaccatctcccttttttccccgattttcctgttggtggcttttaagtcccccrtccctgctttgccatgagagcagggactcccagtgtccctggcgccctgcagcttccatagccattcggggtgtgcgtgggtgctctgctcccagctctgtgagctcgcaggtcgatgcttctgacactgatctgtgcacatgtgtgtgcacacgcgtgtgctcgattgtgagcgcctgccgtggccctgggccgcggtgtgctgagcgggccagttcgctgccttccactggttgaaggaaggagacgggtgtgtaaagaaccgcaccccagagggcaggagggtgagagggcttggtctggcagcagctaagtgccttcggagctctaggctccccatttgtgaaatgggcggagggggacagggcacacccgggattgcggcggatggggacagggcgcagagcatcgtgctcaggaggcgccactgccgtcccctcacctgctgggccgggtcctgtctcctcagcattgtgtggccaggcacacgcgcctctgcgtctcaggtccctcacctggaagccaggtcagaggatggctgtggtggccctgggtgagctggcrccagctcctgcccttacatgcccttcctcttgcaggaacccaagacagaccaggatgaggagcattgccggaaagtcaacgagtatctgaacaaccccccgatgcctggggcrctgggggccagcggaagcagcggccacgaactctctgcgctaggcggtaactgtcacatgtgtcacgtgagctcagggtttcctgggaggccagagtctactgtggatgactcgccccctcagcacaggttgtttggaagtggaaatagaagattctaaaagttagagaccctgtgagckccctggrtcactccccactcccaccttcacggggtaggacgggtctgcatcccaccgtcgcctcacttcaagtggtgccccctgtagggttcaggggcagccgagtgcggtgctcagcagaggcgcaggcagygcggtggggcccgcgtggatctggctggggcaggcccgcctgagctgcagtgttttccaggtgagggtggcctgcagagcctgctgggaaacatgagccacagccagctcatgcagctcatcggaccagccggcctyggaggactgggtaacgtgcgccacccgggctctcgggcagcttctgctgggaatgctttgaggcccggtctctgtttcstttaaacttctgctggctctgtctgcgtagtgtcggggagcctgtgtgtccgcaagctggttcccctttgggaatgcgcttgtttgcctgtggctagagctgggtaggcgagggcttctgggcccctggtgaggaccccagctgggtacttcagaggagggtggctggccgagcggtggggctggaggactggagggagctggggttcctgcgccctgggtcccctggcccyacatggctgcctgcctgctgccagctcatggagtgcagacccgtgtgcttggcccttcagaaatgcttgtccctttgggtgggatctggactgaatcttctaatctaagcacatgaattgtgtaatgggatggaayagaaatgaccttgcttccagaacacagccgcaagtgtccacccgccccaygccgctcctccaggcctgtgggtccccaccgccccgcttcttcctggctttggtgttgggaattcctgctcctctggcctggggaggggccaggctctttctggtgggctagagggcatcctgagctcgcatttccttgcccctcgcaggtgggctgggggccctgactggacctggcctggccagcttactggggagcagtgggcctccagggagcagctcctcctccaggtgagcctcatcgctcctgccacgcaggtgccacggtgttaagggaggggcagtggggaatcctggcccagcaccctggaccctgcgagtaggccctgccgtgtggggcgygtccgctccagcggtgccctctctcttcgcagctcccggagccagtckgcagcggtcaccccgtcatccaccacctcttccacccgtgccaccccagccccttctgctccagcagctgcctcagcaactagcccgagccccgcgcccagttccgggaatggagccagcacagcagccagmccgacccagcccatccagctgagcgacctccagagcatcctggccacgatgaacgtaccagccgggccagcaggcggccagcaaggtarcgtgtgctgtcgcctggagctgggtggggggcatggggcctgctgaccctcgcacgctcaccttccaaggcatctgcctagtgtgcgcgcctggggtgctggggccatgggctgagtccctgcttgcatgccttccatgtgggcacttaggctgtcatcgagctgatggccgtgttcttgtgccccagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggtagaggccgggcccagggtgtccyccactgtgtgctcmgggagtgggcaggggggaggaggaggccctgccccaccttcaccatggccagtgcttcatgtgcctgacccgcasagctggcagctgagcagtgtggctctrgggtgcagcccgggttggagctcagccctcgcctggctcttcttgcaggccctgggcatgttcagcgcagccttggcctcggggcagctgggccccctcatgtgccagttcggtctgcctgcagaggctgtggaggccgccaacaagggcggtaagtggctgcgcctgcacctccaggccagagccaggggcagggtccattcctgtccccctggatctgcagaagtggggctgagggggtaaaggtcacagcccttctgcccttgatcccatcgctttgatcccmagttctgggcaagggttagacaccaccttgtgtctttaacgtgttctagatgtggaagcgtttgccaaagccatgcagaacaacgccaagcccgagcagaaagagggcgacacgaaggacamgaaggacgaagaggaggacatgagcctggactgagccacgcgccgtcctccgagsaactgggcgcttgcagtgcgttgcacaccctcacctcccacccactgattattaataaagtcttttcttttacctgccaaygcttagtttctttgcccaaagggagtttcggctggacaggtgctagcgtggggagctgctgtagggtcccagagacagttagttatttgacctaacaacggaaaacggtcaccccaggaagagtttggtgcctctgtccaggccggttccagayctgtcttgagacthtctccgtatttaagtcaacattcattcggttacacagaagttactttttaatttttaaggaggaaccagtgatgattggtgacaaatctctcacaattaaaaatgggtggaagggccaaatataaaaacattttgcagtattttattctttcgtttaagaagctataacttaaaccatcttcagaaacaagatctgtcacccgtagagcttagagtccaaatagacacctatgaggcgagcacaaggrgcggtgtgaggcagctgcaggggcctgaccaggggccggggttggctgtgtcctaggcggctgggcagccactggcccccactgccccgtggacctccacagagcgagtcatggcgacgggggaccggttcaccgccagcctcctcatgcagccgcagtaggcggggggccagggctgcacggccatgggctctgggggcacagggaagatggaagaaggctggttggtgggcagctagagacccacaggcccttcccaaacgtcagtgccccacccagcccctgtctcattccacatcataggagggtggtaggggggtgggaggagggtgggagggggcagggggtggaggggtggggggagggtggtaggttacgcagcacctagtcctgaggggcagctcccccacccttgatcaaggccgcactcaccaggcaggcccccgaggtacagaggggctggggcaccagctgcagccgccagcaaggggcccacggtgtggttgctctgcgcgtccacctccagccggagcacattcccgcttttcatcactgggagaaagggggactcctgaggccaggtggtcctcagcccagcctctctccagccccaaaagaagccaccccacccagagtcccgcctggctcccgctctgcagaagggtgggggtggcagagtgccctggccacaggaggggcctcacccgctagccggtgccactggccatcacacagcactgaggggcgggtcactgacgtggagaactcccctgctccgtcatccgcccgcagcaggacctggaggggtaggaagggagggtcaggctatgcccccgaggtcaccagaatggggaggcaaaccctgccctggcacgccacctctgccaggcttacttgcttctcggtcacctgcaactgcaagtaggggggcgtccgggcctggcccaagtggaagatcagtccggtgactgccaggggccgcacctccagttccaggcccacatcaggcagtgtagctcctgggaggtctgcggggaggggttgtgatggagaagaaagggggggcccctccccagaacctcctggagccccctgccctgccctgctggggcctgggatgccagcacccacagacctaaagtgataactcccccgctgcctgggaagaacaggcccgcctccagggggcccaagatgcagggtgtgacccctgccatccgtgtgggggcccccaggggcctcccgtgcagcctcagtctcttcacacagccgctgaacccgacggtcacctataggagcagaccgggcagggatcagggcccagggcagctgaaagggaacagtgggtggggagtgggggctggggcaagatggttctcaccggaagtttggagctgtggctgctggccgggaggccgcccacaaagagggtgtggggctgggggtgctctgccccctggtgctgccggtgcggcccctcctggctccaggcccgggccccgtccgtcaccagcaggatccggttcttctcccagcgcacggagacctgggggcaggagatgggtcagggtagggctgccaggccctgcccaccaccttccttcttctcggccctcaccttgtgccagcggccaggccgggagcgctggcggctctgggcgcggagccgagtcccgaggccttccatctgtgcaacgaagtggccattgctcaggaagagcgccagggaggggctgccgggcctcagacgggcagtgaagaggaggaggcctcgggagcttcgcgggaggacgtgcatggagagactgggcctggaagcggagctggcgtcagcctgcgcggcccctctcagcccaccccagccgggcctggccttaccagttcctatgtcgggccaggatgcccacaaactccaggtgactggacagggaacccccaaactggtaggagtctcgggtggtcctgaggtgtgggggcagcatgcaggcaggatgccgggcgggctgacggctgcggcgggaggcctgggggcgtggatggtgaatgcaggggccgcccacacaggggccacccttccagccaccccagctctgcctgctcacccctggggtgcccaccttccgggcggtggcctgcagtcctctaggccccaggcccggggtctgggcttgcagggcgggtgcacagcccgtgctcacattgacgctgcccaggttctgctgcagatcaaatacgcgctgtgggcccaggagcctgtgcagggcgggcaggcggtcagcagctgcggaaggccagctgggaccttgtcccccagcgcccaccaggctcaccgctgcacgaagacgttgctgatgcagccactgaagttgtaaatggtgccagactcaggcaggcctcccaggaggagcctcgggggcccctcaggctgcggctggagctcggggggtggtccccggtggggcttcatctgctggagctggtcatcgacatacagccagactctggggggcgggaggccggaggctcggtttttccccaccctgcccacccccacctcagaggagacagaggtccaggcaagtgcaggcgggcgtccctccagaccttcacgatgagggcccagcggccaggctcaccccgtggcattgctgtagaaggcgacgtaatggggggcaccatcggcgaagcccgcttgagttttcacttcagtcctcaggagctgtaggctcacacggccctgctgcagggacacctggcatagcccatcctggggacggcagccaggtcagccggccggcctggggacccagactcattccagacaccccagtcccaactgctccgacggccaccgcggggtggggaatgggcacgggtgtgaggtctcaccggggacgcccggtagtagagcagggcactgtcctgggcgctgtggaagccgaagccggagtagacgttgccagtgagcggtgccacgttcgagagcgccaggcgaaggaagccgtggccatggaaagtcatggcgcgccccacctgcggggaggccatccctgagtgcccgcgggtgcccctgcatgtccacagatgccacccccagcccggggagggctgctcaccagcaggtcggcggtgcagccggcgctcacgcctgtcgtgttcagccgcttgaggtccacatacttgcccagggccttgatgcctttgacgcagccacggactgagcctccggtggggaagagccgtcgcaggctgtggggaagcggggatgcgggtcagggcgccacctccaagcccagcctaccgccccaacagcctggcctcggagccccagctgcgcacagtgcttacctcgggggcagctggtcgggcggcacgccccccaggtagtaggcgtcggccagctccagatcattgtcctgctccacgctgtacaccgtggcccgctccacacgcaccagcacacgcttgcggctgccccccagcaggaacacctggatctacaggaccagtgggggctccagggccagctgtgtccctgcggcctgccccgcccccatcgttccatctcctctccctgccaccctggtccccaccctggccctaccgccttgctggccgaggtcaggggcggtgggggctgcagtgggacggcctttttcaggccagccccaaagtcatacaacagcacgaggctgccttcttgcacggccaagcacaggaactggctctgcagaaacagggcagggttagtgtggggcagggtcagtgcaagtggggatggcaggacgggtgtgcctggcgcacctgctgcttcaggaagaagagcaccccgctgtaggacacgagccgcagctcctgctcgaagcgcttggtggtgctgatctgactgtcgaagctgatgcgggcgaagccggtgccgtccaggtaggagccgtccgtgagccacgggtccccggtcgacttggagctgcaggtcggagattctggggtcagcggagggtggggtggggtgggtggagacggggagggcaggccacacgcaccgggcacaaggcctgtccacagccgtgtccagctggaaggtcctctcgaagttgtagaggctgaccacctcctcattcagcgtgtccatctcgatgcagccccggtagccggggaagcgaagcaggggagggggctgtgggcacagggctgggtcagggcacctggcctgaggcgcctcccctccaggatggaccaaggggacttcagactacagcaggacggactgaggcaagataccaaaagaacccgcggctctccaggacacaagcgactcggggctgcggagcccctcccaggctgccccaggccgggcgggctcaccgtgaaggtactggggtaccccccgacgtagaagacgaagtcgtctggccgcaggttgagcagcccctctgccccaggggccaccgtgtcacccttggtttcctggatcatctgtctctccactgtgacggacatgtggccaaactggagagtcctgagggcagaggcgaggggtggcgagtgggcacggagagatgaggggtggcgagtgggcacagagagatgaggggtggcgagtgggcacggagagatgaggggtggcgagtgggcacggagagacgaggggtggcgagtgggcatggagagacgggtggcgagtgggcacagagacgaggggtggcgagtgggcacagagacgaggggtggcgagtgggcacggagagacgagggatggcgagtgggcacagacgaggggtggcgggtgggcacagagacgaggggtggcgagtgggcacagagacgggtggcgagtgggcacagagacgaggggtggcgagtgggcacagagacgaggggtggcgagtgggcacggagaggcgaggggtggcgagtgggcatggagaggtgaagggtggtgggtgcacacggagaggggagagatggcgaacgggcaagggccctgcagttggaggcatccggcctctctcctgggcctcccacctgtccaggctgacagctgcgaactgctccccaatgtcctcatcgatgcttaggactgcagggcccgcctcacccagctgatacacccagtgcaccttcttgtcacgcagagacacacccatgtagtccccagtggcctgcggcagtgacagacacacagtcgggatggggaccggggaccagggaccaggcaccgctcatttccaaacagagcctgagctcgggccgcatccacccagccagcctggtacctggcggctgcccatgtacatcacaaagcgatcctcggtaccctgcccaggctcaggctctgggccctgcaggtagaacttgagggcagtgtaggcagcaaggtcggcaagatcccgtggggtgcgcagctgcacccctgagcgcccgttgaacttcatgggcaccttgacctgcggggcacggtccatcagcgtccaccaccaccctccctgatgtccaccttcccctgggactctcacccaccttactggcagccccccgggcctgggcaatgagctctcgcacgcggccaatgctggcggacagggccaggctggcgttgtgcaccccacggttctccaggatgctcagcttggccagcagctggggcagcgtcttctccagggtggacactgcagagagggagacctgagacctttgccccccaccgtgcccgcctccatcaggggcaccgcgagggccatgggcgcacctgagtggcctgcgtcaagcactgcctggcccaggtcctggccccgcaggccctcgtactggccctgccaccgctccacattctcctgcatggcctgcagctgggactgcacacgggtggcggtgtcctgggcttcagcagccacagccttggcatgtgcgatcttcttgcttgtctcgtctgtggtgggcagagggcaggctcagcaggggccagcggggaccatcctggcttcatgtccccaagtctttctgttgggc

SEQ ID NO: 12424 - DNA, 70511 bp, Homo sapiens
agatacagagacagagagaaacagagacaaagagacagagatcgagacagatggagacaagcagaaacggagaaacagatagacaaagagatagagacagagacagaaatagagatggagacaagcagaaacggagaaacagagatagacaaagagatagagacagagacagaaatagagagagagatggagacaagcagaaacggagaaacagagagatagacaagagatagagaaatagagacagagagttgaagacagaaacagacagagaaagagatacagagatagagacagaaacagagacagacagatggagacagagaggcagagagtcagagggagagagtcaggagagggaggrgtgggagggggacgcttccctctgccccagggaccctggctagccaaggcacacaccagggcgcaggcagaggggatgaagccccgtgggcgtccatgaggctggaagcggctgactgtggggcctggggagttgcccttgcagtgcgggaaagccgacccggatgaggggaggcctttgtcctgaggaggggcctttgcagagctgcaggtgttcccatccatgtgggacccccagccagatgtcccaaggtcggtgaggggccgggccaagctgcctccctctgaggggttctcagcccaggaggctgggttcatgggagacatttgagggtgggctcgtgggggccctggcctcgcccagggcgcagtcccaggttcctgcccaggctctggctctgcccactgggccctcctgggaagtcagattcctcctgggcttcgaggccttctggccatataaggccgtctgtgggcacctcctggagaagctcagaaccctcaccccccacccgccccaccctctatgagaaccagagctcagccaggcaaggacagaggcaggggagggcctgctggagccgtggtcctgtgggggaggagggcacaggcaggccaggccccaggggtagaggctcagggtcccgagtcaccctgcccagcatgctggggcgcccccattccgcctgtttcccctggggttcctggcccctggagctcactagggctccccagtctaggcctgaggcaagcaagtggtaagaatgggggtacggggtagggggaccgcagttaaataagattaaggtgacacgtggaagcgtaggtgcccggcctcggggtggacgctgcagccgtgtgccactgcatgtttaccccgggcgatgccttttctggggctccccagagatctgggggcaggagtcctggactctgcctcacaccccagcaaggtgctgggaggtgccctgacaggggcccccacttgagggaggggatgggttggggtcctgggagcaaccttgttactggaccggccccttccctgccaagttgtaggtggttagatcccagggaggtcccgggccccctccctgggagttcccagggccccctactccttccctcctaaaggctggcagggtggaggctcccctacacccagctacacaggcccaggccggggcaggggcatccaggtgggatcctggactctggactttcggtcgccacgcagaccaccccacagagctccatgaggcccccccatttctgagcaccccaggtttgcctgcttgtcatggggctgggcccgcctgcacagggcaccagcccaagcgcttctccttgccacttgggaagaaaaggagctgggtgggcaagaggagcctcggggagcatctgtggagagcccaggagcccggatgctgaccctctccagatctccgacactgggcaccacctaagcctgtctgcaccccctctggcatgggggcccacctgaaaccccccaggtgtgaacccagtggcagcctttgggtcgggcctcggggagtgggcaggcgtgaggcatgtcacctgcacgggtgacttgtctcctggagccctaaggyggtggccatgctcctggcatggtgcctggcctggaaggctttgaagagccccaagtctgtggagggcctgccccgtgagtggtgcctggggctgcgtggcctgtgagctgggcacacacagcaagtggcagaggggccaggggccaggcagcggtgggtcagagtccttcattcctggttagtgtcaacccggagcctggactctgtgctttccaacaaccacatgtcccagaggccatcaggagcccagcagtggcccagctggggtcacagccagggaggaaaaagcaccactccttccaaacgggctgtttccagaccctgcctaggccaggaaggccggactatccsttggccccatccttctggcagcaggaacctgcagaccctcggaggctggaggcaggtggcagccctgggggaaggcaggctccaggcctgggggaggggtctggctatggctcagggtcttcctgggctctgcctccattcctttgaggccagccccccagggtctgcaactccgggctggctcttacagcagtctgtccaggctgagggcagtgggggcctcctaggccaagaggcccagaagctctcccagtccgctgggtttatgcaatcctgatgagaccttgtcttcccggcacctgctgttctgtgtcctcctcccagaggactgagctggcccacgcgaacagttcagaaccagccttgctgcccgctcccagcttctctatttcatggacagggatggaggttcttaccagccggctccayggaagggcatcccagcagccctgagaaagggactgtggcctccgatatcccaaaccacagcgctggcgttcctccagacctcatcccgctgagacaacattcccagttctggagtgggagccacaaggcctcacccrcaggcccggccctagcaggagcccagcctccagccctccttcttgctcagcccccgcttcctcttgggggcttctcccgagggtacagcacccacttggaccctgggctctgggacaggagggtctgcagagtcatctgttactgattgtggctgcctgtgatgcagctgagtgtgggcgtgggggtgccccatgtcctcagcacagcggtgtccccaggaggctcccaaggtcaggagttcacgactcacggctgagtcagatgtgcctgtggcctaccctcagggtcccccacagctgcctgcaggtgtggccgagtagggtgggggcattctcaggaatgccactggagtagcactgggggctcaggtgaggtggctgcccccagggctccgcagcagaccttgtcccagggctgggggaggatctgagaccccttccccagggccaggagtgcccctacttctctcgggctgccactgacccctgcccccgacccacctcctctggggctccatcaccctggagctgggtgggcaggggctctggatcttggattgtccctggagggcagccagagcctggtgggacagaggctcctccacggccctcccctggcgagccacctccttttaccctcccctccactcccagactgggcagctccctcctgtggattcaggacaggacgtgtttgggggtggggtgccgtctgacctgttgcagggaggaggactacgtcacgggcgggtgcccgaaagatgcccagtaaataggagtaagaaatgaatgatggacaaacttcctcttgctttactaacttgtgtgctcttgattgaccctggcctttttggcctcagtttccccatttgtaaatagaagaggtggctgggctgcgcaggactcagaaagacaaggagacaggctcgctggtccatttggtgatgactcactggaaccatgacaaagacagcaggggtgggggtgtgcagagatgagctgcccctctccctgctcacctccccaaccccctgtgtgtagcccggctgggacagcccccccgccctccatacgctcagctcctgccccagctgcctccttcccagtccgtgcaccagcagacacagggtgggggcagagtgtgggctctttacccagcccctgggccacattctcttgtccactgcgctgcccgcctgcctgccagttgctcccggggcagctgtctgccgggaagcagtgagcccggtgattaaccctgctggtgctggcagctccggctgacacagcgcattctcagggccggcccccgctcccctcctggccagtgccgggggacagcggaggcctggcagcttggcctgatctggccgctaggaggcttaaagtgctctccccacccccacctctccccctgccccgccactcgcaatcccacccctccaaccacccgaccctccagggatcccaagaagccctcagggtctcaggagtctccacctccagtcccccaggctgtcagagccccaagctgtcaagggggagcccagagccagagcacactgcctggggccaagcccccacctggggacccgctactgcccagaggccactctctgcctcacacgggatctaaagcagctcagagccggactctgcgcctggactgcagattccttgaygtctccgccccctctccagccagcccctcccccacttggagcttctcctgccaaggggagccgcctcctctcccccctcccccaggtgggagaactaatagtgaagttatggaagaattgccgggccggaaagtaggaggagggagagagggtcccatcgccctcccgactccgtagagaaagggccatacaccctcttgggatttgagatttgcaggaggccagggcgccaggaaggtgtgcaaggaggtgcaccctccagggacagctgctagctcagaacccccaccagaaccggctggccagtgccccacaaacccacccagccccccgggactgtccagggaacccagcgagagatgagccccacagcccatctgggaccatggcccgcccagctggcctggctcagggatgggggtttgctgccagctcggcagctgcagccccaccccgccgccaccccctcggggcttccctggaggcagatttggccccggagcccaagggaagtaggagacccagggccgcagccacccaaaggcagacgaagacctgatctcggcctctaggtcctgtgctgtttgccaggcgtcctcgagccgccgatcgtggcaggaacgcgtgcgcggctgtgcagcgggttggaggccaggccgagagagctggtggagtccaccgggccccggagcacaggtgcttccaggcacccagcaggtgctcagcagctgtgaccagagcccccgacctccttaagagccaatttggcggctgtggggccatgagcaccgcccccgtcctctaaagggggctgcagctgcaggccagtccctcctgcccctatttccctatctgagagtatttttaagccctgctggggcaggcgggagccaggccgagttgaacctgacctggctgccccaggaagcagggggttcccacctaggctgccccgttcctctgcagatggtcattcgcgggtgcagagggcaccttcccgcagccagcaggacggacgctgttgggggaggagcgggggcagccgagtggtgcacccaagttaggggaacaaagagtgggcccctgggctgggaggagctggtgggcgctctgggggccagggcgtcgtggggagcgctagggtcccacccgggacccggagctacgacctgggctgggggcccggcggcgccgtcgtcccacggcctggcccgaggccagcaggtgccccttccgggaggcggccgggccggggtccgaagggttaaggccgcccggccgcccctccccctcctctctccttcccccccccaccccgcctccccggacctctccccggggctcggggctcgggcgctcgggcgggccggggcggggcctgacgtccgcgggcggagcgagccctgccggccgcctggcttcagacccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccgggtgagcgcaggggcgggccgtggggcttcctcccggggcactcggacccggaacaccggcccgaccccagggggagcgccgtggcccggggcgagtccaggtgcggactctctggttccgcattttgggggcccaagaaggcaccccgacccggccgctccgtctcggccgggaaacttcgcgtccctccgggaaggcggaattaaagtccccggcatggacccgggggcggctgggcgccggtccagttcgactgcggtgaccggggcgggaggggggccgggcccagtccctggcggccccaagtccgggatcccggggagggcgggacttggcctccgccgcctgctgccggtggggagggggcgcagctccgccctacccgggacaggctggaacctgttggcctctggatggggtgggaggggccagccacctgaggctcccactrgcccctctcggaggagtctagggactcgaggagacctccaaagtaggggagggccagctgcgaagttttgactggggctgggaacacgtggctcccaggaggggcagcatctctgcccagcaggtggtagggtccgggggcttcagtctccctgggagatgtgggttcaggccctgaagaccccctggggtgcatgtcccctccccaacaagccttaaacctgtaggcgggttctgttggtggactccatgcatggacacctcacctgaaaaccaaggctcttggggccctgtagacttaggttgggcctggggtcagccttgggtgaggagcagcaaagtcagctccaacggctcccaaccggccgctctaggcccattccccacctcagccccaccttagggagagtctaggggccctgagggcctgtgtaacctgagctgtctcctccctggtacctctgccttcccggaaggagaggctggggcaggggygagtagctggagatttgctgggtgggggcagagggccctggagcaagacgttatggggatgaatggaggagcctgggctgggcccgccccctctgcctgccccacccccttggccctggtggagggggaaggagcctccccaggcttctgggctcaccgttctctccttaagcccagcacagtcctctgagataggaggtctcaagcccacacttcagatgggggatctgagccctggaaagctgctgacacctgcttggagccccccagccagaacagggtccagcgggggttagctgtgggaacctgggtgcctcctggctgcccccttatctggtcaactcagaggggccgggtytcaggacggagggcctgtgactgtctccttacctgctgccacacctcaccacagagggcctggctgagtgtccccagctgagattttgccgttctggcaggggaggctccaggtgccctgtgaacctcagaccacccccccacagcctgcccatgctgcgtggctgggggccacaggccccctctcagatctgtctcctctgtgggggcttattacccccgtctcgtgagtaaagggccagcctgtagtcaacgcccctctcctctgcctcagctgtgtggcttccctctgtcagcctcaagctgtctttaaaatgggcacagcgtgctggcccscctcacctgagactgtgagcttggcccgaggagcctgggaagyggccacagtttcagtggcagctgtgggctgtggtgctccatgcctcagagccagcttggatgagaaaccagccggcctcgcccagctcatgtctagcaatagaggtgaacccttcgcttccaaagtctcgagctctgagcagtgagtgcccgctgaggctgccagatatgtagaaagatcagctggtagacgtgagctggacgggtatgaccttggatgcctccttcatctgagagccgcgggtctgctgaccgccctggccgcggattgggcgtgtgagaagtccttgccggccggtctggagtggagctgcggttggrgcaaggcaggcaggcacaggaggtgcccaggcgatgaagccgcagctccatctgagggggctcactaaggctatggggcctggggctgggcagtgtgttctcaaggctgcaggccaggggctctcagggaccctctgtaggagatgcacattagctgggcatcccagawgggggtcggggtgaaccctgctgggcagctggagcaggcagagggcagggggaggttgtggccctcacagccccaggtgggcatcaggggatccctggccggcccagcctgggaaggtggggactgggcagccaggccagcatggtgactcattggaaggggaagtccttatcggcccttctgctgtttcctagctctgttctcacgggaccctccgcagcggaggtgggggagcctggttttcccaaccctgtcctctgtggctcagtgagtggccgaatggggactggaactgcctcccaataactggaccaacgctggcccaggcagggactgagcaggtgcttccctgacctcctggaagagtagaggctgacccttgacccgcaaccttccacccagcttccctctgctgctcgtgtgtctgggagggtcttgaccagcaagcagccttccctgggaggtccggctgtcccagccagagggcgccgcccacacctaccttctccaggagcccctggccccaccctgagcaggacctgtgtgcgccgtgctgtcattgagctcttgagtttgggggccaccatcaaagcttgcagtgcggcctgcgggtaggggtcgtggcgcttaactgggtgtcttcagttgctctagccccatccacgagaatgcttaggtggtgagctggggacacagcgggaataaggagggtgtggaccctgccactgcagagctctgggggaccccggggaggcccccagataattccaggtctcatacatgcagtaaaggaaatacagcagtggccacactgggggctgcagagctgcatcttgggtggtctggggcaaggtctgagatggggcaatccaaacaccagggcggggtcttgggagcctgtgggaggggtaccgggtgttgccctggtgctcagtggaggcagagggcacactctgggcgagggggttgggccctctgtaggtgctgggcctgggggtggggagaaggcatctccccagctcctgcctcctcctcctaggatgaggtctggccccccaagggaggctgggcggggtagggccgctgactttctcaaactcagattgaggcctctggggcctcaatcaaccccaagcctgggagggcgcctttgtgtggacaaacagcagatctggtttcctgggggrgcgggggagcagccaggacccagctctgccccctctcctcatccctgccccggctcccagcackacccctcccctgccaggatgcaggccaggattctgctgggagcctcctctcttccccactcacccatgcaggacaggcccccagcagatggcagkcccgggacagaagcggctgccaggctgtgtgtgtgagccattactcctcacggtggccccaggcaggtgcagccttatccccactctttggatggggacattgaggctcagcagttactgtgacttggcctcttcccaggactcggaagcagcagccaggaggcccaggcccacctgcygctgtccacacgtccactctggggccggtccccacaggcctccggaacagcttaattctgtctctctggagaccctaatccagaaggctgtgggcaagatctggaggtggggsggggtctggccgcctggatcccggccctgacggtccttctgtctgcagctcccccttccgccccctggcttgctgcattttgtccaagcctctctggagcccctggcagggccagcagggaggggtagccatgctttgccttactcctgccccttcttgctccctttggctctagacacattgatccaccttgtggtttactgtgagactcttcctgcccccagggctcgttgcactggcaccccctctgcctagagcacacccccccccttaccacgtagtgctcagacgccaccccgctagagaggcccaccgagattttcccacccaaggcagatgcccctctccaccctggtcttcctcttgtccttagcgccgtgagcagctcacatgagccacatcccctgagtcggaggagcagcaggtgcttggcgcatgtttgctgagcaagtggatgaggggcgcagaggctgggcgtggaaccagctcagtgggaccaggacttgtctcggggcagcagggtgactgtggaggaggaagggggccccggcccttctcggctatctgaccctcccgttccctctgcagggccagtactgygacatctgcacggctgccaacagcaacaaggcacaccccgcgagcaatgccatcgatggcacggagcgctggtggcagagyccaccgctgtcccgcggcctggagtacaacgaggtcaacgtcaccctggacctgggccaggtagggacccttctttgcrtgctgcagcccccatctctgtgtctgtgcccgtcgggcctaccttgggccacaggaccagaaggcgaggtctccaccgtgagcgagacctggggcctgggaggctggacacgaaggacttggtggggggagtccccacagggacaaaggcacggcagtggtcaccttttgtttgtgctttcagcgtccccatgacacagggaaagcgggtgctcatgggggtgtttccaaaggccacagagtttggttgcgggtgctgagtagacagcttggggctgggagggcggaggtgctgtgagcagtgcggtggtgccccctgcgtcaggcgccctgctgtttaaggaattcctggcaggtgcgggaggggctgcaggaatgcagaggaggctggcgcaagtggacattcctgggatacctgtgccgaggtggcggccactgagggttaggtggggtcgggtgcctgctctccrgtccccagctctgggctctccttggccttggaggcccctgcacaagcaggaggctgcagctgggtgcctccaagcgaagagtgaaacccccaaggtgggcctgcctggctgccagccctgagcacccccagattgggggcgacttggcccgggtacccagccttgaggtcctggcctgtaaaatgggccagtaatcctggtgcttcttaggtcagggacagtggtggggcaggtggaggaggctgggcctgagagcagccagtgcctggagtgggggccccagggctgacccagaggcctgcatcccagccggctcygccgctgccccagtcccagtgtgtgacacatcggtcttcacccctgtctgagcctctgtccctgccattgtcccgagggtgttagagatagaggaggtctccctggagcctggctggagggccggccccaaggggcaggcacctttggcagccttggtggtctgcaggcctggcccgggctgggcaggcagtgaggggagggctcaagctccaaaagtggcctggaatttccaggggttcctgaacttgcagagccctgtggagaagggcggggagctggggaggggttgcctgtcctgggctccctgcctgcctgccaggcccctagccctgccctggcctgggtctgggtgtggctttgcctgtttaccttcatctcactgggtttccccgcatctgactcccctgtcccctggagcctgggggtccctcatctctctggcacagcagcagaggcccccaccttggctgtagcgtacgtgtgaattctcagctgctcggggcgggaagctgggcactggcgagttcttcccgcctctcctcctttgagaaactagggggctgggctgggggaggggagatggcccagtctccacggcaaccccagggtggctgcagagccagtgggcgcagtgcccgatgtgcctgggtggggcagggaagccgggactgacactcggacccacgagcctgggctccaccaccccttggctctggggctctctcggcctcggtgcacatgtatgaactgggctggaaacttcaggcctgaagccagtttgcttttagattgttctgggccagaaatcaggttccgccatgtgagcgtcttgcctctcacagcctcagtttcaccaactgtaaaatgatacggagggaagaggaaccctttccactccacctgggaagtggtccctccacccacccacccatctatccctccacccacccacccacccatctatccctccacccacccatccacccacccacccacctacctatccttctacccacccatccacccatctatccctccacccacccaccacccatctatccctccacccacccacccacccatctatccctccacccacccaccacccatctatccctccacccacccaccacccatctatccctccacccacccactcacccatccctccacccacccacctatcctatcccatccctctgcctgctgacccacccacccacccacccccaacgtatccacccacccacccctacccatccatccacccacccacccccctacctatgcagcacccaccctttattccttgtttccatccatctgtccacctgtctgctcattcctccctccacacctgcaccgtcttccttccttctcacccactttcctgaccacgtggatgtatctaccaaggcccctgtctcggcctaggccagggggctgccagccttggtcagggtgggggcagggactccctggagtggggtggggaaatgtccttcctgggcttcagggctgatcctggggcggggctggggcctccatcaggaagccaggctgagcggcgggtgggtccgggcactccccctgcagcgggctgccagcagcctttgttctgggatctggagcggatgccctgggacgggggtgggggcggctggcactgggcatcgggaaggcttcctgctcctggaaggctraggagggyggggtgggctgcatcacggttcggatctcatacccctggtgtgcggtggggcaggggctggcgcaggggaggggagactagtccctgtggtgtccacccagaagcagctgagcctgggcccccgggagtgccagctgggctcctggcctgggtcccgctgcgcccagccgtggaggggttctctctccaagggtggggcctcaggaagaggctccagcrctggtcactggtgactcagggggcagtttccgagttccagacgtgaccttccccagggggtccttctagggggttcttgcgtatctccttgcatcctccggaagcttctggaactgagcggccacatcactggcctcaggctccttcttccgagaaccacaccccaggccccaggccccaggcccagggaagggtgagcgcgttcatgactgcccaggcacatggccagcgggtcctggcttgagctcccccaccccctggctctgccgcagggtccaggcccttgccccactacaccagcacgctagcccagcgggcccaggttgtaaggagctgggcagggtgagtggggctggctctggcctgtgtcccctccctctccagtcggcccctgggtggcctgaccgtgggggcggggctctccccagcagaggagggcattgcctcccgcctccctcagatgaggagtgaggacgcacgggcccccttccggtagggaggcccctgctttgttctctgtagagcaggccacgctgcaggtgctacaggtggggtagcggctttgtcccagtccccgaggcccagagctgcagggcaaatggggaggcccaggtgggggtcaaggtgtgggggaactggggctggcagggtataagggggcagttaggcatgaggctagaagtattggttgggggcgagcagtgccaggtgagggcctgtgcccctggggatggtggagacccatgggagggcagagtggacaggtagggccggagaggggaggcagtcagctgtcccctccaagtgggggtacaaggaggcaaagctctgctgaagtcattggccactggagtgtgagtttccctaggcacttggggaaactgaggtggggttatgagagggtcagggccagtgtggagtgcccaaggtcccagtgctggggtctggaggactgtggggttggccatgctgtctgcagtctgggttcccgggctggttcctcctctgtaaatgggaggagcaccgcaggaggaggacctgccggaggcccagcgcgcccaggctgcctcacccttcaggactgcctgctctctggctggccggcttgggccctgggcaggcctactggtccagggtgccactggcttggctccctgggcctggttgggcactcagccatgtggccagtgccccaggacggtcagtgggttgtccagggaaggacaggaagtgcagctgcggccaggctctagttacagagctcggcggccgggacaggtgcacgggctgaaccagacgcagccacttgagcagggctccctggggggtacggcgggggtcctgggaggcaccactcccctcccctggcacaggatagacggcaaaaccctccctctacgtgtcctggaaggaggacacggcccaaggggctgccatgccaaggtggggatggggccgctcctctccccgcacccccgcgccatgcttgcccttggtggctgcacggccagacctggcactcagggcacagagatgccccagcacccacctagaccccccaggccctggtggtccccaaaggcttcctgttttctgtctgtttctaaacaagagccaccacattggcctctgacaacacagctcagtgaagacgaaactgtttgggtttcaggccgaggggtccccttgggataatctccacttcctgtgtccccggctgaccatctggcctgacctgggctgggctgcagggagggagcctggagcttgggctgcagtggttggggtccctgaatccaccccaggcccagctctgttgaggtgcgggcagccccctggctgggaacccatcctctccctccagctggggagctcctgtcccccygcccactcctggaagttttcctgtcctgcttaggacatctgtagttgggcatggcggcgtccaaccccagagttgggggttctggcctcagagttgttatttttcttcccagcggtgggcttgctgtggaaacccccggcttttccactccacgtccctctgggagaggtgtctgtgtggggcacgtttccggacccctgataggttgtgtggccgccgtgcttattcacccagctgggggccagtggagatgctcccggctgccgccccgcccctgctgtggggcttatctacgtttccagatggggtctcttcgaggggaggcacacagcaggagcgggcaagggctgggctggcccaggactctgggcatcgagggggctgggtgccccggtgccctgtccgagcagtgcgrtcagggtgctggcccggacgcctggggctaggaggggcttttcctgccccgggaattggcacaacgcccttcttcctgcagggcgggggctgagtcacagaccgctgtgatccaggctgccggggaaggctgactggccctcacccagcacagcgggcacctggacctggccctggtctccccaacccaagatgggtcagggcagagctgggtttgggcacaggacagcaccgcctcccctcctctggaggttccagccacagcccaccccatggtgaggtgggtgcctcagcccaggaggctgctagccaacaaccccacgccatccccagggtccccgaaagccccaccagagtttctctgtagtcctcaccgtgctgcccagaccctagcacctactcagtcccctccgcagctttgccttcggagcgccagtgagtggggcagctccagtgggggcctctcagcgtctctgcggggtggctgctgccctccaggagcagctggcgtcctccctcccagggcgctcaaaccttcatgccctcatgaaaggcattttatcctgatgcccctctctgcagctcttcccactgccctgtgcccaggaaggggaagtgtccgctccagggccrcacaacccctgaagcctggagccggcctgggccctgggtcctgggccccgtactcctggggctcttgcccacccsctgtgaggcagtggtcaccgggcagaggcctcctctgggaaccgtggccctcccagggcaagctgggtagtggggactggagggtgcagtggctgagaggcgggtccggctgccgtcctggagacgtgcctgccccaaaatagccgatttttaaaaataactcaggcagcttttgtttggcttttgctttaaaagacttttttttttctttctgcacagaaccatgtagcagcggaaaggtcagcactggcagctgagctgagcggggcgtggagggggaagggcggtcccgaagccaggggtctgcgctcgctccgggtcatggcgagggcggccggtgtggccctgggagccgcgaccaggtcagagacagatgggagtcctccagcgcgggcttcccttcctgtgaccatctgtgcagccaccaggccctcgaggacagctgtccagggcccctgtctgacagacagatggttgggatgggggacagacaggaggccaggatcttcctgtgcatcccaggggtggggagggcgaagtgtctgtgtccccctcatcctgctgatcagtgtcttcaagtcaatatttgtgcaagtgctctcagctgggaaaaatgtgactggcctgctgaaggggagggaggaggacagatcgggccgaggrgagcgcagcctccatccaggcactcagggaacagcgggggcggctcccagggggctcagtcgggacctttagtctccttcggagcctttggtgggaggggctgtgttgccagctccccgagaacagcctgtgtccctgcccctgtccacctctagcgggtccttccctgtccaggcacaggggccactggcccccacctggggctctctggaatgcttgtggtcaggcccacagggggctgctgaggcccrggtgtggggctgggtatagggtctgtccctgaagaggctcatacccctccctgctgggcagggcatgtctccctgccccccacccacagggaggtagacgatgacctcagagcctggcagccggtgaataggcctgtgccccgccccmaccccggaaggctgcgcttggctcccacagtccccgcaacrccaagccctccgagaagggtgggatttggacctgggatgtctggagtcctggaaccttgccccctacctggagtctgggcagctggtgcccccaagggctgaagctatgaggggtctgtggtcttttcatgggggaccccacagcagtctcagtccggctcagtccagtgggrtgactgtaggtcttgtgcagctctgggggaccccactctccyccttggggccctaggcttccaggcctacctggccaacagcacccagctgttcccrggcgtacctgctgtggggagaaactctccggaggagtgggcactggcgggtcagggtcccgaggaggtgtggtgggtggccctggggtgtggcatgaccctcggaggcctgctggcctttttagggcccacctgggkgcccacctgtgagcagaggaggggctggtccccactgccgcccacaaagagttgggctgagtactgaggtytcccaaggtctccatcgtggaccctgtgggccygtcaggggaggtgtgggccgggacaggcaggccacacctgtgctgtgggtccatgagttgcctctctcccccggcacccgggcctcctcgcacaggcsggggagaggttcgtgtttcctccgcctccctgccaggtccctgtggagcctctgcctgggagagccctttcccctttgtttgagaggggctggggaggggctcaccctcccttggagcctccaggcttgtgacagggcctggagacaacttccctcctttgcccccaggtagggggagccyagggctcccctcagaggctatggcgggtgggagcacttggctgcagcaggggctgagccctggcttgcatgagtgtgaaggcggggtgctgcttgggcaccgccccctcctgtgtgcctcgggaccccccctgctcctgggtgcagcctcttgccattgaggccatgggctgtttttagggaccagagaccttttcagagggggcctgtggcctgggtccatggaggagccacccccacggtgtttcactgttgggcgggtgtgtgtgcacccccaggtgcaggcatggaggcccacggtcatgtcgggtgggtgcagatatgaggctgggtagcactgactgctgggggcaggagaggctcaggcctggagtcctgagggcagggtgtcaggggatgggtagggagggagggagggagggagggagggaagcccaggctgatcagaggcctgaggggagtcagcaggcctggcctgtgcggagagaagggcctgggcctggggagatgtccgcagctgagggttagggggaggggctgcagtcagggaaggcttctctgaggaggtgtacaaagcgtcctgtgaagactgagccaggctstcccccagccccgaggcacagacacatgggctgtccctgggtggaggtcaggctgacacacggggagaaagtaggcagagccaaggtggggctggggcaggggcttggggtttcggrggcctgggaaggagcagctttcctctgccckgggcagggctgccctgacgtgcaccgggccacagcagtgctactgccccagtgcctgggctggtggagtctccgaggcagactcagcttcaagagggcccccagcctgcaaggctgagccccgcttgctccctgcagcccagtccctgggggctcagtgggcccctggctgtgggctggtcagcatgggastgagcagagcctggggaggggtgcccggtgtgaggtgggggcaggggccccatcttaggagctgctgacctgtcagagggactagggggttggacctttggacctgcctggtggcagggaccactgtctggccaccaggcctggctggaygtgagggctgtggggacactggggtgtgttcctgcctccaccctggccagtccctgcctgggccgcaggtaggcctctccctagcttgctccatctgcagccacagagcttgcaggaccatgggggaaccccaaactcctgcggcagggaaggggaggaggcagcgcgttggtcccgagcccaggcggggagcccttccaggagggctggttcccgggggctcatctccatccctggggagccctctcccctgggttcgtctgccccacacaggcaaacccagaggtgccccctgtgcggcgagggtgccacatcccctgctgtggcctcacctgaggggcagaaaatgagccaggcccctgggagcatgggaatccaggcgcccctggctcccctgacgccctctcggcccacaggtcttccacgtggcctacgtcctcatcaagtttgccaactcaccccggccggacctctgggtgctggagcggtccatggacttcggccgcacctaccagccctggcagttctttgcctgtgagtctctgccgccgtggggcctggggggagaggcaggggggtccctgggcaggccctccgtgaccaggcttctgaaggtctccraatacccagccctgccctcacacccggctgctgcggtcatgactgtcagacgaggacycgaaggctcatggggatttattggctcctgtccctggcgtcgggcacagccaagtccaggggctgtggcgccaggaatctctggtgccatctcttggctgcctctggatggcttcatgcaccggcagctcccgtggtgacaaaaggggcctggcagctcccacctcrcctcctgccagcctagccacctgcgtcaagagtactggagtcctagcccggatgctggccgtccctggccccgtgccaccctgaccagtcatgctggtgggagtgggtgctcctccccaatagggcaggcctggtcacgtgtcccccaaaattccctggcctgagaatgkgggaggggcgggtcagtgatgggcagtaggcgtctgtccccaaggaagggggtgaggatggtcgtcgaggggggtcactcgcactcaaagcgtgcaagggagagcggtggggggcagtgcagtccaacgggccaggccccttcagccagtgagctgyggtctctgtcacrcggcctcttggcctgtgggagcctcagtggcaaggccsggagacgtcaaggggccygggcacygcggggacccaggcttttctggtgatccagcgccctcccctccygccattccccgcagcctcyaagagggactgtctggagcggttcgggccacagacgctggagcgcatcacacgggacgacgcrgccatctgcaccaccgagtactcacgcatcgtgcccctggagaacggagaggtgggccggggaggggcagggcggtacgggggctggagaayggagaggtgggtaggggaggggcagtgccgagcggggctggagaagggaaaggtgggcccgggaggggcagtgctgagcaggggctagggccacactggcgtcaccgcatactgcccacagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccgggtgagctgcccatggcgcaggcgggggagggggactggccgggtggacccgggactcagggtgagtgaggcctggccgcctggtgctcacggggcctgcgggtgcagtattattacagcatcaaggatatcagcatcggaggccgctgtgtctgccacggccacgcggatgcctgcgatgccaaagaccccacggacccgttcaggtgaggccccattcaggtgaggccccgttcaggtgaggccccccccagctccctgcctgtccttgtcacccctgcctaacctgagggtgggtgacctggttccatggcccaccacaaccctgctgtctgtgtgacctgcactgaccaccrccgtgtgcctcagtttcctcatctgtgcagtgatgtggaggccagggcatgtgcagcctccccagggtgccctatcttggtttggggggccttgccctactgccagcagaggtggggctctccggacccccaggccagctggccttcccaccatagtggacacctggggccctgtggaggggagtcagcaatggggatgattgatccccgactccaagactgcatcccccggaatggacaggtgcccactacctgccgaggcagccctaattcactttgggggtgcccgcccagctcccccaacctttcaggacacaacagacaacttccctgctgccccagccctgaccttcactccagtcaagcagggaccaaggcccaggayggggatggcagggtgggggcagccaacaccccacatctgctgtgccctgtgtgcctgctttcgggggcagccgagggcactgcagagcatccacctcccgggagcccctcacaggaygggcagcagccctggtgctggcaccggcacattcctgggcctcacccagagtcctcagtaaggtagggccgggctcattctgcggagaagcaaccccagggcacgtccgtcctttcctccctccctkcgttggttctttcagccagcagctgtatgttgagcgcctaacacacgctgggccgttttcctgggaatgggaacacagggtgggaccccagcccggcctcaggagcacctgttccggggraggcagctgggaaacacgcaaaccagtactcagcgtggtgcccggagggtgtaacaccctagggtggcagtgcaggcatggggctggacagaagccactcagagtggtgcagctgaggctgagtgtgtgacgaggctcctggacccccagcagggagctggcagggctcatctagtgcctgcaaccgagcagcccaactttcatgcgcttggatttgggacccgcccttgccttctgtggggccttactgctctgtccacgctccagtttacaggggaggtggggaggcgggtggagctcagacaggacaaaggttcactcccattctcacggccagtgccgagcagaggcgggagccctgggccccttcggatgtggctggtgggtctgaggggaggagtggcacagtcacctgagccggaggacttgggctgtttgccaggagctgtgggccctggggacccacccaggcacttgttgctgccagcacagcttcaggtgctgagctccagcagagctaacttgtcctgggaaattaagtgccaagtggggacgcagctcgtgacagcagggagtggaacccaccaggcagccaaatgggcctccaaggagaggaagggcgcgggagccggggcttgccttggcctgcagggaagacattgccatcccctgactcaccgcacctgggtgtggactgagctcagctctccctgcaggtgcaagcaggggtgactgggaatctttcatggaaccacagcctctgttaccaggacctggtcacccaccagtgtcccaaaacattagcctgcccatgttctccctgcaccctttacccgccaccccacctctcctccagggaagggggctccatgtcatcagccagcaattttctgcctctttacctccaccatcaccttactcccacccaaaccatcacccccactaccagcccactcccaccatcatcacccccaccatcaccgtcatcacccccaccatcaccgtcatcacccccaccatcaccgtcatcacccccactcccaccgtcatcacccccacccatcaccacccccaccatcaccatcaccatcaccatcaccatcaccatcaccatcatcacccccatcacccccaccatccccatccccatccccatcccctgggttgctgcttcctccttcctgaaatgcaccctgtagtttttctattccatgacagtctatccggaattgtctgaaaacggctgttttgtcctccctcttgaatgatagttgagctgactgtaggattcgtggttgatagctgcatctctcagcactttggagaaatgatttgactgtctcttcacctctccaggtgcttgggagagtccattgtccttgcagttgctgatcctctgtgggtcatcttcttctccaggactttttatggtctttttgccattggtgttctgcagatttattgtgatgtgttgaggattgggatttttttcttgctcaggactcacgctttttttttttttttttttttttgagatggagtctcactctgttgcccagactggcgtgcagtggcacgatctcggctcactgcaagctccgcctcccgggttcatgccattctcccacctcagcctcctgagtagctgggactacaggcacccaccaccacgcctggctatttttttttgtatttttagtagaaacggggtttcaccatgttagccaagatggtctcgatctcctgacctcrtgatccacctgcctcggcctcccaaagtgctgggattacaggtgtgagccactgcgcctggccatgtgttcattattaattcaagaccatccttggccattctttctgactgttggctccctttcctacctcttttcccctggagtccccattagatacaggagcaccttctggtttccttctcataatttctatttcctctctctttatcttctgaggtgtcttctggatagcttcctttgctcctcttccacttcactaaatctctcttccactgtgtctgtctgctgtttagcccatccattgagtctttaattttatagtttcatttttcatttctagaagttctgattggttctttttcacatctgcctgttttccatagtgttattttttttattattatgttttagatttcttttttattttattttattcttttttgagacagagtatcacactcttgcccaggctggagtgcagtggtgcaatctcggctcactgcaagctccacctcccaggttcgtgccattctcctgcctcatcctcctgagtagctgggactacaggcacctgccaccacacccggctaattttttgtatttttctttagtagagatggggtttcaccttgttagccagatggtctcgatctcctgacctcgtgatccacccgccttggcttcccaaagtgctgggattacaggcgtgagccactgcgcccggcctatgttttagatttctttatgaccatttttaacattcttccctggcttctactagattactccattttgtgaggttcttggggctctttctgctgacctgccacattgtttctctgcaaggtctttagcagggtttatctttgtgcttctggcgtgccctgggattgggatggttttgggagagcttttgctatacaccccagggtatcgccagcccggcaccacttttcctatcaatttcttgacyatgtggatttttgaaaaatggaacaccagttcaggcccttgcttataggtacttggrgctggtgtgacgacagagcagcttctttgttgatcacctgtgctgacgggcagtttatttcccaattcctctcattgagggtatggccctcccagatgtttctggattctgagggaaagcagtattgattcccgaggccctgtgaggtgggccccgtggaggacaggactagagctggaccatttgaggctctgggtctaatcctcatggactggactgacttctggggtcctgctcagggaacgcacggccctgcagcctccggcagagcctgatctggggcagggactcccgctgtggtctggctaatactgagcagtaggtgcttccaacctcaggccttgtctctctccagctgtcaccctgcccacgggacgtaaggcaagattccagccctgtgacttagtgtccaccccagctggaagaaggaagcagttcttggccacttggccctagggaggtgaccaggatgcctaggagtcctgcctgctaagcgaaatctgagccttggggggtgcaaatggacccctttcccttctggctcagggaggttttgggcttaygctcgagtcctggccgaagtggaaagggcataactcagttttggagaacgcaggtctccatcctgacctgcaggcaagggggactctactgacccctgaggtgccctgtcctaggccccacccggtcagtgcacacctgctccccagtcccgcctccacaaaggccctgtgagaccctgtcctccaccgcctctttccttgtgtccattccctgagcctggggaagttgcgtcagagccacaggctcggggacgctgagtctgggcgagcgcttgctgccggacagctggagaaacagcagcggggggccgtgtccatgtggcaagccaagccatsgaggggatcacaggccccttcagggaagggactgagcacctgccacctgcctccaggatgggcctgatcccccctcctgtgtaccccacaggctgcagtgcacctgccagcacaacacctgcgggggcacctgcgaccgctgctgccccggcttcaatcagcagccgtggaagcctgcgactgccaacagtgccaacgagtgccagtgtgagtgcctcctcccacacacgtgtgtcctgcccacaccctggcccatgagagggccccggtgcccgggccygtggagggcgtgccaacagctgcgctcccctctctctagcctgtaactgctacggccatgccaccgactgttactacgaccctgaggtggaccggcgccgygccagccagagcctggatggcacctatcagggtgggggtgtctgtatcgactgccaggtgggctgggctagagkgctgggaatgggctggcccygaggtggggcagggacctccccagactcaacggccattgcactcccagcaccacaccrccggcgtcaactgtgagcgctgcctgcccggcttctaccgctctcccaaccaccctctcgactcgccccacgtctgccgccgtgagtgggctcagctgggcgggtgtcctgggtctcagggtctgcctggaaagaggtgttcttgggcctttggggctgctttggaggggatgtcctgagcttccaggccagcccaggaaggagcctcccaggccacggggcgggtccccagccctcatgtccccccagggggcctggctgtagccctcatccccatggccctggctggggaggtagagactgccacatcttggagccyaccccttgagtcctggtagctccaggcttacccggctcctgcccctgcccaggctgcaactgcgagtcygacttcacggatggcacctgcgaggacctgacgggtcgatgctactgccggcccaacttctctggggagcggtgtgacgtgtgtgccgagggcttcacgggcttcccaagctgctaccgtgagcacctgccaggggcatccaaacagacaccactgcctgctggactccgggagccctgcagggggtggaggggttccccgggayggaccrtgttatcctgcctgcatctccgattgtgctgagagaccaagggtggcagggggtgtagggtgctagggttctgagcagacctggccaacatgcgtgtctcttcccctcagcgacgccctcgtcctccaatgacaccagggagcaggtgctgccagcyggccagattgtgagtaagtgtccttgaggcccccaggtccccggcctgccctggagccatgggggcggcttcacagaaagttcctggagaaagggaggattttcatttggtcactttatttttggcttatttctttttatgcaaattatgcctattcacactggaaaaccttcggaaatataggtcrgcataaagccaaagaaaaaagttagcccaggcaacatggtaaaaccctgtctctacagcaaatacaaaaattagcygggtgtagtgatgtgtgcctgtagttcgagctactccggaggctgaggtggaaggattgcttgagcctggaaggccgargctgcagtgagccatgatcacaccacagcactccagcctgggcaacagagtgagaccttgtttcaaaaaagaaaactgggcatggcacatgtatacatatgtaactaacctgcacaatgtgcacatgtaccctaaaacttaaagtataataaaaaaaaaatagaaaaaaaaaaaaaaaagaaaattggttgggcacagtggctcacgcctgtaatcccagcacttcaggaggccaaggcaggtggatcacctgaggtcaggagttcaaggccagcctggctaacatggtgaaaccccgtctctactagctgggcatggtggcgggcacctgtaatcccagctactcaggaggctgaggcaggaaaatcgcttgaacccgggaggcggagcttgctgtgagccgagattgcaccactgcacccccgcctgggcaacagagcgaaactccatctcaaaaagaaaaacaaaaacaaaaagttatccacaattcccccagctctgcacagcgcttgaatgctctctgtacacaagcacttctctttcacaagcttcgtcatgcgctctgcaccctgtcctgtgattacatcccaaccacaatcctgtaaacacattgtcttgtggtccatttcatagggactaatgaagtatttatttaaacaacccccagtggttggaaatctaggttctttttttttttaattatgctgtgataaagcattattaagatgaggtagaaaactggccsggcacagtggctcacacctgtaatcccagcactttgggaggctgaggcaggtggattacctgaggtcaggagttagacaccagcctggccaacatggtgaaaccccatttctactaaaaatacaaaaattagccaggcgtggtggtgygtgcctgtaatcccagctacttggggggctgaggcaggagaatcatttgaacctggttgcagtgagctgagaaccaccatcacactccagcctaggtgacagagcgagactccatctcaaaaaataaatttaaaaaaaaagagtctcccagcatacagtcacagccacagagcagcatggcacctgctgaccaaatcattgccattaccacatagcagtctatcactcttggcttgatagacaaaaaatattctcaagtcagagccatgttcccttgctttttagtgtttctggaattgggatgcgtcttttgcttgatggcatatcacagtctagttggtagggtttttccctttcatgacgggacatacaagcatggcatctttcccagtgagtggggtcttagacttagattgtatttgatatgacgtcttttttttttttttttttgagatggagtttcgctctttttacccaggctggaatgtgatggtgtgatcttggctcgctaccacttgtgcctcccaggttcaaacgattcttctgcttcagtctaccgagtagctggggttacaggcatccgccactaagcccagctaattttgtatttttagtagagacagagtttctccatgttggtcaggctggtctcgaactcccaacctcaggtaatccgcctgccttggcatcctaaagtgctgggattacaggcatgaaccaccatgcctggcacgatattgtgtcatttttagctgcactttgactactctgtaagcttgaatcttcttgacttttcgagtgctttcttttttttttttttgatggagtttcactctagttgcccaggctggagtgcaatgctgcaatctcagctcactgcaacctctgccccccgagttcaagtgattctcctgcctcagcttaccatgtagctgggattacaggcatgcgccaccatgcctggctaatttttgtatttttagtggagacggggtttctccatgttggtcaggctggtctcgaactcctgacctcaagggatctgcccgcctcagcctcccaaagttccgggattacaggcgtaagcctctgcgcccagcctgtatcacctatttcttataagttgtgtgtttttctcctgatgggtcatttgccccttattttgggggggagcttttttccgtgtcctgattttgtaaattttgaggtgaatctgcccacgttgttctaccgaatctctggctgagtcggatgtagatgctcctcccttacccaggaattctcttgtctgctggttctgtgatggtttttttatgtggaaatgtttagtttttcatcaatagtgtaaaccaggggtcaacaaactgtcggaaaaggcccagacggtaaatgtcatagactgagggccgtgtggtccctgtggggaaactcctcagctctaccgttaccagctgtagcttgcaagcagccatagaacgcgtattcatgagtggggttggcggcgttccaataaaactttatttacaaaagcaagcgaggagtccatagactagtttgctaatcsctggtgtaaactgacaatttatcttttcgctactgggccatagtaagcactcagtaattacctgtggctgtacagtattcactttcaatgtgttcattacaatgaattgtattgtctttcctaatggggacacagtgttgaacatcaatattttattttgtctaaattcacaagtgagattgttttggttttgtaaaatacttgggaaatcatccacacttttttatgctcccaatcagtttaaaaatcacagaaattatttacttgttaaaagtctggtcaaacttacaaaaccctttagtcctgatacctgtttttcttttcttttttttttgtttttttgtttttgtttgagacggagtctcgctctgtcgcccagactggagtgcagtggcacgatctyggctcactgcaagctctgccttccaggttcacgcyattctcctgcctcagcctcctgagtagctgggactacaggtgcccgccaccacgcccggctaatttttttgtacttttagtagagatggggtttcaccgtgttaaagcaggatggtctcgatctcctgacctcatgatccacccgtcttggcctcccaaagtgctgggattacaggtgtgagccactgagcctggtctctgatacctgtttttcaacagagatcttaaattaaggttttaatgtattctgtggctattgtattcaattttctacctcatcttttttttttgagatggagtttcactctgtcgtccaggctggagtgcagttgcacgatctcggctcacttcaacytctgcctcctgggttcaagcgattctcctgcctcagtctcccgagtagctgggattacaggcacctgccaccacgcctggccaattttttgtatttttagtagagacggggtttcaccatgttggccaggctggtcttgaactctgaccacaagtgatccacctgcctcggcctcccaaagtgctggtattacaggcatgagccaccacgcctggccagttttcttcctcatcttaagtcaggtttgattatttgtattagcaaattgtgtattttgtttggattttttaatgtattgacataaagttatgcacagtggcctgttataaagttaaaatttctgttcatttctattctcgtctatttttatttttattttctttcttcttctttttttttttttttttggttgatcagacctaacagaggttcgttgagtttattggtctgttcgaagtacaggtgcagttctcttgataagacctgctgaggtttttctttctttagttgggaggagagattttcctttctaatattcaatttctttaatccactttctttgatttatcactttttwaaaatagcttcttgagttattatttttagtctgtcttcattcccaacaaaaaggcttaaagcagtggttctcagccagtggtgactttgatgcacaggaagcattcgatgatgtctggagacatttttggttgtgacgattgatggatgtaactgatccagtgggtagaggctagggatgctgggaacctcctacaacacaggactgctcctgcacacataacaaagagttatccagcctggactgtcagtagtcctgaggctgggaaactctagtttaaagctataaattttcctcagagtatacctttggctaggtatcttgtagtttgagatgtggggtgtcctcattgctgtgttttttttaaatagtctatcatttggggttttattttctttcaacccgtcactgttcaaggtgctgaggtttccctcctgtccttttcgtggtgtgcagttctggttttgctgcatcgtggttagacttggcacactgatagtttctgccttttgtctttggaatttgagattttctttgtttctaacctagaatgtgacgayttttattttttaattttatttatttatttatttatttatttatttatttatttattttgacacagagtctcactctgtcacccaggctggcgtccagttgcacgatctcggctcactgcaaccaccacctcctaggttcaagcgattctcctgcctcagcctcccgagtagctgggactgattataggcgcccaccaccatacttgggtaatttttgtatttttagtagagatggggttttaccatgttggccaggctgatctcgaactcctgacctcagttgatccacccacctcagcctcctaaagtgctaggattacaggcatgagccactgcgcctggcagtttctgccttttgtttttggaatttgagattttctttgtttctaatccagaatgtgaccacttttagattgttccaggaacattggacaggaatgtgtgttctctatggagtaccgatttggcatgttaaagcagacttgtggccaggtgcgatggctcacgcctgtaatcccagcactttgggaggctgaggtgggcaggtcacctgaggtcgggagttcgagacgagcctgaccaacatggagaaaccccgtctctactaaaaatacaaaataagctgtgcatggtggcgcatgcctrtaatcccagctactcgggaggctgaggcgggagaatggctcgaacccgggaggtagggtttgcagtgagctgagatggcgccactgcactccagcctgggcaacaagaacgaaactccatttcaaaaaaaaaaaaaaaaaaaaaaacaaaggaggcttgttcattatgctcttcaaacccacagtacccttgctcaatttctgtccctctgagctgtcacagtctacctatgtatctccatccagtctttgtctctctctgactctggtttgccaaattctccttgccattttaatagttttagcttccctcacctccaggacacgttacctgctcctagagattcgtttctgctgcccgttgggtgacatgcctgagcttccctctgtctcgttaccgctgtgccttccgtcctcactcctctgtgtttgcgtccaccccagctccctgcacacagctctcggtttaccacctgtctgaggcgttggtttaaggtacgctctttcaagaggctatggctggagtttcctcttggtcacgctgacgtcttcggtttttatctcatgaaggagacagcscagccccacgatcgtccttgcctctgtcagttctggctggctcctgcccttgtatcatttctccttttctgctgaaacatttcctttcctgactttcacaagttagagcaagaaaacgtgctttgattttggtctgtttgtttttgctactgtttcctctctggggagggtttgcaagctctctttctgtgttctggtctgaccagtggttactcttacatttttgacaagtattgaacctttatttttctatcagtaacaaaaactgaagcgtgctcacaaccctcctttcatgcgtaagttaagacatttgatacattctttctaccttcttcccaacacctgacattgtttctaaagaaactataattttaatcccagcactttgggacgccgaggcaggcggatcacgtggtcaggagatggagaccgtcctggctaacatagtgaaaccccgtctctactaaaaatacaaaaattagccgggtgtggcagcgtgcacctgtagtcccagctgctggggaggctgaggcaggagaatggtgtgaacccgggaggcagagcttgcagtgagcccagatcgtgccactgcactctagcctgggcgacagatcaagactccgtctcaaaaaaaaaaaaaaaaaaaaaaaagaaactataatttgttttgcagcttgttttgagttttgatttgtttgtattttctctttgtgttaatgcttgcagctaactaggaatctacgtaagaaataactaatgaagcgttttgatagttggcctgactttgttgcacatcactgttttcccaaacacgcctctcccttgttggaatttttttttttttttgagacggagtctcaccctgtcgcccaggctggagtgcagtggtgcgatctcggctcattgcaacctccgcctcccaggatcaagcgattctcctgccccagcctcccaagtagctgggattacaggggtgcaccactacgcccagctaatttttgtatttttagtacagacagggcttcactatgttggtcaggctggtctcgaactcttgacctcatgatctgcccgcctcggcctcccaaagtgctgggattacaggcgtgagccactgcacccagcccttgctgggatttttattattttattttctagttagtgttgtgtaaaagtgtaagaaaatgagtttgtggagagggaaggtttgccaggaggggcgtactggggtctgcagggcatctgagactcccctgcctgtccccaccctscagattgtgactgcagcgcggcagggacccagggcaacgcctgccggaaggacccaagggtgggacgctgtctgtgcaaacccaacttccaaggcacccattgtgagctctgcgcgccagggttctacggccccggctgccagcgtgagtcccctctccccgctcaacctctrcctgcgctcgaggtggacacctgaggcctggtgcctctgaccaagcatgtgggccaccctttcctgcagcctgccagtgttccagccctggagtggccgatgaccgctgtgaccctgacacaggccagtgcaggtgccgagtgggcttcgagggggccacatgtgatcgctgtgyccccggctactttcacttccctctctgccagtgtgagtggtgcctctccacgtgggcgtgggtaggggaggcccgtgggcctggcctaccgtgacacccgctccgctctgcagtgtgtggctgcagccctgcaggaaccttgcccgagggctgcgatgaggccggccgctgcctatgccagcctgagtttgcyggacctcattgtgaccggtgccgccctggctaccatggtttccccaactgccaaggtgagcaragggtcagggcaggaaggggttctgccacccacatggcgccagggcctgaccccattgtccctctgcagcatgcacctgcgaccctcggggagccctggaccagctctgtggggcgggaggtttgtgccgctgccgccccggctacacaggcactgcctgccaggaatgcagccccggctttcacggcttccccagctgtgtccgtgagtgcctagggaggaagtggtggggaggcaggtgcagtctccactgcgtgcccacagctatccttgtctgcagcctgccactgctctgctgaaggstccctgcacgcagcctgtgacccccggagtgggcagtgcagctgccggccccgtgtgacggggctgcggtgtgacayrtgtgtgcccggtgcctacaacttcccctactgcgaaggtgagcaggcaggtggctgtgtgcaccaggtgccgggcctgtgtgtgggtctgtgctgttcacacgctgcctgccttcctgtgaggctgttcacgtgcatcttgctgtgtgtactgcgactgcgtccccacgctctgtgttcgcaccttgttcacatgccgtgcaggggtgtccgcgtactgcccgtgtctgcgtgctgtgcatccgcgcctgtcgtgtctcgtatgggtgcatgtgttgcgttctgtgtgtgtacgggtgtcatgtgttgcttgtgtgggtgtgtgtgtcacctaagtgtgggtgcctgtgtcacgtaagtgggtttgtgtgtcacgtgggtgcatgtgttgcgtgtcgcatgtgggcgcgtgtcgcataagtgggtgcgcgtatcgctatcgcgtgtctcaagtgtgggtgtgcgtgttcatgtcctttcacgggcgtgtgggtgtgttagtgcacgtgtagtgggtgcatcttcacgtgcgtttgtgtgcttgttcagacrtgtgtcacacactgcgtgtggaatgtacacgggtaccccacgcggtgcacgtttgcgtgcatgtccatgagcaggtgctgtgtggtgggatggcacgtccgttgctgcggagggagcagggaggtgcgtgttttcaggccgtccatgtggatgagaggyacctgtgctggtcctcagctcctgtgggaccgtgggttctggctgggcctgggacacccttggccttccgggttggtcactgggaaatgaccgaggcatggtcctctcttcacagctggctcttgccaccctgccggtctggccccagtggatcctgcccttcctgaggtgagcccaagtctgctcgtgtgtgggagatgggtgaggacccaggccaagctaaaagtcccgagtccggtgagaccagggcttcctgcctgctgctcagttgccatggcaaccccagggcctgtctgctccttaggctggtcctctgcccccactgcaggtgactcctgtgagtcacaggtgagggccctcagccctcaccaccccttgtcagggctctatggctctatggtttgtgggtgggagagcagggcgcccgctctgacctgcagtcttgtcctctcccaggcacaggttccctgtatgtgccgggctcacgtggaggggccgagctgtgaccgctgcaaacctgggttctggggactgagccccagcaaccccgagggctgtacccgtgagtgtgccctggagtattggggtacaggggttccttggggaactgtgcccacaagtatatcctggagggagtgttggggtgcagggttcctggaggggctggagccagtgagtgtgccctggagggagtggtgggatatggggttcctcggggattgtacccatgagtgtgccctgaagggaatgttggggtgcggggttcctcaggggggctgcgagtgtgccctgagggagtattgggggtatgagggttccttggggggctagagcctgtgagtgtgccctaaagggagtattggggtataggggttcctcggaggggctgcacctgtgagtgtgccctggagggagtgttggggtgtggggttcctcaggggatggcacccatgagtgtgtcctggagggagtgttggggtgtggggttcctcgggattgcacccatgagtgtgtcctggagggaatgttggggtgcaggggttcctgggggggtactggagtccatgagggtgtcctggaggaatgttggggtgcagggggttcctgcgtgggactggagtccatgagtgtgccctggagagagtgttggggtacggggtttcctcggggtgctggagcctgtgagtgtgctctggagggggtgttagtgtgtgggggttcctcggaggggctgcacccgtgagtgtgccctggagggaatgttggggtgtggagttcctcaggggattgtacccatgagggtgtcctggagggagtgttggggtacaggggttcctgggggggggctggagtctgagtgtgctctagagggagtattggggtatgggatttccttggggggctggagcctatagtgtgctctggagggagtgttggggtataggggttccttggggaactgtacctgcaagtgtatcctagagggagtgtcagggtgcaggggctcctgggggtgctggagcctgtgagtgtgccctggagggggtgttagggtgtgggggttcctcggggggctggagccaggctctcctgccccaccaagcatctgagtcctgccctgctctccccaggctgcagctgcgacctcaggggcacactgggtggagttgctgagtgccagccggtgagtctgaggaccaaggtgtgggggatttgggggcacactggtcaggaccctcccctgccccacttcacctcctcccttggcccccagggcacyggccagtgcttctgcaagccccacgtgtgcggccaggcctgcgcgtcctgcamggatggcttctttggactggatcaggctgactattttggctgccgcagtgagtgcccactcgctcgtcccagaccacagccctgcctcccctcggtttatgctggggaacccaaggcccggagggacaagtgcagcctgggcagcatgargcccgggtgatggatggctgccccttggtgccagcctgtgccagggtrtgggagagggggtgcagctcccacccagatgcgtggcttcctctcccctgtcctacacctgggcagacggcactaacagatcccagcgccctcaccctcgccctcgccctcgccctcgccctgagccctgagccctgagccctgactctccatcatccagagagccccaggcaggcttctcagtctggctgtgaggggcccctgaggctgggtgggggccaggcagcctctgacctcccaccttctccctgcaggctgccggtgtgacattggcggtgcactgggccagagctgtgaaccgaggacgggcgtctgccggtgccgccccaacacccagggccccacctgcagcgagtgggtaccccttccccactgggtggtggggagcggggcaggcagcttgtcctccgggcmtctccgtgtccctcaccatgggcccacgtgaggcctcaccctccctggagayccggggccgctgtgcagggctaggtaggatggccaagctgcacctgaccagcccctgctgtggccaggcctgcgagggaccactacctcccggacctgcaccacctgcgcctggagctggaggaggctgccacacctgagggtcacgccrtgcgctttggcttcaaccccctcgagttcgagaacttcagctggaggggctacrcgcagatggcacctgtccaggtgggcgctgtgctccccctcccaggctcagcctagaagtggagccaggcgtggctggcagggaggggtgggcaggccccttgaaggcccaggcctcaggctggcagtggtcagggagagtgacccgacgctccatgcccacccagcccaggatcgtggccaggctgaacctgacctcccccgaccttttctggctcgtcttccgatacgtcaaccggggggccatgagtgtgagcgggcgggtctctgtgcgagaggagggcaggtcggccgcctgtgccaactgtgagtggggtccctgggccacagcccctgccccaccagcccagcccaccccaccccaccccaccccactcccaagccctgccaccttcctctggctcatgtgggtggtaggaccagcctatccccaaccctgtagggggtgcagcctggggtggccccaagggctgggctcaggagtctcacccctgcccccgcccaggcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggtgaggcaggggccagagtgagggctgggggccgggtcagggggtggggcccaccactctcagcaccacctccaccctgcaggactacgtggttctgctgcctagcgcatactacgaggcggcgctcctgcagctgcgggtgactgaggcctgcacataccgtccctctgcccagcagtctggcgacaagtgagggccatgcgtgcggtgggaccggggtgggggcttcctggacccccactgtgcctggcttcccccactcaggctgtctctggggacctgggtggacctggggctgaccacggcctgtgtccccccagctgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtgcgtgtcctgggaccccacggagcaatgggtgttgcaggaccttggcctgggggctgggggtcctgtggcggtggcaggttataggagcagggcgctgcctcaggcaatgsagcccagcacccaggcagggcgcccctgcctcctgcctcctgcctcctgcctcctgcctcctgcctcctgcctcctgcctcctgcctcctgcctcctgcctcctgcatgtgtgacctcagtgcctgtctgtatgtaggattggctgtggcctccacatacagctcagcccccaccacttgcctggagatgtccgggccagggtgggactcggctgaagggcaggccctggggtcagggaggcgctggagtgggaggggagggaggtgggaagggcgaggggtggcgggcctcccgtcaccctgccttccctgcaggtggacgtccagcttcaagtggcagtgccacagccaggccgctatgccctagtggtggagtacgccaatgaggatgcccgccaggaggtgggcgtggctgtgcacaccccacagcgggccccccagcaggggctgctctccctgcacccctgcctgtacaggtgagtgggagccggtggggctggagtaagggcacgcccggggctgccccacctgctgaccaccctccccccacagcaccctgtgccggggcactgcccgggatacccaggaccacctggctgtcttccacctggactcggaggccagcgtgaggctcacagccgarcagkcacgcttcttcctggtaaggacccctcaggtccccaccccaaggggtcagcttctttcagaagatttgaaacatgcatgagaggggagaggacagttggggtcccaggtccccaaggcggccacactcgctcatgcccagcccagcatgtttcttctggaacccctcctgcaagcgttttgtggattcagtcccttttgacgtacccccgagctgttccatgtgctcaggaaagcacctgcagtcacagctccctggccccagggcagccacctcctggcacagacagcgttggttgcctgttctggaactttcttttctttttttttttttttgaaatggagtctcactctgtcgcccaggctggagcgcaatggcaagatcttggctcactgcaacctccacctcctgggttcaagcgattctcgtgcctcagtctcccaagtacctgagactataggcactcaccaccacgcctggctaattttcgtatttttaggagagacagggtttcaccatattggccaggctattctcaaactcctgacctcaggtgatccgccctcttgggcctcccaaaatgctgggattacagacaggagccaccatacctggcctggmactttctataaatgccacacaacatgttctgtgcagccgcgtctcccaccgttgtgtcagcggataagttgccgtgttccgagacaccaacctcacatggccgcacggaaagggagcacccatttgcggcttgtgcctgctgagtgcctgcctgggtcaggtcctgggagagctgggcctggcccggcctggtggcaccaagcagcactcgagataagagtgggggaacagtgacggatgggagggcgagggggaggaagagggctatgggaggagccgcataggcctgtgggcccaggaactggccaacacgctggtctgcggttggggtttgtgcagctggaggaggagcaakggcatcttggaaagagcagggctcggtcggacgcctgggtttgcagtttcctgggtctgagctgtgtgaccggcccccccatcgtaccgcctgcaccccccatcgtaccgcctacacccccccatcgtaccgcctgcaccccccccatcgtaccgcctgcactccccatcgtaccgcctgcacccccccatcgtaccgcctgcacccccccatcgtaccgcctgcaccccctatcctccccgcaccacgggcgttgcagcatctcgtccctctgcctgcagcacggggtcactctggtgcccattgaggagttcagcccggagttcgtggagccccgggtcagctgcatcagcagccacggcgcctttggccccaacaggtaatggcaggtaatggggctgggaggggcgcrgccgagggcccggcggcagggccggctctgactcacccactgtgctctcaccagtgccgcctgtctgccctcgcgcttcccaaagccgccccagcccatcatcctcagggactgccaggtgatcccgctgccgcccggcctcccgctgacccacgcgcaggatctcactccagccaygtccccagctggaccccgacctcggccccccaccgctgtggaccctgatgcagagcccaccctgctgcgtgagccccaggtgagggccatagtctctagagggacrggggtgtcagggcaggactccgggycccaacccagggcaggttgtccagggggcrgcaggggctcatagctcagcctgctcactagggcctatccctgcaggccaccgtggtcttcaccacccatgtgcccacgctgggccgctatgccttcctgctgcacggctaccagccagcccaccccaccttccccgtggaagtcctcatcaacgccggccgcgtgtggcagggtgagtgtctggtgtggggggtggagaggctaccacacacgatgagrctggaatgccggcgccacagcgtggcctgtgctacctgctatgagcgacaggcaacatgactctgtcctgccatcarttctcaaactagctgcccttgcagcccgcagcccctacccgcccgctcccgttcccagaaaagcctgggtctcgcctctgtctcgtgcgttgggaagccccgttgtgctccatggcacgtggcgaattgagggcttgccccaggatgccgctggcagcacatgtggccctgtgtgtttgtctggttcctggctcggccaagcctggkgtcccgcacatggagttgaccggtacctagaggtgtcccgcatgacatctgtaggtcatgatgcggccaacccccgtgacatgaggggccggccttgcagacctcttgggcacgtcccgtgcctgtggccgttggccagcgggcactccttggctgccccaacgctgccatcttcaaccctctgggtgtcttgggggcgctagagatgggggcctgaccctgcctttctcccccgcccaggccacgccaacgccagcttctgtccacatggctacggctgccgcaccctggtggtgtgtgagggccaggccctgctggacgtgacccacagcgagctcactgtgaccgtgcgtgtgcccragggccggtggctctggctggtgagtcccagctgatgtcctgctcagggaccagctgtccttatacttgtcattaccactgtggtacacttgggctgggtctgtctcttctgggcctgctgaggcctggccttgtgcccagcaaagcagctcctgcctttggggacctcccgatccaccttgtgaggctccagaggggccctggaccctgcaccctgcaccctgctggtcagggtggccttcctggaggaggtggggcctccaggaaggagagggaagaggaaggcgtggccagcagacagagatgtgggagacaccaggaggtctcatgaatgctgctgcctcctcaygcccccgaaagctgctgtttggcttggagtggcctcccctgagcagycagggcccabggctgggctgggctgggctgctgctgccaggactctgagctgcctgcaggaccctggtcccagccagcctctgggggcctccccgctgcaggctctgggccygcgggagagtgaccaggcctcaccccctaggattatgtactcgtggtccctgagaacgtctacagctttggctacctccgggaggagcccctggataaatcctatgacttcatcagccactgcgcagcccagggctaccacatcaggtgggcagggctctggcaggtcaggggtccggggtgggggtctgggccgggagctggcctcaccacgtgcccctccatgtagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggcgtgagtaccccagtccttgggcgcccagtggcagggagttggtgccagagcccaaggtggacgggtcgaccagaaagcagggtcaggagaatgttctagagcctggcagggcagcattgctgccccatctgcgggcctgggcccaggactycagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacactgccacatcccctagggctgcattctgggcctctgagaggggcgggactgggaagaggggtcagtaaaccctgtacccgccccacagcctgtgactgcggtgcccgcctctgtgacgagctcacgggccagtgcatctgcccgccacgcaccatcccgcccgactgcctrctgtgccagccccagacctttggctgccaccccctggtcggctgtgaggagtgtaactgctcagggccyggcatccaggagctcacagaccctacctgtgacacagacagcggccagtgcaagtgagagcccagagcggcrtcagcgcggcccctggtggccttaaggacagcatttcctctagccagagggtcctggcacccaccctgctcccatttgtgctccctgggtgcagcagcgccctctcctccacttctgggaggatgctgcctgggtggggggtgcctacgaggtctcactttggtgtgagtgacctggggtggagggggctcagctcccgcccctgccacaggtgcagacccaacgtgactgggcgccrctgtgatacctgctctccgggcttccatggctacccccgctgccgcccctgtgactgtcacgaggcgggcactgygcytggcgtgtgtgaccccctcacagggcagtgctactgtaaggtgagtgagggctgggcccagatctggcctctccctccrgcctcatcagctgaaagtgtccttacgggcctttcggggcagctggggcttcctagaagcttttgggagagtcatccccattggcaggtgggtaccaggaacccggggtcaggcacctggcacctgccgaccactctcactgtcctctcatccctaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggaggtgcgcctgcaggactgagggcattgccttctcggggaggkcttaggtgggactggatgcaagatggggccctgtgatgtgtgggcatccacccrtgtgcagccacacgtgtgtgcccacagttcgtggayatggagggatgggtgctgctgagcaytgaccggcaggtggtgccccacgagyggcagccagggayggagatgctccgtgcagacctgyggcacgtgcctgaggctgtgcccgaggctttccccgagctrtactggcaggccccaccctcctacctgggggaccgggtaagcagggcatcaggtctgggggaggcactttgaggatggccaggacgcctgagagggttgggagccaggagyggggtctgtccagggarggggagctccatgggggtccgtgagggtgcccaggccctgtcccggtagggaatgagcgcaagtatccaggcccagcacagggctctgtgctgggggtgcccagaccactrctgacgggctctgagcctgtggccagagtctggccaggtcacctctgtctgtcctgcctccaggtgtcatcctacggtgggaccctccgttatgaactgyactcagagacccagcggggagatgtctttgtccccatggagagcaggccggatgtggtgctgcaggtgagggagctgagatgatgtggcagggtggttgggtgggcgtggcgcagtrgcaccgtggtccaggcccgtgccaaccctcacctccccatgtgccttcccagggcaaccagatgagcatcacattcctggagccggcataccccacgcctggccacrttcaccgtgggcagctgcagctggtggaggtgaggggagctggcttgggcacccaggtccctcatggacctcagctcatctgggaaggccggaaggggtcccagtgctgctgtgcccattctccgtggtggaaaasagcccaggagcagaagcggggtgggggctggggaggtccccacacccattgtcagatatcttctgygctggtcaccctggggggtgtcatgctgtcttcccacctgctttgtgagtccctgatccctgaggggtgagcagctgctcagtagctgttggcttcctccatgcactgcctgttagcatcttttgcccatttctctttgacttgcaaatctttttccatccttttagagttctttgttattcttggtgcttaccctctgtcagacttcagagtaacaaccgtcttctcccctctcacagctcatctggtttttctttgtttttttttttttgtttgtttgttttttgagacagtcttgctctgtcgcccaggctggggtgcagtggtgcaatctcggcttactgcagcctctgcctcccaggatcaagcgattcttctgtctcagcttcccaagtagctgggactataggcacccgccaccacaccctgataattgtgtattttcagtagagatggggtttcgccgtgttggccaggctggtctcgaactcctgacttcaggtgatcctcccacctcagcctcccaaagtgctgggattacaggcatgagccaccacacccagcctgagctgtcttctgatgaacggccttatagttaatgtacttgaatttatccttttttccttggcagcaagcgtttttgcatcttgtttaagaaagtatttgtcactacttgatcagaaaggacctgcctatgttttcttctagaagcttggctgttctctttgtgtatttcaattcttaaggcatctggagctggtttgatgtgtggtgtgaggcagggatctaggtgctggctggcctcatgggagactggtttttctacctgtgtgtacctcctcctgccccatggtctttgtgcccctccatcccctacagggttggggggtctgttctaggctccctgttctgtcccattgagtgtggccccactgaggtgccatcctggacccacaggggaacttccggcatacggagackcgcaacactgtgtcccgcgaggagctcatgatggtgctggccagcctggagcagctgcagatccgtgccctcttctcacagatctcctcggctgtctycctgcgcagggtggcactggaggtggccagcccagcaggccagggggccctggccagcaatgtggagctgtgcctgtgccccgccagctaccggggggactcatgccaggtgaggttaggacagcaccagactgcgaggcggctcacctgtgcacacccttccctccagcatcctccctgtgttcccttccttgctgcctccacttcctgtcaccctactcacctctcttcctgcccctgcttttcgcaggctgctggccaactcatgggcctgcctgtcccctgctgcctgtctgcctgcccctcgtctgcctgcccctcatccgcctgcctgcccctcatccgcctgcccctccatgcacacaccctccatacccctttcccacctaccccagcccccaccactgggtcacctggacatcccccaccgaccatcctggcgtctgcctgtcattctgcccatccctcgcccactgtgtgtctgtccagctgctaatctgccctgctaatctgtctgtctgctgtaactttgctccttctgtatgaggaggtttgtggttgaatacctcctagaaggagtggaaagagyaggccctggtccacatggagtgggtggtcaccagccccaaggcctggtcattcccgagacaggacatccgtgtggctttgagagctatgtcctcaaacagcagccaggtgctggcccacctccagccggccgaggccaggagttcctgaccagcctctgacccagcggtgaccatgctccacgggttcccagtgcctcgtgcctgcaggatccctgagggtctgacttgtgagcttgcagggtggggcccctcgtcctctcaatcgctgatgccacctgcccccgtacaccctcaggaatgtgcccccggcttctatcgggacgtcaaaggtctcttcctgggccgatgtgtcccttgtcagtgccatggacactcagaccgctgcctccctggctctggcgtctgtgtggtgagtaggggctggtggggccaggggggcagcattcactgaaggcacagtcaagtgtgccagggaagaccaggrgctgcacttccaggtcaactgaggtctggggaagggtgttgcccagtgggggaccatctggccttgggcacagagtctgaggcaggggtggtgggagctgcacagactcggcagtaggatgtgggtgtccaccatagctctgactgtccactctgccccaggactgccagcacaacaccgaaggggcccactgtgagcgctgccaggctggcttcrtgagcagcagggacgaccccagcaccccctgtgtcagctgcccctgccccctctcagtgccttccaacaagtaagccagcctcctcccgggacgaggccctgatggtgccaggctcccttcacccagcagcggggtgggttcccactgccctctgcagaggcctggacagctggaggtgtccgtgaggtctgggcccccgacgcctggcgtgtgttccagccggagcacagtgtgctcgcccgggcccgggcactgccaggggcctagtgactgacgctgctggtctttgcagcttcgccgagggctgtgtcctgcgaggcggccgcacccagtgcctctgcaaacctggttatgcaggtgcctcctgcgagcggtgagctggggctagggcagtggggcagggcctgagtgctgaccccaggatatgcgagggtgggcgccacgggccactgacggcccctccccaccctgctcccaggtgtgcrcccggattctttgggaacccactggtgctgggcagctcctgccagccatgygactgcagyggcaayggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccgtaggcrtcgggctgggagggatgcaccctggggagggttgcgcggggaggagggaggcctgctgggcgtaccccrtaagtaggctgtgtgcctgatgctggggcccagccaggacaagtcggagccagccttctgggttcatggtcaaccytttctcccccgctatgatccggtcctcccgccccagcgatcaggccctcccgccccagcgatcaggccccttcaccatcaggcctcccccggaccatcacaccctttctccctactacaatcagaccctccccataccaggatcacatcccccctcccctacccatgatcaggcccccaccttcaccatcagaccctccccccaacccatgaccagcgccccccccacctcacgatcacatcccctctccccccacaatcagtcccccctcrtggttagacaccaccaccaatgccccaccactggcagcggacaccagccgtcagagcagggcaggccatggcagggagtctgcaggtccctcgggcccaggggaggcagctggggagtggggccaggctgggacacgagtgggtagccgggtggtccgggcggcctggaggagacacagcaggaggcagtgaagtgagggcttaggagggtgcctaggggctccctgggggggtgagagggcccagggctgcagtcacggaccccttctgcagggtgcgactgtaccccatgtgggacagaggcctgcgacccccrcagcgggcactgcctgtgcaaggcgggcgtgactgggcggcgctgtgaccrctgccaggtagggctgtggggtaagcagggctgggtgggtggggcctagggactagagttggggcctggggagaatctgataggtggggctgaggggcagtgtttgatgggcagagcctcagggggtggggccagatgggcaggacccctggcttccaggttggtctgggacagtcttgagggctgggcagggcagtgaccagcctgtgccacaggagggacattttggtttyratggctgcgggggctgccgcccgtgtgcttgtggaccggccgcygagggctccgagtgccacccccagagcggacagtgccactgccgaccagggaccatgggaccccagtgccgcgagtgtgcccctggctactgggggctccctgagcagggctgcaggcgtgagtgctggccggtcacaggagggcggatggggacttctgagtggggtacgctccaaggtcccaggccagccatgctcacccaagccccccaccacaggctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaaggtgygtcctcaacaccccacttccccacacctgatggagtaggaatccaagtcccacacagcctggtgaccccagtgttaacgtcgacctcccagagtggtcccagctgccttccatttcccgagagacccatgcctgtccaactccaaccacgctgaggagcgctgcagctccactgctggctgcacccctctactgtccctagccttcctgtgtgccctggccccaccccatctgctggcccttcctcccccactgaccccacccctccactggccccacccctccactgaccccacccctctgctggccctgcctcccccactgaccccacccctccactgaccccacccccattggccccacctcttccactggctgcacctcctccgctggccccaccccttcactgaccccacctccactggccccacccctccacaggccctgcctccactggccccctcttcctccactggcgccaccctttcactgaccctgcctccactgaccccacccctccactgaccccacccctccactgaccccacccctctgctggccctacccctctgctggccctacccctccactgaccctacccgtcctctgaacccacccgtcctctgaccccacccctccactgaccccacccccactggccccacctcttccactggctgcacctcctccactggccccacaccttcactggccccctcttcctccaccggccccaccccttcactgaccctgcctccactggccccacccctccacaggccccgcctcctccactggccccctcttcctccactggccccaccccttcactgaccctgcctccaccggccccgccccttcactggccccacctccggccccaaccccttgtgctggccctaccttctccctgggtgaccccatgcccttcactcccatctgactcctacctgaccctatgactctgccagaactctgggacctccccacaggtcctgtgtccctaagctgacctcatgacctctggctgagccctccccaccctaatgaccccagggccccagctgatcattctcccctggcctgacccaatgacactgacctgtgaccccacatcgcctgcagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcaggtactgagcgtcctggccttccctccccaacccgggccagtgcaggccttcaccttycgcctcccacagagccagctccggagccccctgggcccccrccatgagacggcacagcagctggaggtgctggagcagcagagcacaagcctcgggcaggacgcacggcggctaggcggccaggcaggagccccaagaccccccagggccccgggaggctttcacctgtgttccccgcggttcgcttgtcctcattcagcagatgttacttcatgcctcgtacatgtgtcagtgcaggggacaggagctcgagagtcttaggggttgaccaagtcactgaattactatctaaactacctaatacatttgtttacagtgtataatatcactcaaatgtctttttttttttttttttttttttttgagacacagttttgctcttgttgcccaggctggagtgcaatggctcgatctcggcttaccataacctctgcctcccgggttcaagcgattctcctgcctcagcctcctgagtagctgggattacaggcacacgccaccacrcccagctaattttgtatttttagtacagatggggtttctccatgttggtcaggctggtcttgaactcctgacctcaggtgatctgcccatctcagcctcccaaagtgctgggattacagacgtgagccactgtggccggcctcaaatgtcttaatgagtaactatttcattaaattgacaggaaataacaaatggcaagttataaccaataattttaggtaactaacaagtgataaataacaagtcatcagataagagagttaaatagataaggggcccctcttccctgggaccctcggcgctcccccagaccccaggccctcccttgccaccccgaccctcgcctaccagcagcgtgggctartgggctcttcctcyacaggcygtggggacccgagaccaggcgagccaattgctggccggcaccgaggccacactgggccatgcgaagacgctgttggcggccatccgggctgtggaccgcaccctgagcggtaggggccagcccagccaggctcagggctcagagccaggagggctgcctggggtaggggtgggggtgcctggccgagcttggcctggaagaacaggcaggatctgtcttttagatgggagacgacgcctctggagtgaacagtagggcagggtcaggaggtcggcgacacagccgtgtggccagacaggtggccccgggagacgtcagacccctcgacagcctccccaggaaatgtgccggttagatgttcgcgctcacagatatcccrtagtgcacactgagacatgggactcaggagagayttggctccctgagcctgcctaacaggacctgccagcccagcctgggggtcggcagggggtgccatgtcagagagagctggccagggagcagggtgggccaggcggagaggggcaggacgagaaggctcagaagctggctgagcagactggtgtcaggrtgttggaggcactgcaggaggtgagggccgggcaggtgaggcagctgtggcctttcgccaggtgctctaggggccacccaggtgcgctcaggttccgggcccctggcctgccaaggatggcagggctggggtcttgggcttggaagccagcaggcagaggtgcactagtacgggcggccccaggctctgacgaacccctgccccacagagctcatgtcccagaygggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagatgtgagtggtgttgtccctggcaggcggggtggggagaggcagggacctgggagctccaagggggaggtcagcatggagtggcatcaggtgggcatcacggggcagatggatctggcgggcaccaagtggagaccaggggtcatgaaggggcctggcttccagagtgaccaccctcaccctggtctcggctagtgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctggtgaggaccccggacttgttcttcctcctgctcctcttcccgcctcctccctgcaatccctctcctctccggctcctcccctcccctcccctcgtcctcccctccctccgtcctcccctccctcgtcctccccccctcctcctcttcttccccccctcctcctcttcctcccctcccctcgtactcccctccccctcctcctcttcctcctccccctctccccttctcctctctcctccctcttctcctgtcctcttctcctgtcctctccctccccactccccatctgcccatcatccccctccccctccttgtccctccccaatcctcatccctttccccacctcctctattctctccttccccttctcctcctctcatttccccatctctcctcaccccctcccatcctttcctcctcttctccccctccctgtcccctcccccttttgcccccttccgccttcctttctcttcttccccacttttctctctacccctccatcctcctccttccctcatactcacacgttctaaccctcccctcctcccccctcctcaccccccatactccccctcttttcttctcccttccctgccctgctgtccaccccatcacatcctttattcttttcttacccctcattgtccccaactcccctgcattgccttcagcaaaggaagcaggagctgtcccgggacaatgccaccctgcaggccactctgcatgcggctagggacaccctggccagcgtcttcagattgctgcacagcctggaccaggctaaggaggtgagtgcagcccctggcccctgtcrccaccccatccacggccaactccctcccaggcccgtgggcagctttgtgtgcacacttgcgtgcagagcccgccctcagggtcgtggatcaggtggctgtgagcaggatgaggggctaagtccactcaaattccaggagctggagcrcctcgccgccagcctggayggggctcggaccccactgctgcagaggatgcagaccttctccccggcgggcagcaagctgcgtctagtggaggccrccgaggcccacgcacagcagctgggccagctggcactcaatctgtccaggtgggtggccaggagaggaggggccctgggcccaccctgrggatgcagacagggccttgggagggccagctggtctgggaaggctcctaggggctgaggccgttgtcctcaaagaagccaggccttcctcagctccacggcaagctggggcccagagtgacaggagcagtacacccagcaggcgacaggcacgggcaaagacctggaggcgggacttggcgggcaggcrcgggcacggctggttgtgagcgcaggaggctggagagccaggccgagggcgtctgygcttacccactccttcgaccctcccttccgctgcagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcggtgaggcccctcacttcccctcagccccagcaggagcgcccccactgcctgcacctcccgcagccccggcctgcgtgtctgagccacggtctgccctggcatccacagacggtggtgcggcagggcctggtggaccgagcccagcagctcctggccaacagcactgcactagaagaggccatgctccaggaacagcagaggctgggccttggtgagtgctgggctccgatgggggcccttaggcctgctgggcatctgagctcccagggaccctcagcccccagccacatgcacacgtggggtttgtgggtcaccgcagcatggtttggggtgggagagctttggagatggctccccagctgcttgtgtgtcagccccggggagccctgcaggggagtccagggaggagcagcctcctgcgaggcactggctgccactgaggcaccagctgagccacagggcacagggcaagagatacgtggcctctgctctgctgacccgagggctacacgcgtgccaagctgcgcaatgagaaaggtgtgagctgctaggaccagagggctgtctcttctgagcctctattgtttcatctgtacaatggggacagctatgcctgcagtgggaccagaggccttcagggaacagaggcyacgctgagactcaacacctccccacaggctaagggactccatgtctgagtgtccctgtccatctgtctgctgtgtgtcagccttggtcctcctggggtcagaagggtggaggtgggctgcaattgtatactgggggtgaagctgcctgggagctgaagctgcctcccccgcagtgtgggctgccctccagggtgccaggacccagctccgagatgtccgggccaagaaggaccagctggaggcgcacatccaggcggcgcaggccatgcttgccatggacacaggtatgcggagcctgggcccggctctcgcagccggccgaccatgaggctctgtgacagtggcgctggccacatgtggttggtgagcactcactgtgctgtggaagagacccccacagtgggcagctggggccagacacagaaagcctaccagggaggtgccagggctgcagatagcacagacagccccagccgtcgrgagcctggcaagcttggaagtgctttgggtagaaatggaggtataggtgggagggctgtaggccttgggggggattggggcacaccctgcaggaagggcacccaggagggcacagtggtcagcgtggctggaaccaaggggctggcaagaccttgggcggtgaggaccagggctcccaccctgagaggcttggagcagaggacgatgtgcctcacccagtttctgagggacccctgtggctgcggactgttcccagcaagcccaggagagatggtgggggccaggtggtgggaggtgacatggggcacatgtccagggaccagctgtggcctgagaggctgggtgcctgtcctggcatggagggggcgtctggtggaggcatttaggatgggtttggattgcactgagcagcggggtgtgagggtctcacacratccatagggggttggatgtccctgttgctggcccaacagaaagacttggggacatgaagccaggatggtccccgctggcccctgctgagcctgccctctgcccaccacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcaggtgcgcccatggccctcgcggtgcccctgatggaggcgggcacggtggggggcaaaggtctcaggtctccctctctgcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtgggtgagagtcccaggggaaggtggacatcagggagggtggtggtggacgctgatggaccrtgccccgcaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggtaccaggctggctgggtggatgcggcccgagctcaggctctgtttggaaatgagcggtgcctggtccctggtccccggtccccatcccgactgtgtgtctgtcactgccgcaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggtgggaggcccaggagagaggccggatgcctccaactgcagggcccttgcccgttcgccatctctcccctctccgtgtgcacccaccacccttcacctctccatgcccactcgccacccctcgcctctccgtgcccactcgccacccctcgtctctgtgcccactcgccacccctcgtctctgtgcccactcgccacccgtctctgtgcccactcgccacccctcgtctctgtgcccacccgccacccctcgtctgtgcccactcgccatccctcgtctctccgtgcccactcgccacccctcgtctctgtgcccactcgccacccctcgtctctgtgcccactcgccacccgtctctccrtgcccactcgccacccctcgtctctccgtgcccactcgccacccctcatctctccgtgcccactcgccacccctcatctctctgtgcccactcgccacccctcatctctccgtgcccactcgccacccctcgcctctgccctcaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacggtgagcccgcccggcctggggcagcctgggaggggctccgcagccccgagtcgcttgtgtcctggagagccgcgggttcttttggtatcttgcctcagtccgtcctgctgtagtctgaagtccccttggtccatcctggaggggaggcgcctcaggccaggtgccctgacccagccctgtgcccacagccccctcccctgcttcgcttccccggctaccggggctgcatcgagatggacacgctgaatgaggaggtggtcagcctctacaacttcgagaggaccttccagctggacacggctgtggacaggccttgtgcccggtgcgtgtggcctgccctccccgtctccacccaccccaccccaccctccgctgaccccagaatctccgacctgcagctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcaggtgcgccaggcacacccrtcctgccatccccacttgcactgrccctgccccacactaaccctgccctgtttctgcagagccagttcctgtgyttggccgtgcaagaaggcagcctcgtgctgttgtatgactttggggctggcctgaaaaaggccgtcccactgcagcccccaccgcccctgacctcggccagcaaggcggtagggccagggtggggaccagggtggcagggagaggagatggaacgatgggggcggggcaggccgcagggacacagctggccctggagcccccactggtcctgtagatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgaggtaagcactgtgygcagctggggctccgaggccaggctgttggggcggtaggctgggcttggaggtggcgccctgacccgcatccccgcttccccacagcctgcgayggctcttccccaccggaggctcastccgtggctgcgtcaaaggcatcaaggccctgggcaagtatgtggacctcaagcggctgaacacgacaggcgtgagcgccggctgcacygccgacctgctggtgagcagccctccccgggctgggggtggcatctgtggacatgcaggggcaccmgcgggcactcagggatggcctccccgcaggtggggcgcgccatgactttccatggccacggcttccttcgcctggcgctctcgaacgtggcaccgctcactggcaacgtctactcyggcttcggcttccacagcgcccaggacagtgccctgctctactaccgggcgtccccggtgagacctcacacccgtgcccattccccaccccgcggtggccgtcggagcagttgggactggggtgtctggaatgagtctgggtccccaggccggccggctgacctggctgccgtccccaggatgggctatgccaggtgtccctgcagcagggccgtgtgagcctacagctcctgaggactgaagtgaaaactcaagcgggcttcgccgatggtgccccccattacgtcgccttctacagyaatgccacggggtgagcctggccgctgggccctcatcgtgaaggtctggagggacgcccgcctgcacttgcctggacctctgtctcctctgaggtgggggtgggcagggtggggaaaaaccgagcctccggcctcccgccccccagagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggtgagcctggtgggcgctgggggacaaggtcccagctggccttccgcagctgctgaccrcctgccygccctgcacaggctcctgggcccacagcgcgtatttgatctgcagcagaacctgggcagcgtcaatgtgagcacgggctgtgcacccgccctgcaagcccagaccccgggcctggggcctagaggactgcaggccaccgcccrgaaggtgggcaccccaggggtgagcaggcagagctggggtggctggaagggtggcccctgtgygggcggcccctgcattcaccatccacgcccccaggcctcccgccgcagccgtcagcccgcccggcatcctgcctgcatgctgcccccacacctsaggaccacccgagactcctaccagtttgggggttccctgtccagtcacctggagtttgtgggcatcctggcccgacataggaactggtaaggccaggcccggctggggtgggctgagaggggccgcgcaggctgacgccagctccgcttccaggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtgagggccgagaagaaggaaggtggtgggcagggcctggcagccctaccctgacccatctcctgcccccaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgagaaccatcttgccccagcccccactccccacccactgttccctttcagctgccctgggccctgatccctgcccggtctgctcctataggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttaggtctgtgggtgctggcatcccaggccycagcagggcagggcaggggkctccaggaggttctggggaggggccccccctttcttctccatcacaacccctccccgcagacctcccaggagctacactgcctgatgtgggcctggaactggaggtgcggcccctggcagtcaccggactgatcttccacttgggccaggcccggacgcccccctacttgcagttgcaggtgaccgagaagcaagtaagcctggcagaggtggcgtgccagggcagggtttgcctccccattctggtgacctcgggggcatagcctgaccctcccttcctacccckccaggtcctgctgcgggcggatgacggagcaggggagttctccacgtcagtgacccgcccctcagtgctgtgtgatggccagtggcaccggctagcgggtgaggcccctcctgtggccagggcactctgccacccccacccttctgcagagcgggagccaggcgggactctgggtggggtggcttcttttggggctggagagaggctgggctgaggaccacctggcctcagragtccccctttctcccagtgatgaaaagcgggaatgtgctccggctggaggtggacgcgcagagcaaccacaccgtgggccccttgctggcggctgcagctggtgccccagcccctctgtacctcgggggcctgcctggtgagtgcggccttgatcaagggtgggggagctgcccctcaggactaggtgctgcgtaacctaccaccctccccccacccctccaccccctgccccctcccaccctcctcccacccccctaccaccctcctatgatgtggaatgagacaggggctgggtggggcactgacgtttgggaagggcctgtgggtctctagctgcccaccaaccagccttcttccatcttccctgtgcccccagagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgcyccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaaccgaatgaatgttgacttaaatacggagadagtctcaagacagrtctggaaccggcctggacagaggcaccaaactcttcctggggtgaccgttttccgttgttaggtcaaataactaactgtctctgggaccctacagcagctccccacgctagcacctgtccagccgaaactccctttgggcaaagaaactaagcrttggcaggtaaaagaaaagactttattaataatcagtgggtgggaggtgagggtgtgcaacgcactgcaagcgcccagttsctcggaggacggcgcgtggctcagtccaggctcatgtcctcctcttcgtccttcktgtccttcgtgtcgccctctttctgctcgggcttggcgttgttctgcatggctttggcaaacgcttccacatctagaacacgttaaagacacaaggtggtgtctaacccttgcccagaactggggatcaaagcgatgggatcaagggcagaagggctgtgacctttaccccctcagccccacttctgcagatccagggggacaggaatggaccctgcccctggctctggcctggaggtgcaggcgcagccacttaccgcccttgttggcggcctccacagcctctgcaggcagaccgaactggcacatgagggggcccagctgccccgaggccaaggctgcgctgaacatgcccagggcctgcaagaagagccaggcgagggctgagctccaacccgggctgcacccyagagccacactgctcagctgccagctctgcgggtcaggcacatgaagcactggccatggtgaaggtggggcagggcctcctcctcccccctgcccactccctgagcacacagtggaggacaccctgggcccggcctctacctgctggaactggggcgaggtcagggtattctggatctcatccgcggtctgcggcagcgactccccagatggcaagtagggaagcaggcgctcctggacatccgcgttggcgaggatgggagccattatctccggcgtcagcacactggccaggtccactggggcacaagaacacggccatcagctcgatgacagcctaagtgcccacatggaaggcatgcaagcagggactcagcccatggccccagcaccccaggcgcgcacactaggcagatgccttggaaggtgagcgtgcgagggtcagcaggccccatgccccccacccagctccaggcgacagcacacgytaccttgctggccgcctgctggcccggctggtacgttcatcgtggccaggatgctctggaggtcgctcagctggatgggctgggtcggkctggctgctgtgctggctccattcccggaactgggcgcggggctcgggctagttgctgaggcagctgctggagcagaaggggctggggtggcacgggtggaagaggtggtggatgacggggtgaccgctgcmgactggctccgggagctgcgaagagagagggcaccgctggagcggacrcgccccacacggcagggcctactcgcagggtccagggtgctgggccaggattccccactgcccctcccttaacaccgtggcacctgcgtggcaggagcgatgaggctcacctggaggaggagctgctccctggaggcccactgctccccagtaagctggccaggccaggtccagtcagggcccccagcccacctgcgaggggcaaggaaatgcgagctcaggatgccctctagcccaccagaaagagcctggcccctccccaggccagaggagcaggaattcccaacaccaaagccaggaagaagcggggcggtggggacccacaggcctggaggagcggcatggggcgggtggacacttgcggctgtgttctggaagcaaggtcatttctgttccatcccattacacaattcatgtgcttagattagaagattcagtccagatcccacccaaagggacaagcatttctgaagggccaagcacacgggtctgcactccatgagctggcagcaggcaggcagccatgtggggccaggggacccagggcgcaggaaccccagctccctccagtcctccagccccaccgctcggccagccaccctcctctgaagtacccagctggggtcctcaccaggggcccagaagccctcgcctacccagctctagccacaggcaaacaagcgcattcccaaaggggaaccagcttgcggacacacaggctccccgacactacgcagacagagccagcagaagtttaaaggaaacagagaccgggcctcaaagcattcccagcagaagctgcccgagagcccgggtggcgcacgttacccagtcctccraggccggctggtccgatgagctgcatgagctggctgtggctcatgtttcccagcaggctctgcaggccaccctcacctggaaaacactgcagctcaggcgggcctgccccagccagatccacgcgggccccaccgcrctgcctgcgcctctgctgagcaccgcactcggctgcccctgaaccctacagggggcaccacttgaagtgaggcgacggtgggatgcagacccgtcctaccccgtgaaggtgggagtggggagtgacccagggagctcacagggtctctaacttttagaatcttctatttccacttccaaacaacctgtgctgagggggcgagtcatccacagtagactctggcctcccaggaaaccctgagctcacgtgacacatgtgacagttaccgcctagcgcagagagttcgtggccgctgcttccgctggcccccagygccccaggcatcggggggttgttcagatactcgttgactttccggcaatgctcctcatcctggtctgtcttgggttcctgcaagaggaagggcatgtaagggcaggagctggcgccagctcacccagggccaccacagccatcctctgacctggcttccaggtgagggacctgagacgcagaggcgcgtgtgcctggccacacaatgctgaggagacaggacccggcccagcaggtgaggggacggcagtggcgcctcctgagcacgatgctctgcgccctgtccccatccgccgcaatcccgggtgtgccctgtccccctccgcccatttcacaaatggggagcctagagctccgaaggcacttagctgctgccagaccaagccctctcaccctcctgccctctggggtgcggttctttacacacccgtctccttccttcaaccagtggaaggcagcgaactggcccgctcagcacaccgcggcccagggccacggcaggcgctcacaatcgagcacacgcgtgtgcacacacatgtgcacagatcagtgtcagaagcatcgacctgcgagctcacagagctgggagcagagcacccacgcacaccccgaatggctatggaagctgcagggcgccagggacactgggagtccctgctctcatggcaaagcagggacgggggacttaaaagccaccaacaggaaaatcggggaaaaaagggagatggtggtaacagttggacactatttcttggcaaaaccgtggaaaaacacgttctacaccagcaggtggcaaattgtggccgccatctgtgtttgcaaataaagtttaactggagtttggctatgcctgttcattttctcaggccgctgcacactacttgcacaggtgaccagcaacacagaccatgtgctccacagagacctcagccagggccacccctgctcttgaaagtgccaaggggggtggggtggggacagcagctccacctctggcagagagcatggccttctctctccacactgcaaacgcatgcacacgcttcctgaccacaggcccgccaccagttttcacctacagatgatactggcttatggaaaatgatctgtgtaccgggaaattctttgcaacactgcctgtaacagcacaaaaaacggcaacaagctcaatggtcactgacagatggcagaatgagcagcggcctctagacccaaaagacgctctgcagctgtgggtaagagaaaccctgggcactgacacccctggcctccaggacacactgccagggaaggggcaggactgtggaaagtgtgagcaggatgcttcgtttctgtgagcaccagcagggaagccacacaggggcctctgcctctgctgtgggggcctcagtgacccacggcaaggggcagagagagggcactgggcatcgttagaaccagggccagcatgtctgtctgcctggaaatttcacaccgcaatcggttgcccgcagcccagcctggagcctccgtactctgggagaggacctcggccccaggtagcatgcaccgcagccctgaggtggcatctcaggccgtgtggccgggtgtggccggcgcctgctggtttataaaagccaattgcaccacactgtaagcaagttcctaaccgaatcgcagggcaacaaaaaggcacaaccccaaggcctgccccatacctgcatccagaagaaaagccgcttggaccctgccttgaacttcagcacgtagaccctcccgctggggcactgcggcacccgcttgaactcacagtcgtcagggaagatgatcaagtcctggcaagccaggggaagagagagtcagtggcgcagatggcatcactgtgcccagtctcaggagagcgtactgagccctgggtctaaccgggtggggtgcgcaaggggcagctaagccgccagacccctcgctggcagggtctccacaaggcagagaagccagggtcagagacagcccatgaaaggcaaggccgggggagagagcagggaaaggggcctttcagatggcaacggggtttctgagacgtgctggaaacaacattcccagagtagttaaaaagtcaacgctgaactgctctcaaatgtaacaaagaacaactaagagtttgaaaaacaaagaagactgagtgaagccgccaggcacagagctccaggctctccagggccacacctccaaccccaggcacctcacacggacagttcaaggccaggcacagagctccgggctctccagggccacacctccaacccaggcacctcacacggacagttcaagatacacagtggccgagatgcccctgtcaccgcggaaaccaggacgacccatcagcagggcagtcgatgacggccccacgagcggtccccagatgcggccaagcccccaccgcgaactccaaagcgaggactccgagggcccgagaagtcgcctgtcctgctgctgcggctcagggacactcacgtcttccacgttcccggacgtcctgtccttccagcagaagtgaataagcgagtcgtccgtctgctgaatgtacaccagccctttccgcttatccggagtcacggtggtccccttcagggacatctttcccgcccgaaactccaccaagtacttgttggaggcgccccgagagcctggcaccaggcttggaaagagcgcgcctgaggtcgtcatcctgaaagcgcggagaggacgctgagacgcggcggtcactgtcgcctgcggtccggcaagctcccgccccctggggtgtttgcgagcagggggcctgcgcccagagctgcctaaggcagactcagacacgccgggctgcctttccgcgtttgccccgctcacgacgatcgcaccgcccgcactcggcgctgggccggggcagccccgccaagcctagtggggccggccctaggcttgacgccgtctccgcggggcaccagcctcgacgcgccaccccggcgacccgctccgcggggcagacccgcccgagctcccgccgagccccacgttcagagccgcaggcggaaccggggcggcgcccgagaccccagaacccccgcccggcccggcccccgcaggccccacccgccgcgccggccaccttctcgtcttggctgcccccgccccatccttggtccagcagcccctgcccccgcctccggtcgcccccggccgccccaggcccggcgactcccgcacctgcctcgcgcccacactcgttcgagaggcgccgtccgggctcgctcttcctcctcggcgcctgccgggccccgccggaaacccgcgttcggcccgccccgcctgccgctctcgccgccgattgagccccgtaagccgcgcagccggctctaacctgccaacgattggcgagggcgaccgtccatcgcactcg

SEQ ID NO: 12425 - DNA, 17320 bp, Homo sapiens
gctggtctcaaactcctgacctcaaatgatctacccgcctcggcctcccaaagtgctgggattacaggtgtgagccactacgcccagcccaagttttctttattctccctttaaaaagccattagcctaaataccctccactctgtttcccttagaatggacagaacccaggcccttttcaccccactccaatcagccccaacacctaataggatcacttttttttttcttttgtaagagggagtctcactctgtcacccaggctggagtgcagtggctcaatcttgtctcactgcaacctccacctcccgggttcaagcaattctgctgcctcagcctcccaagtagctgggattacaggtgcccaccaccacgcccagctaatttttgtatttttagtagagacagggtttcaccatgttgaccaggctggtctggaactcctgacatcaggtgatctgcccaccttggcctcccaaagtgctgggattacaggcgtgagccactgcgcctggcctggccaggatcattttatagatggctaatgaagtgatgaatgggctggagcccaaggatgtagacatgggggtggttgtgaaaatggagtgatactggagtgcaaagatattctatgaatattagtaagatctgggaccaaggtgagggtaataacattaaaaatgtaaaccctgggctgggcacggtggctcacgcctgtaatcccagtactttgggaggccgaggtggtcagatcattaggtcaggagatcgagaccatcctgactaacacagtgaaaccccgtctcaactaaaaatacaaaaaaaaaaaaaattagctgggcgtggtggcaggcgcctgtggtcccagctacttgggaggctgagggaggagaatggcacgaacctgagaggcagagcttgcagtgagccgagatcgcgccactgcactccagcctaggcgaaagagcgagactccgtctcaaaaaaaaaaaaaaagtaaactctgaaaaccaaagacaaaacaagatgggggcaagataaattttggaagtattggccgggcacagtggctcacgcctgcaatcccagcacttttggaggccgaggtgggcagatcacctgaggtcagaattggagaccagcctgaccaacatggagaaacctcatctctactagaaacacaaaattagccaggcgtagtggcgcatgcctgtaatcccagctactcaggaggctgaggcaggagaactgcttggacccaggaggtggaggttgcagtgagtgagatcgtgccatttcactccaacctgggcaacaagagtgaaactccatctcaaacaaacaaacaaaattttggaagtattaagtttcctagtttatactcttttatcttctgcattagtgattaaagtttgttttttgagacagggctttgctctgtcacccaggctagagtgcattgacaggttctcagttcactgtagcctcaacctcccaggctcaagccgtcctcacatctcagccccccagtagctgggactacaggcatttgccaccaagctcggctaatgtttttgtattttttgcagtgaccgggttttgccctgttgcccaggttagtcttgaactcttggactctattgatctacccaccttggttttccaaaatgctgggattataggcgtgagccactgtacccaacctattattttttttttgttttgagacaaggtctcactctgtcactcaggctggagtgtggtggcacaaacgtgactcacttcagcctcgacctctagggttcaggtgatcctcccacctcagcctcctgagtagttgggactacaggcatttgttactgacctgggcaaattttatttatttagtttttgttttctttgggtttgtttgtttgttttagacagagtcttgctctgtcgcccagagtgcagtagtgcaatctcggctcactgcaaactccacctcctaggttcaagtgattctcctgcctcagcctcctaagtagctgggattacaggcttgcaccaccaagaccagctaatttttgtatttttagtagaaacagggtttcaccctgttcgccaggctggtctcaaactcctgacctccagtgatccacccgccttggcctcccaaagtgttaggatacagacgtgagccaccacgcctggccattttctttttttttgagacagagtctccatctgtcacccaggctggagtgcggtggcacaatctcagctcactgcaacctctgccacctgggttcaagcgattctcatgcctcaacctcccaggtagctggaattacatgggtgccaccacacccagctaatttttgtatttttagttgagatgggatttcaccatgttggccaggctggtctcgaactcctgacctcaagtgatctgcctgcctcccaaagtgctgggattataaggatgaaccactgcacccggcctaattttgtagagatgtggtcttgcccatgttgcctaggctggtcttgaactcctgggctcaagtgatcctccaccctcaacctctcaaagtgttgagatttttgttgttgctgttttgtttttgtttttgagactgggtatggctctgtcactcaggctggagtccagtggcatgatctcggctcactgcaacctccacttcctgggatcaagcgattctcatgcctcagcctccccagtagctgggcctagaggagcatgccattgcgtgctggctttttttgtattgtttgtagagacgagactttgctttcctatgttggccaggctgctcttgaactcctgggctcaagcaatttgccggcctcccaaaatccaaaatgctgggattacaggcgtgagcttttttttttttttttttttttggagatggagttttgctcttgttgcccaggctggagtgcagtggcatgatcttgactcactgcaacctccatctcccaggttcaagcgattctcctgcctcagcctcctgagtagctgggattacaggcgcctgccaccacgcctggctaattttgtatttttagtagagatggggttttgctgtgttggtcaggctgctcttgaactcctgacctcagatgatcgacccgcctcggcctcccaaactgctgggatcacaggcataagccactgagcccggccaggcatgagcttttgtagggcataccagattgaaaatgaagactgtcaggccaggcgcggtggctcacgcctgtaatctcagcactttgggaggcaaggtgggtggatcacgaggtcaggagatcgagaccatcctggctaacacggtgaaaccccgtctctactaaaaatacaaaaacttagccgggcgtggtggcgggggcctgtagtcccagctgttcaggaggctgaggcaggagaatggtgagaacccaagaggcaaagcttgcagtgagccaagatctcaccactgccctccagcctgggtgacagagcgagactctgtctcaaaaaaaataaaaagaaaaagaaaagactgtgggctgggcgcggtggctcacacctgtaatcccagcactttggggggccgaggcagtcggactacctgaggtcaggaatttgagaccagcctggccaacaaggtgaaaccccgtctctactaaaaatacgaaaattagccgcatgtggtagcaggcgcctgtaatcccagctactcgggagtctgaggcaggagaatcacttgaacccgggaggcggatgttgcagtgagccaagatcaaacctttgcactccttgcactctggcctgaggacaacagcaagacttgatctcaaaaaaaaaaaaaaagactttggactgggtgcagtggctcacaccagtaatcccagcacttttcgaggccgaggcggacggatcacgagatcaggagttggagaccagcctggccagtatggtgaaacaccgtctctactaaaaattagccgggcatggtggtgcgcacccgtagtcccagctactcgggaggctgaggcaggataattgcttgaacccgtgaggcagaggttgcagtgagcggagttcgcaccactgcactccagcgtgcgcgacagagactctgtctcaaaaaaaaaaaaaaaaagaaataaaagaaagacccaacaccacatcaggacatgtaattcttatttatttttcaccctcaacaaggaagaaaggtctctccctcaattctgctcttccaatacttgaggataggcacccctaaccctccttcctccagggaggcctcagcatcagtgtctgtggacgtagtctctgaagagtgcttcagctgatggggaaggagaaactcaagacagagatcctcctagggatggcgtcactttcctgccaactttctcgttgcctctccttgaaagcagaagaagtgccagccctcagcttccgtcagatcttgggctcctagggccttgtacaagtccatggccctctggttccagtccaggacggccaggcrgaattgggagcagcccttatccaaggccacctgtgggagaagacaacactaacttttctggggtcaaaaaagaaaaaggttttctcactccctctttcaacccgggtcccccctccatatacccttgcttcttcaggtcctcacttgtcgccccacccatctcctcacctcagccacctttttgattattttggaaccaatcccttgacctgttgtggagagaaagaggcaaaaaatagctattgtttgagctgaaggggatcagaaaatgacaccggctgggctctggggacaggggataacagtggggtctgtggggtgctttgctcccaccccagcctcagcttctgcccagtaccccgatattccggcatcacatagatatcctccagataaatggtgcgtcccttccatgtactgtagatgaaatagtatatcccatagcccaccacgcagggccctgagagagagaaaaggggagtaaggcttctggaagcctgtggggagacctctgaggccggctggagaggtggacttctaagggccaggtgctcttacccagtagcttcccgggcgctggaagaatctctgctaccaaacagtgatagaaaggattgtctccaaagccatctgctctcagggctgccgagattggagttgtgacaaagagatagagaaagaggacgtgggtgtatgcccagcctggagctgtcgcctggggaacccatccctcatttcctccccagcctccgccagaacctgggcgctgagcccccaccttcttcactgatcttcacctgatccgagagtttttcgaattcggctagctcctaaggcgtgggtacggaagctagattagagcagaagggccccgctgctccccgagcaggttcccaaggcgagcccctccccctgcccccgcctcctacgaccccgctctggccgcgccactctgacccccgggttaccggcctgcagtcttcacccgaatcagcctcaggatatctccacagtctccctccttggcctctcggatccgcacggaagccatccggatccccgctgtctgggaccaaagtcccagggcctcgcaaacggcaactagaccccttaaagggcctacggacttggatcctgaagagcctgagagagcggggtggcgggagtcgggggggacggcggggtagccgcggcctggtaagtggagctgggattccggcgccgtacgggaggagagagtaggccagcgaggcgatcctctgtccgggcatagccccaccccctcgaattctgtcgcagcagggggcacaactgtcagccaatcagcttggagaacaggcacggccgcgtccccccccaagccccacccccgacagctggatcttgtgactgggctcctgggtagagttcaaggttggagtgaagcggcttccttgcggttgtgtgggtgtcccaacctgggtcgagataccccgcggttcaaaggctcccccgcagtgctttttaaattgacatatgcagtgataacctgctttagcctcaggctcactcacccgcccagaccctgggtaagccttaagaccctcagctctgaaagctgtttcctgcagctcttgagtagcatgaagtgttacctcttgggggcatttgcattttttaaatgttttatttttatatttatttatttatttatttttggagatggtgtattgctttgtcgcccaggctggggtgtagtggcgcgatctctgctcactgcagcctccacctcccgagttcaagcgatcctcctgtctcagcctccggagtagctggaactacagtcgcgcaccggcacgcccggctaatttttttttcttttttcttctctttttttttgttttaacggattctcactctgtcactcaggctggagtgcagtggcgcgatctcggctcactgcaacctctccctcctgggttcaagcgattctcctgcctcaccctcggagtagctgggattacaggcatgggcaaccatacctggctaatttttgtatttttagtagagacggggtttcactaygttggccaggctggtctggaactcctgacctcaagtgatctgcccgcctcagccttctaaagtgctgggattacagatgtgacccaccaagcccggtctgtcatttgcattttaaaatgggtcatggggtgggcacagtggctcacacctgtaatcccagcattttgggaggcagaggcaggcggatcacctgagatcaggaatttgagaccagcctgaccaacatggtgaaaccccgtctctactaaaaatacaaaaattagacaggtgtggtggcgcatgcctttactcccagctactcgggaggctgagacaggagaatcgcttgaacctgggaggtggaggttacagtgagccgagatcgtgccattgcactccagcctgggcaacaaaagcgaaactccatctcaaaataaataaataaaataaaatgcgtcagggagggtcgggccttgtggctaatgcctgtaatccaggtactttgggaggctgaggtgggcggatcatttcaggtcagaggttcgagatcagcctgggcaacgtggtgaaatccccgtctctactaaaaacacaaaaaaatttgctgggcgtggtggtgcgtgcacctgtagtcccaactactaaggaggctgagacaggaggatcgcttgaactcgagaggcagaggcagcagtgagccgagatcacgccactgcactccagcctgggtgatagagcaagactctgtctaaaataaaataaaataaaataaaataaaataaaataaaawgggtcagggagtgggtgatttctactgctagactgtttaggccctgtaataaatggataagggaagataactgagaggcggggggcaggtcccttcttaatattcactgaatcatacacacagacaataccttcttgggagacaggcctcagaggcctgggaaaagactgggggaggagttcagaccagatgccaggcactgtgcctgcattttctcaatgaaccctctttcacagtcaccccgtaaagtattattttcctcattttacagacaaggacaytgaagcacaraggtgaagtgacttgcccaaggtcactcagctagaaatttaggattccattatctcatttctagtcctgatacaggatgctacttgggacgcaggggaggactgtttctagacctcaggcctgtgaatgcaggctccccgagtggacagaaatcttggaggacctagatcaggccctagaggaggagargggagatggaatatcctctcccagttcagaaactttctcggcagtggaggatgatagtggaggggactctgtccttcaccccattgatccccagaggggtgatagctgagtcttgtgactgggcccctgggcaggggtcaagggtcagtgcccctgtttcctttaccccctcctccccgggcaacctttaaccctccaccgcccacacrcaaggctgcctgcctctacacattctcccaagagttgtctgagccgccgagtggacagtggctgattatggagagcagaggcccactggctacctcgcgcctgctgctgttgctgctgttgctactactgcgtcacacccrccagggatgggccctgagacctgttctccccacccaggtgcaggagcgggacagggcactcagctcatgcagtcttcccttctctcctctggccctgtagcagggcctctccctctgtctgtctctgacatgtccctactcagctttgtttgytttctctttctgatagagtgcccacgaccctccggctgtccacctcagcaatggcccaggacaagagcctatcgctgtcatgacctttgacctcaccaagatcacaaagtatggggttggcctagcccttgacccagtcccctggttctgccctctctccatcagctcttctcttttccctgtyttcctttccttatctgtgaacaccatctcccccaaacccacactggttctcaaaggacacatgacatacacaatctttccttctgtgtccttccagaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtaagctagctctggtcctcaggggagggatgtctggagctggtctgaggaaagggaacaaaaccaagttattgggcatccctytaccactgtcatctcgtttaatccacacgaacccccacaaagtagctattcttggccccatcttttctgatgggaattctaaggctcagtcagtatataagtgacaagagctgagtgacccaaggccaaggatgctagctgcttctttaaggcatgttctttccactatagtactaggctgcctcacaggaaggtggcagaaacagatcccaggggcctctgattttgcttcccaccttcctgcaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgcyggtaactacaccccaggggtggaaccctagccaagacttggtaaagcactgctgggtggctggccgtgggaatctaagtccacacttttagggagaagggaagggttgagagctgcaagggggaggccaaatgctcagaggggagtcaactgagggcagggaggtcgggactgcggctccgatgccctgatttctacatccccrtatcttatctctgtcacactccagctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggtagatttcctcggagtctatttttcccaccctggccagctcagcctgcctctgtccccctctaccactggcccctttcctccttgagaccccagctttgaggcctcaggataatcatttctccccacagacattccccagcctcatgcagagccctgggccttctctttggacctgggactcaagcaggcagcaggctcaggccacctccttgctcttgggacaccagagaacccatcttggctcagtctccacctccaagatcaagtaaagggggacagtggggcattgcctgtattcagtggagcctggagcaatgagggaagaggggagtccaacatgtcaatattaggaaggtttccagcccagggaacataacaagactggctccacagaattgtttttcattaataattagccaggcatggtggtgcttgcctgtaatcccaggtgctggaggccaagaccagaggatcacttgaggccaggagtttgacaccagcctgggcaacatagcagagacctctgtctaaaaaaaaaaaaaaattagccaggcatggtagcacatgtctgctgccctagctatttaggagcctgaggcaggaggttcacttgagcccaggagtttgaagctgcagtgagctatgatgtgccactgcactctgacctgggccacagtgagaccctgtctcaaaaaaataaaaataaaaataaggcttatggatggcactcaggtgggtggtaggggcgagggacatatcttgaagctccccacagcaagcaaacagttttgacttagactgcatatttacttggggcaggtgtggtttcaaaaagggtcaagccaaaaaaaattggggcaggatttaagtggtgagaatggccagtaggtggaggcatagcgaagaggcagaattaaggcagctaggggtgaggccacaggcagtaggcccggctcattcttccctctctctctaccgtccctttcccacacactctgcagaaggtggtgttgtcytctgggtcggggccagggctggatctgcccctggtcttgggactccctcttcagctgaagctgagtatgtccagrgtggtcttgagccaagggtcgaagatgaaggcccttgccctgcctcccttaggcctggctcccctccttaacctctgggccaagcctcaagggcgtctcttcctgggggctttaccaggtaagagagaatgatgttcaagttcatgagcacaacattggaaacagctcaagggaggcggcacattttgaggggaaggaaacctctgggagggaagaagaataggccacaagaagaakatatgggggcagtggaaggtagtgcttttgcaaactcaggttggaggagtggaaaagtggggakaagattctggatccgagccaccttaatgctctaatgccacctttgcactacctccctctaggagaaractcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagttactgattattcatttattcaacaaatattcactgtgcactagcaatgtaccaggcactgtgccaagtattgagttgtcttaatgagcaaaaacactctggttcctaccctcttggtgcccacagtcccatagggaagcagacatccatcaaaggctaactaataagtggatagttggaagcactgataaagaagaattggagagttgtgaaaacatggagactggccgggcgtggtggctcacgcctgtaatcccagcactttgggaggcagaggcgggcggaccacaaggtcaggagatcgagaccatcctggctaacacggtgaaaccccgtctctactgaaaatacaaaaaaattagctgggcatggtggcgggcgcctgtagtcccggctgctcgagaggctgaggcaggagaatggtgtgaacccgggaggcggagcttgcagtgagccgagatcgcgccactacactccagcctgggcaacagagcaagagtccatctcaaaaaaaaagaaaaaagaaaaaatagaaaacatggagactaggaggccttaacttagtctgagcgtcaaggagagtttctctaaggaaatgaggacttctttttttttttttttttgagatggagtttcccgctcttgttgcccaggctggagtgcaatggcgtgatctcggctcactgcaacctccgcctcgcgggttcaagcgattcttttgcctcagcctcccgagtagctgggattacaggcgtgcaccaccacccccagctaattttttgtatttttagtagaggtggggtttcaccatgttggccaggctggtctagaactcctgacctcgggtgatcctcctgcctcggcctcccaaagtgctgggattacaggcgtgagccattgcgtccggctggaaatgaggacttcttaggctgagatcccagcaaaaaccccgacagacagacatactctggatacaggtcactttctggaagccaggacccacctggttccgcagaagctactccctttgagaccagtttcctgcctctgtggctggtccagagagatcaggaggaagggaagagatgggattttgacatctcagtcatctggtccttggactggccattgctgcccagggaagaagcagcagggggcgtgagagggtcacagagagatgtgggtaggggttctggaaaaaggggtggaggcagggagaaagaaaaagggaggagagcagagggagaaagtcgcgtctctctctctctctcctagtcttggtccacttgctgccttcccagacaaatttgtctctactccattaagcaagaactggcttgtgctggtcccagctgggaaaaacagacagatttgggaatatctctcccctcaaagaatacggtgacccagctctcaaccacagacctctagagaatgctggtgcccagcatccctccctggggaaccctcgtatccaagcccatagcccctacccctcagctcccagtcttctgccctcttaggaacccttgtgtcctagcccaaagctcccagcctactaaggagccctggggctaaagccccccatcctctttcctctcaagaactattaggtcagccaggtgtggtagctcacacctttaatcccagcactttgggaggccggggtgggcggatcacctgaagtcaggagtttgagaccaatctggccaacatagtgcaatcccgtctctactaaaaatacaaaaattagctgggcatgatggtgggcgcctgtaatcccagctactcgggaggctgaggcaggagaattgcttgaacctgggaggtggaggttgcagtgagccgagattgcgccactgcactccaacctgggtgacagagtgagactctgtctcaaaaaaacaaaacaaaacaaaaaaaaacttaaaaagaaccattaggttaaagcatcctccatctccagaccccatgagaatcccagtgtccaagactcctaatttcttacaagaatcttttcaccagtaacccaggcagcaggctgagtcactcactggagctgctgtccccttctgcagagatcagccgggacctaaatgactccagggtaaggaggccctggggagtctgtagggtagaagacacaaatcccaagccccaccttctacctctcctaatcttgaccctatagaccctctcaggatctacaactgcctccacccagccagcagtgttggtagtggagtcttcagcaatggagagggcatccacatttaactctggccccttgttgacgttcagggctaacctaggccacctgagcacccgctatgtactaggcactgttgtagatactgaggattcgttggtgaaaaggacaaaaacaggctgggcgcagtggctcacgcctgtaatctcagcactttgggaggctgagacgggcggatcatgaggtcaggagatcaagaccatcctagccgggcgtggtggcggcgcctgtagtctcagctacttgggaggctgaggcaggagaatggcgtgaacccgggaggtggagcttgcagtgagcggagatcgcaccactgcactccagcctgggcgacagagcgagactccgtctcaaaaaaaaaagaaagaaagaaaaaagaaaaggacaaacactatccccgctctgatggaacttatagcatagtagaggggaagcagacacaaacaagaacacaaataaataagcaggattatttcagatagcggttagagcaataaagggaacaaaaccctgtaatataataggagggggaggggagggtcaacattagctgggtggtcagggaagtcatttgagcagagacctgaataatgaaaagaagtcatcctgtggaggcctgtggagtgtgagccagcagggaggggggttaaagagcccggatgtacctgggcacccaccaagggggttgttccgagtgccaatatcctgaccttttgtccctggaatctcctcggagctggcttttctctcctccctccaccccaccttctccaggacactgtgccaccaacctctctttccccagcctgccctagattccaggattcctgattaccatccagagctgtctacactctttcattaagactgacttcgctttgacatcgactttgccaggyccccaaccaagggcacctacgatgcctgcccagtgtcccctgccttccccacacccccaaaaacttttcagagcttggcagcacacactaaagcctctgggcctgatctacccactcaccccatcctacccactgcctctctctctctctctccctcccttcttgctgcgccccccccaactttcattcaattaacatgtattggctgctgatacattggtcaaatactgtgtagcccaccacagggactctaaagatgaatataaaacttggtactgggctggagaaccagggtctttttttttttttgagacggagtctcgctttttctcccaggctggaatgcagtggcgtgatcttggctcactgcaagctctacctcctgggttcacgccattctcctgcctcagccttctgagtagctgggactacaggcgtacgccaccacgcccagataattttttgtttttttagtagagacggggtttcaccgtgttagccaggatggtctccatctcctgacctcgtgatccacccgcttcggcctcccaaagtgctgggattacaggcgtgagccactgtgcctggcctttttttttcttttgagacagagtctcgctctttcagccaggctggagtgcagtgacatgatctcagctcactgaaacctctgtctcccaggctcaagcaattctcctgtctcagcttcccaagtagctgggactacaggcatgtgccaccacacctggctaatttttgtacttttagtagagatggggattcaccatgttggccaggctagtctcgaactcctgacctcaggtaatctgcctgtctcggcctcccagagtgctgggattataggcgtgagccaccgcgcccagccttttttttttttttcttttgagacagagtctccctctattgcccaggctggagtgcaatggcgtgaccttggctcactgcaacttccacttcccgggttcaagtgattctcctgcctcagcctctcaagtaactgggattacaggcatgcaccaccacacctggctaatttttatatttttagtagagacaaagtttcaccatgttggccaggctggtctcaaactcctgacctcaggtgatctgcccacctcagcctcccaaagtgctgagtttaagggcgtgagccaccgggcccagccagaaccagggtcttgagagagagatagacatgtaaaatgctttagcagaggtatctgagatgccaagaaacctagttgctagttctactaaggaccatcaaagaaatgagttatggctggacgcggtggctcatgcctgtaatcccagcactttgggaggctaaggtgaatggatcacctgaaatcaggagtttaagaccggcgtggccagcatggtgaaaccccatctctactaaaaatacaaaaaattagctgggcgtggtggcgggctcccataatcccagctactggggaggctgaggcaggagaatcgcttgaacccgggaggcggagggtgcagtgagctgagactgcaccattgcactccagcctgggcaacagagcaagacttcggaacaagaaaacaaaaaaataaaaaaacaaaagaaacgagttgttagatgtgcgaagttgaacaaatgactaaacctctattactgtttccccatctacaaaatgggaagtttctctatcttagaaggttactgtgaagatttgatgaaatcatgtagacattttaatgtctagcatagtgtttggcatacagaaagtgctcaatatatgagatatatatatatttctcaatatatataagaaatgttgttcttattaatctcacacagttcctgacatattagttctcacatagttcctgacatactagtctgagcctgctgggtatcaaagatctgggagggcgtgtgacatggatgaaccatggagaggctgagatggagtgagggcaggtgggggctccttgggctatgtggccttgtgtgtcctgctgaggagttggagcttgatctcgtcagtgaataaactttattttcttatctattcttctttttcttcttcttcttttttttttttttgagagagagtctcactgtgtcgcccaggctggaatgcagtggcgtgatctgggctcactgcaacctctgtctcccgggtttaagagattctcctggctcagcctcccaagtagctgggattacagatgcccaccaccacgcccagctaattttttgtatttttagtagagacggggtttcactgtgttagccaggatggtctcaatcttctgaccttgtgatctgcccacctcggtctcccaaagtgctgggattacaggcgtgagccaccatgtcaggcctttttttttttttttttgagacagcatctggttctgttgcccaggctgaagtgtagtggcgcgatttcagttcactgcaacctccagctcctgggttcaagcgattctcctgcctcagcttcctgagtagctgggattacagacatgcaccaccacacctgactaattttttgtatttttagtagagacagggttttaccatttggccaggctggtctcaaacttctggcctcaagtgatccacacgccttggcctcccaaagtgctgggattacaagcgtgagccaccacatctggctttctttcttccttttcttctatttttttcttttttagagacagtcttgctgtgttaccaactgtagtacagtggtgcaatcatggctgggaccacaggagcaggccattgcacccagcttatttttaaattttttgtagagatgcggt

SEQ ID NO: 12426 - DNA, 80475 bp, Homo sapiens
attcactgaagtcctaacccccaatgcgatggtattaggagatggggtctttgggaggtaattagatctagattaggtcaggagggtggggacctcatgatgagattattaaattttaagaagaggaaaagatgagagagctttccctctccccacatgcatacttggagataaggctgtatgtgagcctacattaagaaggctgctgtctacaagccaagaaaagagccctcaccaggaactgaatttgctagccccttgatgttagaattcccagcctccagaactgtgggaaataaatacctgtcatttaagccatcaatctgtggcaatttgtgaaagcagctcaggctaaaaagcacaaagtaaggtctatgggcttgctcttgctgttttgatgacctgccctctttactgctaagcctgagggagaggctcctaggcagcacttcaccctgtcaaaagccctacctcccaggaaggttctagtgcaggagtgtccaatcttttcacttccctgggccacattgggccacacataaaatacaccaatgatagctgatgagctaaaataaaagtcccccccaaaatctttttattattattattattattattattattattattattattatactttaagttttagggtacatgtgcacaatgtgcaggttagttacataagtatacatgtgccatgctagtgcactgcccccactaactcgtcatctagcattaggtatatctcccaatgctatccctcccccttccccccaccccacaacagtccccagagtgtgatgttccccttcctgtgtccatgtgttctcattgttcaattcccacctatgagtgagaatatgtggtgtttggttttttgttcttgccatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatatgtctgcatgtgtctttatagcagcatgatttatagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgagatgatatctcattgtggttttgatttgcatttctctgatgaccagtgatggtaaccattttttcatgtgtcttttggctgcataaatgtcttcttttgagaagtgtctgttcatgtccttcgcccactttttgatggggttgtttgtttttttcttgtcaatttgtttgagttcattgtagattctggatattagccctttgtcagatgagtaggttgcgaaaattttctcccattttgtaggttgcccgttcactctgatggtagtttcttttgctgtgcagaagctctttagtttaattagatcccaaatgtctattttgtcttttgttgccattgcttttggtgttttagacatgaagtccttgcccatgcctatgtcctgaatggtaatgcctaggttttctcctagggtttttatggttttaggtctaacgtttaagtctttaatccatcttgaattaatttttgtataaggtataaggaaaggatccagtttcagctttctacatatggctagccaattttcccagcaccatttattaaatagggaatcctttccccattgcttgtttttctcaggtttgtcaaagatcagatagttgtagatatgcggcgttatttctgagcgctctgttctgttccattgatctatatctctgttttggtaccagcaccatgctgttttggttactgtagccttgtagtatagtttgaagtcaggtagtgtgatgcctccagctttgttcttttggcttaggattgacttggtgatgcaggctcttttttggttccatatgaactttaaagtagtattttccaattctgtgaagaaagtcattggtagcttgatggggatggcattgaatctataaattaccttggacagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatactggcaaaccgaatccagcagcacatcaaaaaccttatccaccatgatcaagtgggcttcatccctgggatgcaaggctggttcaatatatgcaaatcaattaatgtaatccagtatataaacagaaccaaagacaaaaaccacgtgattatctcaatagatgcagaaaaggcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaacactggcacaagacagggatgccctctctcaccactcctattcaacatagtgttggaagttctggccagggcaattaggcaggagaagggtattcaattaggaaaagaggaagtcaaattgtccctgtttgcagacgacatgattgtatatctagaaaaccccaaaatcttataatattttaagaaagtttactgatttgtgttgagctgcattcaaagccatcctgggccacatgcagcccatgcgctgcaggctggacaagctcggtctagtgaattccaccattacacctctctcatgatctctttctgtgtctttgatagccttcacagctccctatgtgggttcatctgtccactctgagccctttctgtgcaaactaacccactcttattgggagctgacatctgctgtcaaaagacaaaattacaacaaatttaaagatcctaaatggattttatctgtgattctagaattggacaacaccttattctgtacaaaagaaggagtgttccaatgatctgagcaaaggatgtataaccacccgacaggttcaccttgcccactgcctagacagagccaatttatcaagacagggggactgcaatagagaatgagtaattcacacagagccagctgtgtaggagaccagagttttattattactcaaatcagtctcccagagcatttgggaatcagagtttttaagaataatttggtgggtgggtggaggccagtgagttgggagtgctgattggttgggtcggaaatgaactcataggaatttgaagctatcttcttgtgctgagtcagttcctgggtgggggccacaagatcagatgagccagtttatggagctgggtggtaccagctgatccatcaagtgcagggtctctaaaatatctcaagcactgatcttaggttttacaatagtgatgttatccccaggagcaatttggtgatggtcagaatcttgtagtctccagctgcatgactcctaaaccttaatttctaatcttgtggctaatttgttagtcctacaaaggcagtctagtcacaggcaagaaggagatttgttttgggaaagagctgttatcatctttgttttaaactatgaagtaagttcctcccaaagttagttctgcctatgcccatgaataagcaatgacagcttggaggctagaagcaagatggaattggttaagtcagatctctttcactgtctcagttataattttgcaatggcagtttcattaggccacgttaactaacttctctacacctcagtttctcactctgtaaaatgaagatggtaagttatacgaagttcaaagtgagtttatactggtagacatcagaatagtgattgccttgggagtttaggaagggtcatgaaggaaacttctggagtggtggaaatattctgttttgatctcagtgtttatatgggtatatacatacattttaaaaaagtcattggccaggcacggtgactcacgcctgtaatcccagcactttgggaggctgaggcaggtggatcacatgaggtcggagttcgagaccagcctgaccaacatggtgaaaccccatctctactaaaaatacaaaattagagccatacgcagtggctcacgcttgtaatcccagcactttgagaggacgaggcaggcggaacacctgaggtcgggagttcaagaccagcctaacaaacatggagaaacctcgtctctactaaaaatacaaaattagctgggcgtggtggcggatgcctgtaatctcagctactcgggaggctgaggcaggagaatcacttgaacccagaaggcagaggtttcaatgagctgagatcacgccattgcactccagcctgggcaacaagagtgaaactccgtttcaaaaaaaaaaaaaattagctgggtgcggtggtgtgcgcctgtaatcccagctacatgggaggctgaggcagaagaatcagttgaaccagggaggtggaggttgcagtgaccggagatcacgccactgcactccagcctgggtgacaggagtgaaactctgtcaaaaaaaaaaaaaagtcatcaagcagttaagattagattaaaatgcagtaatctaatcttaattagattagatacttagatacctttatttaaaattttttaaaagtggagataatagtacctacttcccagcatcattgtgacgattaaatgtgctcagcaggttgcataattgtttctgatctagctagtatccagtatttgtctattgtcacaggtggtgactgctggaggggctgagtccccaataagctgtgaatgtcttggaggacaagtatgttggccccttcttgttctagcagtgaagaggatcccatgtagactccaagcagctcaagttcagcaagggagacagaccattgcaagtgcatgaaaagggcactggtgggctgggaagttcgtaggaggagcctctcacatgctgggtttggggaggaattctggaaagcagttagtcttagggacgggaaggatgtagctggtgggacgggcgccctcagctccatgaataaaaggagtgggtctgactctggttctcattcccctttaccatgcctggcacacattagaccatcaataccaattgactccaggaaggagtgtctccccgtgggggcatcaggagccgctgagtttaaatacacaggtgggatgtgacacactgggaaccattcagatttgctggatctggatagggcttgtcaggactcagtgcttccaaccccagggcccatttccctgtggcccctgagtcaccaccatgggtggacagctgctccagtgccaagatacagccacagaggactgcaggcccagggcctccagaaggacaggcaggctccctctgaaagacaagcctgcttatagctgaaacctctggcccaggcgtcctctaagggaagccaggctgtgtcagggcacggcccatgaagacataagatgaagatggggagaaccagagggggtgcgcttcgaaggaaagcgggctgcgtgggggcaccgtcgattgcacaggacgcggtcccggctcgcgtagccccgcaggcggcgccagagcgcargcccgcctcgtgactccggtccacagtccggccgggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtacagtcgcctggccgcagggccacggggccgcctcctccgcttcggtgggggtagggggcgggctgtcacccggacgcgggaaaacatgggcccggccgcgggcgcgcctacctctcgggcttcccggggcccccgcgcccctgccctgcgcgcggccgtggggcgccggtgccctcgcccggagatgccctgccaatgccacccgctygcaagatgcggcctsgaccccgcctggacccagctaccccaggaaactgcaggcgctcctcggcaggacccccggtgcccagaggggccggaggactcggcgggttcctgcgctgttctgggcacccagtgacggggatccgaaggaagtcagctactgtaaggcaggggaacagacaggcgggtagccctgcgcacatgcacaaccagtgacctggaagcagattatagcccaaaaccytttttwaaaaattgaaatggcccaggcctggtggctcttgccggtaatcccagcactttgggaggccgaggcgagtggatcgcttgagcccaggagttcgagaccagcctgggcaatatggagaaaccccggtctctaccagaaaatacaaaaattagccgggcatggtggagcacacctgtagtcccagtttttctggaggctgaagcggatcgcttgagcccaggaggtggagattgcagtgagctaagatggcgtcaccgctctccagcctgggcgacagaacgggaccctgtctcaaaaaaaaaaaaagaaaaaagtgaaatgcatagtgtacaagtggactttaccctgtgaccgcccttcgttgacaccagcttgcctggtctgtgcacccaggactgctggccagaggagcagtgtgctgctgccaacgcccygcagacaggcaagcaaatcaaaatttgccttcaaagagggcatggggtgaccgggggcaccttttcctttaaagtacttgggaaatatacacagttgcagtcaaacccctcttctcgaatgggtcaagggaggcaggcctctggccagtccttgggggaacgtcctgtgggactctggatgactcgagttgccttgctggacctcagttttcccatctgtccargaaaggagttatactcccaagcttggagattgcttcagtgggacattaatgtctctggaccacaatcatggcctgtgagaatagcccatggccttgcctggtctcaggcctctgcagacatggatccccagagatgcctccaaaccttgcttcccattccttcctctctggcactttctcccgcctccttgtcaggtgcacgaaccaactcatctgtgaacatcttcctctagagggtcttggctttggctatttggggaacaaagattccttgagacatgtgggtgttcctacttagcctcagtttcttcatttkactaaatctttgagtgttaccccagatgartcctctgttaccacgattacggtgaggcagccctgccttcaaggaggtctctaggttgaactgctcctagggtgtggggcctcatctggtgacgttagtaccccctggaccagtgtagaagctgaggaaaattctacacttcmttttttaaaatgcctttcaggtaaaggttgttgctgttgatgcagagttgaatgtcttctatgaggaaagtgtgcattttgacagagatcttccagaatttgggyatgtacttgatgtgcatgtgtgtgtgatgggggtgttggttttggggtcctcccgcaaacttttgtattcgcagaccgcactgttgaggctttgccaaatacaggagtggtggtctcggcagacctttcaagcatctttttttcctatacctagagtgccatctcccccatttcttcctaattccattcatccattcatgaagtaagcatcagttgagacctactttgtgccaggtgctaggacctgatggcgaaacaaaaagagaaagctctcccagagcttcccactgagtagtggagactggtatcaaacaaagaatctcacaaaagagtgtttcattataaactctgagaaggcctctgaaggaaaggaactcacttctccaagtgcttattataaaggaatgtgactcagacttgggaggggaagtcccagagcgtctctagggaagtggtgcttaagctagagatcagagtgagtgaagttagccaagcgatggaagggaagttggccaggtgatggaagagcattccaggcagaaggaacaacatgtgcgagggccctgtggcaagaaagagcatggttcattccttcatgcaattgaagaaagccaatgatgctggggagcagagagaggcggaggctggtcagagctccataggccatggtatagagtttgtctttattctaaaagctatggtcagccactaagggccataaggggtaggggtatgggtgaggtatgaatgacaggttgyatttttgttttgaaaatatctctctgggggcattgggagaacagattcggagcattgctggaatggacgtggggaactattaaagaggtttttgctggtcattcaggtatgaaatgatggataggagagagctgagtagtaaaatggacaggtcctgttacaaaattgaatgtgagatgtaagggtgggatttctggctgtccttcagagtggatgttggactgtgggaaagaatgagttttggagagaaagatcatgagttcagcttgggctgccataacaaggtaccatagactgggtgggttaaagagcggaaatttatattctcacacatctggccgttaggagtctaaaatcaaagtgctgggaagattggtctcctctgggacctctctccttggcttgcaggtgaccactctcttgctgtgtcttcacatggtggtcactcggtgcaggagtgcttggtgtctstgtcatctgtatcctaatcttcttataaggacatgagtcatactggattaaggcccattctaatgacttcattttaacttaattgcctttttaaaggccctgtctccaaataatcacaatccaaggmcctcggggttaggatttcagcatatgagttttaggggcagagggggcacaattcagtccgtaacactgtggacttgctggttttgaggcaccctcgtgagggcctggtaaaagtgtccttccctgtctgttttagacacacttcctctttgaagccttcccagctgaccctttgtgcacctctcattacccatcacattgtgttgccaactctttgcccccagctaatgcggccccatggagccgaggttagaagccatcttgctttctcacattttttattattgcaggccttgcatgtttgcctttgggtagttggtatgtttcaaggaattggtcttttcaactaagccatcaaatgtgtggccatagtgttgttcataatattcctttatcctccttatgacatctgtgggaccagtaatgatgatctcttgctgttggtcatttctgatattggtaatttgtcttctctctttttttctttggttatcctggctagaggtttatcaattgtattgatcttttcaaagttcaacttttggttttgttgattttcccctgttgttttcttcaagttgtgctctaatttttattacttagtttcttctgcttgctttaggtttaaattgctcttttttccctagtttcctcaagtggaaacttagaggattgatttaagaccttcttttctaatatatgcatttaatgctataaatttctctgtaarcacaaatgctttttatgggatgccttagcagcatcccatacattttgataagttatagtttcatttttttcgttcaaaatattttttagttctcttgagacttctttgactcatgggttatttagaagaatgtttttaggctgggtacagtggctcacacctgtaatcccagcactttgggaggctgaagcaggcagaacacttaaggtctggagtttgagaccagcctggccaacatggtgaaaccctgtttctactaaaaatacaaaaaaattagctggacgtggtggcaggcatggtgacaggcmccgtgtatgctgcacgcctgtaatcctagctagctgggaggctgaggcaggagaattgcttgaactgtggagagggaggtttcggtgagccaagatcgcgccmctgcactccagcctggacaacagagggagagcctgtctcaaaaaaaaaaaaaaaaaaaaaaaaaaaaggaagtctggaagtgtgttgtttaatctccagattttccagttttctgttattgatttctagtttaatttcattgtggtctgagaacataccctatatgacttctagtctttcaaaattttaaaatttcctctccctcactctctcttccatttaataagtcagtcctctccactggacatttaaaaaaaggtgtccataaccaaaatatggtattgcttttttccattatattttcaagatattttaaaccagatgcctatagatttagttcattccttccccatcacctcaattgcattgtgggttttctttttacaactttattaaggtataactgatgtacaatactgtgcatatttggagtatacagttaaaagctttaatatctgtattctttcatgaaactatcaccaaaataagacaatgagtatttccatgtcctaaaaatttcctcctgcctctttgcaagcgatgcctccttccccatacccctacccactggcaaccgctgatgtgttttctatcactagtttgtattttctagaattttgtatagatggaatcataattatgtatgcttttttaaaacctttaaaattttacatcacagttttgagattcatccatgttgctacatgtggcaatagttggttcctattattgccgagtagtatttcattgtatgatgttgtatggatggactacaattggtttcacctgatgagggatattggggttgtttctcttttctgttgttataagcaaagggctatgagagtcacatacaagtcttttcgtggacatatgatttcatttttcttggaaatgacataccaggagtacagtggctgagttatacggcaggtatatgtttaacttcttaaggaattctcttccaaagtggtgattttaagaaaaaaaattttatattgttaacaggcattacattgcacttaatatgtaactcaaatgaaaagtatacagtgaaaagtctttttttttctttttttctttcttttttwgagacagagtctggctctgtcgcgcaggctggagtgcagtggcacgatctcggctcactgcaagttccgcctcccgggttgtcctccattaggaaatggtacatctacacaatggaatactacacatctataaaaaagaacacagaagtttttatgtattgacatgtaaacacagccacgttactgtgaagtgagtaaagcaaagtacagatcagtgagtatagtatgctttctcttgtatgaaaggaggaaaatcagaatattcataccttcctatatttccatgtaaaaacactggaaggagcctggcacagtggctcaagcctgtaatcctagcactttgggaggctgaagcgggtggattgcttgagtccaggagttcaagaccagcctaggcaatatggtgataccctgtctctaccacaaaagtgcaaaaattagtcatgtgtggtggcgtgcacctctagtcccagctacacaggaggctgaggtgggaggatcacttgagtccagaaggtggaggatacaatgagccaagatcataccactgtactccagtttgagggacagagccataccttgtctaaaaagtaaaaaaaaaaactagaaggatacacaacaaattaaagtcatctgtagagaagggacggagaggagagatgagctcacaggtgggattaagacttttcactgttatatggggtttcaccatgttagccaggatggtctccatctcccaacctcgtgatctgcctgcctcagcctcccaaagtgctgagattacaggcgtgagccaccacacctggccaagttgtcgctattattgccacrcacagatatttatgtcattgaatttcccagtctcttttattgcttctagattttgagtcatagttcaaaaggccttcctcactccaaaattatgaaggaactcacctatgtttttatctagttcttgtaagatttcagctttcttacataaaaatatttggagtttatccaggtacgtagtatgacatwtgtatccaactttaatttttcccagatgattcttcagttgttgtaacaccaaccatgtttktatttaatttattttttttatttgagacaggagckggctgtcacccaagctggagtgcaktggtgtgattcagctcactgctatctatgcctcccgggctcragcaatcctccctccttagcctcccaagtagctggaaccacaggtgcgcccctaccatgaccagctaatttttttgtattttttttgtagagatggggtctcactctgttgcccaggctggtctcgaactcctgggctcaagcagtccacccacctctgcctcctaaagtgctgagattacaggcgtgaaccaccacacccagcctcaaccgggtttttagaagtccatctttacctttaagaggctgaggtgggcggattacctgaggtcaggagttcaagaccagcctggctaacatggtgaaaccctgtctgtactgaaaatacaaaaattagctgagcatggtggtgggtgcctgtagtctcagctacttgggaggctgaggcaggagaatcacctgaacctgggaggcagaggttgcagtgagctgagattgtgccactgcattccagcctgggtgacaaagtgagactccatataaaaaaaaaaaaaaaaaaagaagtccatctttacctccatgatttgagatgtgagccttatcatgtgctactttctgtgttcacttaggtccatttttgggcttttgtttttgttccatggtttggtagatctgttcataagccagtaacacattgtttcaattatcccagctctgtaatatgtttgyttgtttgtttatttacttttgagttggagtctcgctctgtcgcccaggctggagtgcagtggcatgatctcggctcactgcaacctctgcctcctgggttcaagtgattcttctgcctcagcctcctgagtaattgggattacaggcgcccgccactggctaatttttgtatttttagtagagatgggtttttgccatgttggccaggttggtctctaactcctgacctcaggtgatccgcctgccttggcctcctgaagtgctgggattacaggtgtgagccattgcacccggcctgtaatatgttttaatatctagaattgttggtcccctctgtttgtttttttttccagagtttccatggctattcttgttctttttcaatatgtacttcagaatcagcttttcaggttccagaaagccaaattgttaatttttttttttttttggacatggagtctagctctggagcccaggttgaagtgcagtggtgtgttctctgctcactgcaacctccacctcctgggttcaagcaattctcctgtctcagcctcccaagtagctgggactacaggcacataccactacacttggctaatttttgagtttttagtggagacagggtttcaccataattggtcaggctggtctggaactcctgacctcaggtgatccacccacctcggcctcccagggtgctgggattacaggcgtgagccaccacacccagcctgttgttaatatttttattgagatcatattatctttataaattaacttggcagaattgacaactttatgagattaagtcttcctgtctaagcacacgttatgactttccatttgttcaagtcttcttttgaatacttcacatgtgttttaatatgtttaacatacagcttttgctcactttggtagattgcacaaatgaccacaatactccacccatccctgtacccacaccctttgcaatgtgactgyaattcctcccatcaaggagtcgtttccctacctgttgatttgctttatccagtagaacaggggaagtggcattgtgccagttctaagcctaagcctcaagcagccttatgtgcttctgctgtcattcttggaactctgcctagccaccaaatgaacaagctcaggctatactgctggagagttggacatatgtggcctagttgccccaacttcttcccctaagagccagccagcccctagctactgttagctacctatgaagcagagccttctagctaccgttaactgactgcagatgtatgagtgagcccagctgagccccatccaatgatagcaagtagaattgtgagcttaatggtttttagccactaagttttgaagtggtttgtgacaatgcagaaattacccaatgtagataattatttttaagtttatttctaacttttttatccttttactactgtaagtggggaagggaggtttctagcagaaacttatcagctgtcttccaaactcatttccctttcttcctaggcactctcctgccttccttgtagttatgttcagccatgtgactgagttctagccagtggaatataagaaaatgtgatcaggcctctaaaagacctagtccatcaaaacctccttctctgacttttctcccatttttggctgatgtgggtgtccagagcaaccttggaagcacatgtggaacatgacagagccaccatcaacctggttcctgaatgactgcatggagcagaactccccactccccactcatgttcctaaccacctactgattgtgctttacatgaggagaaagaaacttcagctgtatcaagccatagaaatgtgtttttccttaactaatataattttttccctcatatcctttttttaaagaaaatactggggccaggtgtggtcgctcacgcctgtaatcccagcactttgggattacagaggcgggcacatcacgaggtcaggagatcgagaccatcctggctaatgcagtgaaaccccgtctctactaaaaatacaaaaatttagccaggcttggtgccgggcgcctgtartcccagctgctcrggaggctgaggcagragaatggggtgaacctgggaggcagagtttgtagtgagccgagataatgccactgcactccagcctgggtgacagagcaagactctgtctcaaaaaaaaaaaaagaaagagaaaatactgtttctattgaaatgtaattcacataccataaaattcaccttttaaaatgtacaatttgatggttttagtatattcaaagaacaatatcactatcaccactatgtaatcttagaacattttcaccacctggaaaggaaaccctgtattaattagcatccactgtatagtccccctcctgccagtagtggcaaccacaatcaactctctatctctggatttgctgattctggacatttcgtagacatgaatatatataatatgtgacagccttcttttacttagcataatgytttctttttaaaaawttttcatagctttttgyttrtttcaaataccaacttgaaccagatacctggcataatgttttcaaagttcatccatgtcatagcgtgtgtcagtacttcattcctttttgtggttcagtaatattccattgcattgatatatcagagtttgtttttccattcaacttttagacatttgagttgttctgcttttttgctattgtgagttattctgctatgaacatccacatatgttatggattgaattgtggccccccagaattcatatgttggaagcctaccctcatcatgacagtatatttggaggtgaggcctttaggtagataattaaggttaaatgaggttgtaagggtggggctctaatttgataggacctgtttccttataagaaggagagacaccagtgctatcccacttcatgcgcagatgcacagaggaaaggccttgtgagaaggcggctgtctgcaagctggaaagagagccctaaccagaaactgaatttgctggcaccttaattgtggacttctagcctccagaactgtgagaaaataaatgcctgttgtttaaaccatctagtttatggtattttgttatagcaacctgagcaaactaatacaaygtatacgtttttgtgtggacatatattttcatttctattgggtatattacctaaaagtggaattgcggggtcacatggtaactctgtgttcaacattttgaagaattgccaaactgttttccaaagkggctgtactattttccattcccaccagtggtagatggtgcctctagtttctctacatcctttttttttttttgagatggagtcttgctctgtcacccaggctggagtgcagtggcgtgatctcggctcactgcaagctccacctcctgggttcatgccattctcctgtctcagcctccctagtagctggaactacaggcacccgccaccacgcctggctaattttttgtatttttagtagagatggggtttcaccgtgttagccaggatggtctcgatctcctgaccttgtgatccgcccgcctcggcctcccaaagtgctgggattacaggcgtgagccaccgcatccttgcttaacatttattattgactgtctttttaattacagacggcagccatcctagtggatgtgaaatgcaatctcactgtgcttttgatttgcatttatctaatgataatgatgttgagtatctttgccatttgtgtatcttctttagagaaatgtctattaagatcttttgcccttttttaaaaaaaactgtgttatttctcttttattattgagttgtaaaagtttttttttaatgtatattctggaaacaagtcccttgttagatatgtgatctcaaaatttttgtcccattctgtgggttgtcttttcactttcttgatgatcctttgaagcaatgtttttarttttgataaagtctaatcttcctacttttttccttttgctatttgtgctttggtgcagtattggttaggttttggtatcaattttatatttacttcactaaaataattggaaaaattttccttcttttcaggtgctctagaacaatttaaatagtattagaaatatttgctatttaaaggtttggtcccagcactttgggaggccgaggcgggtggatcatgaggtyaggagatcgagaccatcctggctaacaaggtgaaaccccgtctctactaaaaatacaaaaaattagctgggcgcggtggcgggcgcctgtagtcccagctactcgggaggytgaggcaggagaatggcgtgaacccgggaagcggagcttgcagtgagccgagattgcgccactgcagtccgcagaccgacctgggcgacagagcaagactccgtctcaaaaaaaaaaaaaaaaaaaaaaaaaggtttggtataatttttctgtcaaaccatttgggcctggtgcttttggggcatggggtggctctggtcttccttcttagctggaaatgccagttttgttttgtgtgtgtgtgtgtgtgtgtgtgtgtgtgtgtgtgtgtgtgtgtgtgtgtgtttttgagacagarccttgctctgttgcgcccaggctggagtgcagtggcaagatctcagctcattgcatcctccgcctcctgggttcaaacaattctcccaccttagtctcccaagtagctgggattacaggtgccctccaccatgcctggctaatttttgtatttttgtagagatggggtttcaccatattggccaggttggtcttkaactcccgacttcaggtgatctgcctgccttggcctcccaaagcactgggattataggtatgagccaccgtgcccagcygaaatgccagttttaagttgttaaatacatggcagaatgtctggttacagtttttatctgttttgtgaaggcaacattttttggtgagcttttattgtctgtagtaaaattttgttgctctcttcctctttttccctagtagtatctttttaaaaaatccatattattgagtataatttatgtacaaaaaatgccatccattaaaaatgtataattaaaggtactttgccagatatagacctatagctgtgaaactaccaccacaatcaagatacagaatgtttatatcacccyccaaaagatcgcttttttccctgcttaccgagacaagctcggttgtggagactccaacgcaccagcactagaggaatgaagacaaagacccagaaataaagtgcagtgtgggaatcggctaaaagcctttagagctgagagccacaaacagagttttgcccacatatttattgacagtaagcctgtgataaacattgtttctaaagattatagattagctgaaagcattycttatgggaaacaaagcattcttttcaagaagcagagaaacaggctgtggctgattatctgcagcaggaacatgtccgtaaggcacagatcgcttatgccattgtttktggtttwggaatgccttgagtggttttccgccctggatgggccaggtgttccttgccctcattccggtaaaccagcaacctccagtgtgagtgtcatagccatcgggaacatgtcacattgctgcagaaatcctgtttatggccagtttctttaaggcctgtttrtgacaggcttagggcctgttcccagcacccactagacttagacaaccactgatctccttttctcagtatagatgaatttgcgtcttctagtctgttcctatataagttataattgtgtacatatgaatagttcatattttttcttgctctgtagtatgatatcacaaatatacaccacgatttatctgttcacttgtttagggacactgggttgactccagttaattattacaaataagtctgctatgaatatttgtgtacaaatctttctatgggcttagactttcatttctcttggctggatacttaggaattgaatggctagatcacatggttatctaatagcatcttggtgtggattctgagmctggttttctctttcctaacacatagttaaaagggttggattttatcagatcagctctttgcactagagtcttctaggggtgaggtgggtggggagagggttccagtcaaacttccaaagcctgtagtccaaggacttgttggtctgttgtgatagtagagacactcttccctccgacgcagcatctctgtgtggctgcccctcctctacctctccaaacctatggggcttgagagggattttataatccaacactgcactcccctagggtgagcctttcttatctagaaggcttctttagaagatgcttctgagaattgccacatctgggccactctgggcaatttgcctgtcttctctttccatctttgcagccctygtgcctgttcaatcaacagttcccacttggggttggggaaggttctccttcatctggacatttccagagtcatccaccatagggtttctcctggctttgcaatggtctgcctkccctgaggctctggtctacattctctgttgttcttgcaggactcagggyggtgttcatgtgcacaaggatgggctgacggtcacttctccagtactaatgtgggtccaggtaagcgcagggattcctrttctccttctatccccaggctgtctcactggcagactyggtgatttgctaggaagtccaaaggtggcagccaatgagagcatctgttgwcaccaggtcctcatgggaargtggagttggcatgactcctgggatcaggctcagcctcagctggtgtcaacactcccaggctcagaggacttacaaaaaacttccaggtactggagctacagcagatggcaagtcctgccattaaccacctttaaaataacacagagcaaatcttttccaaacatctgcagtcaggccctgtggcctcccttgtaccatgaaatatacaaacatagactgggcatggtggctcatgcctgtaatcccagcactttgggagrccgaggcaggtggatcacctgaggtcaggrgttcaagaccagcctggccaacatggtgaaaccttgtctctactaaaaatacaaaaaattagccgggcgtggtggcccatgcttgtaatcccagctactcaggaggctgaggtaggagaatcacttgaacytgggaggtggaggttgcagtgagctgagacygcaccattgcactccagcctggataacaagagtgaaactccatctcaaaaaaaaagaaaaaaragaaatacaaacatagcccttagggtcttagtgctcagcctcyaagatcccttagctccctaatcacctagaatggcaagttatggcctggccagtcagactcatatcaatgccaagccaggcctgcctgctgaggatcaacaggaaaggmgaatgcctgtagcaggatctggtgacctagggggccacaggagcagggatgtggacagcatagacaggcgtggtagctccaggggctacctcatcatatgctgcagggtccccgagtccctgaaactggaggccagctaagtgtgtgtcttccaaaagcttttttcagtcctccaatacctatctaaccaattccctatatwacattctttttgttmaaaataactggtatgatttcttttttattggtgtaaccctgattcawacamtggagaattggggtaaaggatggattttatccagataaactggstagaatgtamttcagagggggctgagccagaccaaggggcagagtgggagggtcgggggttagagacaatggtcagtgtcaggaggtcccagtgatgatgtcgagggcatctcataggccaaggccttcacctggggaggtgagcagtgggtgagaaccaggcttgggggcmgggccaaggtgatttctgatytgaygcagcctccaggaccaaacttgatcctagctctgccagcccctgctccggctgcaccccactgcctgcccaaggtttgatggrcacagatagagatggcagccacagccagggctgaaagaagccctcccagcaaaggctgggggtggtggagtcaggcaaaagtgagagagtcttctctgccctcaggaaaacacaggtcagagtgaatctctaattcctgccatgaaatcttaggagggtggtgccaagctctgctgggcaccaccatccatcccactcactgggttttgctagaaaggagggtccaaccagacagtggaggctggaataggggcctggaacaggtggccatcatctctatccactccctccagcctctggctcctggacacagggagtctgggcctgatgctttgctctcaygggagctctctcctttgctcttcacttccctgtkgcagtgaagtcagatcactaatatagagggttgaaaatgcaaataaaagaaggcaaaagttggctgccttactttgttagtttttgagacaaggtctcactgtgttgcccaggctggagtgcagtggtgtgatcatggctcactatagcctcaatctcctgggctcaggtatcctccctcctcagcctcctgagtagctgggattacaggctcatgccaccacacccagctaaatttttcattttttgtagagatgggatctcattatgttgcccacactggtcttgaactcctgagctcaagtgatcctcctgccttggcctccaaaagtgctgggattacaggtgtgaggtgatggcatgcacccgtagttccagccactygggaggctgagatggaaggatcacttgggcctgggaggttgaggctgcagtgagctgagattgcrccactccatttcagtctgggaaccagagcgagaccctgtctcgaagaaaaaaaaatggagaagtaaaatttgaggattggtggtttatgattccatttatttaaaatatttttagcatagttgacctttttatttgattgatgcctacttgttwaattaatgtactctagtgcttacaaatcccaagtcatgagtttcttcatcatctgcccagagtactctgctgtaatggcaggcacttgcgtttcaattctgaggcttgcgtgtctgattcagtggttctgtacagtcatggtgggttctgtttttcttcttaggcactggatatcatcttggagaagatgaaggcttcgggcttcgamttctctcaagtcctagccttgtccggggcgggccaggttcgtttgcagcagactctgtctgccatgtgagggtgactgtcctgggcaatggtgtgggtgttgaagagatggcaacccttggatggggagcggctcattcttgacagccactgcacaaatttcactgtgaataaaaatccctacaactattttactttggagactgtataacttgtctcgttgcaaaaggatctgagacagttcttaggagtaagtattatataaaataggacgcttggtgagagaactgagttcctctgaaggggatggaggaagcaattgacatgaatttattatgactgcttgggggcaccacaattgcttttctatttcctgaaagtaaaagcaaagtcaaaaatgatcctaataatgatagtagtttcagtagaaggaagagtattaataatgatatcagaggacattgacttagtgcatgcgcttagtgcatgccagatacaactctgaggcctttccagatgtcatccaacttaatccttatgattctacagggtggtgctgtggagtgcttggtacacactcagggcatactgtctgggtttgatccctggctctgccatttacaggcagtgacctgggatacgtcatctggctttctggkgcccccgtattctcatctgtcatagggtcattgtgagtgtaagtacatagcacagtgcctcctattaatacgcagtaaacattattaaagcttgggcttctgttattatcgttgatatttacatgaggcacggagaggtgatgtcacttacccaagatcacacagtgctgggagtgggagtcaggacctgagtctatctcatycagtcccttggctgtgctgggatcacttttctccatgctggattactrtattttcaaatcctcactaggatgtaactaatttttctgaagatgcttcttcctccatgacctaacaggaatttattgttttggttcttgttaaacacaacagagattccctgggtgatcttgtccacttctctctcccgaatcccaggcctggacacccatctccctcctagstaatccccgacccccatggctggatatcccacagatgcctcagrcttagcatgtcccagactgagttctgtctcccttcagacctcctcctttctgggttctctttctcagggaattctccccatccacccagggcacaactcaagtgtcatccctgcctcctccaccttcccaccccacatccaagggtcctcacgtcccactgatttgtctgtgactcttgactctaccatctyttctccagcgctatctgcttgtcattcttctccaggtctctaccgcagcctccttgcctccagcctaccttccccgtgactcccacaagcctttaatacattcagctctgtgcacgctgctccccctggtaatccagggttcctaccacctccaagataaaccccagcctcctgagcatggtttcaggctcagtgctcaggctgtcccctctctcttcagcccatcacccacccccgacccagcctcaggcccactgcttagaatgccactcatcccgggacttgcctggcgcccctcacctgcagattctctgcatgcaacacacactaggaccatttcctgatactcatgaccacttcctctcatctgtacccgagttggttaggtgcctctgttcccacgaccctgtcactgcagctccatagttgtacatttgtgtccttttccctgactcaactccagtagcctgaagaatagggaygaaagtatcctattcatctgtcgcaagcctggcatgatctatgtgcttaataaatgttcattgaatgaatgaatgaatgaatgaatggggtgagtgaataaataaatgaatttcaggtaatattacaagcaatgtctttaaatgcagttttacaaaaggcatyaaaatccagaccaataattagttcttggaccttttctrtaagttgtagggtagacagggcagagttcctccccattttcttgaagtggaaaccaagtcccaggagggtgatgagctctgtgactaagaagtggcaggggcaggtgtggagcccagttctttggcatgtggtctggggtctttctgtgtcttcaggaggstgtgacacyggtgtgtggtcatgtgaccatgtgcttgggtttcccaacagcaacacggaagtatatactggaaggctggagcccagcaggcactgacaagcttatcaccagacctccggctacaccagcagctkcaggtaactgtggctaygtkgtgtgagtgtgagaaacttctgcagartcccaagtcctgtgggtcctgaagcctgctcatctcagtgttgcagctgtgctcacgcgccctcaccagaagagctttcaacctcaggcttttggggagagaccccactgggccagttctaagttacagcacaaagggctggcccatgtgtctccaaccaaggtcacctgggaagaagcgtcatgactgccgtgatgggcagtgtgaccgccagccctggggcagatctccaagtcagcggatggagcttaagcctgtgcctttgccctccttcccaggactgtttctccatcagcractgcccggtgtggatggamtccagcaccacagcccagtgccgccagctggaggctgctgtgggtggtgctcaggctctcmgctgcctcacggggtcccgtgcctatgaggtaggctgaggatgcggggggtgcagggggtggtctggttgyaagctccggaggcatagtgggtgacctgcctctggggggatcacatgaggtcatggaggtgttgtrgagccagcaacaggcactctggcccctgggtcctgatccaggccacctgctgccctgtgtgttcccaggccaggctgggtgtgcacatggctgtgctcctgacatggaggtgctgtgcatgggggtgagggtaccccctcaatgagaaggcacctcctgtcattatttgtaacccggggattacaacaggacttacgttttgggtaggtttgaagctgaaagaagtcagtgcatgtaaggcacttagtgtagtgcctggcaatrttwaaaaaaaaaaaaaaaggaaaaaaaataatagtgtctctgttccacaggttcaaccttgtccccaggggtgattgtgattaggccagcttgggttacatgacctcgctggagtagaagttttggggatagggccaactctacttgggccacctgaaataacaatatgtggrtggggaaaataccccgatccctcacctggtgscttggtcagaacagtcaccgtgctgtgtgaagagcaagggttattcactcagggttgtccagtcctgatgtgggagaggccctccaggaaggcccagaagttactcacttctctatcctgtgggtgcagagccattgtttactgcctgagtatttgattactaaggacattttaaggattcaaaggccaagatcacattgttwagtagatatcaaacagatttaatgcttatttttaaaatatttaattattagaaacgaggtctcactgtgttgcccaggctggactcctgggctccagagytcctctcgcttcagcctcctgagtagctgggattacaagcgcacactactgtgcctggttggggcttacttttaaaagcttttatggtacctactcctatccagagcatgctacattaaactcactttgtggaggtaattrttcattctgtgtaggatttgggttcctaagaatttatattccttttccagcgttttacagggaaccaaattgcaaaaatttaccagcagaaccccgaggcctactcacatacrgaggytggttaaatgttcctgtttgattgaaagtcacakttgaattcttttcataatatrttagaatagatacatcttacgtgcagtgactraaaacrttgataagcagacattaacaaatgatatatttgatttgcttttttctcattgtcaggacatttccaaagaggagggraagaatggaatgtgggaaagagawgtcaggggttctcctgaccagaagggtgagggtgagggtccaggtgggagcactggggactgacgtgttcctgaggccacctgaatggaagatctgagtgtctgagcaggctgtgtctgctcactttcctatgtggttaacgcaggagggctaccaggcacatgattggcatagagtcagtrttttctttggawatgtataggactgggcatttgtgtccccagctgtggcccttcagccagagcctctgtcacaggaacccaggttcattcctggctccacagttgctgaagccagcacttgttgctgcctgagaaacagccccacgccctggctagtgattttcatcttgtgataaggaaacgatcagctcacattaaaccaaagcacctttttaatcttagaaattaacatgtggtttattatttaatgatttgaggttccagattattctgcagcattagccattaatgtaggctttgggtaraggggtgaaaaccctccctaaattctgtgtgtggaacgaagtttgcctgacagaggacaggaggtgataacattctctccacagttccaaaggcccatgattctcatgtggaagtacagacccttagggtggcattgaaaatccatcatctatttctctggctagtgctcagggtctgtggcttctgaggagccagctttcctgacgccctgaragtgtcctggttggttctgaggccacacatccacttcccttgtaaccagaaggaaatgccmaggagatagaggaaggaaatcagggcacacattccccagcatgtggattccggatggaaatgcagcttccctaagccctttctcatagggcttttggtttttgtctcttttgaacttggcagttttatggcccatcagaaactgtagaraatgaatgctctcccgaggagtctgctcatggtattccagctgctcctatctgagatgcacagtctccaccattacttgggccttttgttcaaagtttccacttccytctccaattttttttcatgctktgtgtgtgtcagaagcattcagtagcgtagggtatgtggaagtgaggcacctctcactgtttctttcctttacagagaatttctttggtcagtagctttgctgcttccctgttccttggctcttactcccctattgactacagtgatggtgagcctcggggtatggggtgggtgcctgggcagtgtgcatgtggcatgtggstgtgcaagcagtgggagccccacctaccccgagtgggtgccaatcttgtagccctgtcatctgttgccaggaaggaagtgtattcattatcttttaccacataacaaatgaccccaacacttagcagctgaagaccaccgtgtttattttctcacctagtgtctgagagtcaggaatgtgggggcagcttagcttggaggtactggttcgggatctcccacaaggtggcagtcaagctggcagccggggctgcagtcatctgaagggttgactggggctggaggatccatttccagcatcatgcacatgactacaggcaagaggcctcagttcctcacatgtggctgttagtgacactgcagagagggagggaggagacagaggccaagcagaagctgaggagtcttttataccctaatcttgaagtgatgtgccatcacttttgtctcatcttactggtcacacactaggtacggttgacccagtataatgttggggagaacctcacaaggggtgaacaccaggaggtggggatcagtaggggcgatcatggagcctggctcctgcaaggagctattaaagtttttgtttcacatttggtgaactcatgagatttgtgagcttctagaatcaaaaccccgaaaaaaataaattgcagttgatgccagtgaggagggaaagctgggaggaggttgctgcaggaacycttggatgagcctaagtgtgagaagagtgtggacagaaygggggtagagaatgcagggcaggagcccagagccrtggatatggcttcagaatggagcctgggatgctctgagcctcgtgggarttcatgggaagttttcgagggctgttgtatgccaggctttattctggtttcaggagagagagtgactaaggagtgctgttaagcttccctcacaatctggaggaggcaacagggttccctacagctagttctgtagaactcagacaggcagaacagtcaacttggagtagcctgcatgtccacccgttctgcacacctgccacagagctgataaccgcagcagctgttccggggggcattccagaggtttatgttccttagccacagctgggccctccactctgccccccttcactcacctgagatgtcacctcctcatttcacctgggcaggtgacaccatcagcatcccagcccacctctgtytgcctccaccttggcccagtggaggaggagttctctccacccatgctctgggttccctgtcctttcccatcctcaggraagccttgggagaaggaggatgttttaggaaagagctagtaggttgatctcagtgaccagaaggaagtttagaggactctgagacctttccttgaaaagttagatgagattgagaaatccctgggrgctgacctggaaacctaagggacatggagagtggttcctggtcagtgtgttgctgstagttccaggccccctgggaggtctttgagcagcagatttccaagctaactgtagtgtttgagttgatgaggaatatttggaggaggtgtggtgccgtgtgtttccaagggcccctcttrtctctggttytctggttstagaacaacacaagcatatataccttccatgaagaaagagctccaggtacaagttgtggcaagagaattatctgctctgtgccagatttgtgcattttcacaaaaggtccattttcaagattgtctgttgtttgtttccttccttcctcaggttctggaatgaatttgttgcagatacaggataaagtctggtcccaggcttgccttggtgcctgtgcacctcatttagaggagaagcttagcccaccagtaccatcatgctcagttgtggtaggtctcctttctggtgatgtggctcatttaagagctggcagctaccagggaagcactgtagcgcacacacacrcrcacacacacacacacacacacacacacactctgcacacacccttatttgttcactcacccacaggcatacmcatgcagggtcttcagtttagcctaagatgtaagtcagtgtctggatcagtgccttgcacacagtaggtgctcaggtacatgccttatggtcagcgggactttggaaaattccactagaaatttattagaatagggataaaaatggcaggtgattgcatagctaaagaaaaagtgcacagagtgctgaaattctagggactactgatgaagcttgaaggaggcasccttggggaaaatagaaataccagcggggctggcacagcacaggccctggcactggacagcatgggactgaattctggttctatcasctttgtgactttgtgtctcggtttcctcatctggaacaaggggaatgatgctattcatcttacagggctgttgtgcaaattagatgarttaatacttttaaagcacttaaaaaatartgcctggtcccacmggtwatgggaaaaacatttacccatcacagcggccccacccatttgcagtggacactggytgtgaatgccctggggtgttctacttggccagccctgttctccattgtcctgtggggacagtggagtagagagagagagaaaaagatctgggtgctgcccctggggccctttggtgggaaatgcttaccacagagccagaacaaccagaaggaactctgggtgggacagagtgctggtgtgaagaagggacaagggcaccctgaggcctggagggagtcgtgtaactgggaatcttgggccatgtggaggaggggctgctgtgaggacttcgcgttgggagtctcagccacagaagcacttttgttttcttttcagagacagagtctcaccttgtcacccaagttggagtgcagtggcatgatcatagctackgcagccaccaactcctgggctcaagtgatcctcctgcctcagcttcctgagtagctgggaccataggcttgctccaccatgcacagctaattttttttttttttgagacagagtctcgcttttgtcacccaggctggagtgcagtggcgcartctcggctcactgcaagctccgcctcctgggttcacgccattctcctgcctcagcctcccgagtagctgggactataggtgcccgccaccacgcctggctaatttttttatatttttagtagaracggggtttcaccgtgttwgccargatggtctcgatctcctgacctcgtgatctgcccgcctcggccttccaaagtgctgggattacaggcgtgagccaccgcacccggcctaatttttttttattttggtagtgacagggtctcactatgttgcttagattgggcaattctgcctcagtctcccaaagtgctggaattacaggtgtgaaccaccgtgctcggccgtttttcttgtatgattcacactgacatgctgaaaacagcctctgccaccatgaggcagaatgtcaaagccaaaccatcagcatccaaagtatgccatgaggccagtgcatggagctgaaggaacagccatgtggccctgtggaagctgacagcacagctttctgacccgctttctgacgcaggtcagaaaggcagagaaagggcagacagaaaacagccaagccaccgggactggtaatccacacacggcttttagttggatgtgaaattcagagcaggctttgtttgccttrtgcgagaacacatgcctccaagaaggagcctgtgcagacaagcagcttgaggatygggaaagaactgactctgaaaaggcattttcatttgtcacgtaggtgtcacatgtgggggaaccactcaagacccatgtttttcgtcatccctctttttgcaggtagtgctcagatagccctccctgcactctgtcttttttggattactttccttagaacattgctctctgcacgttcacgtccaattattgttaatccagtcactggggtgatagagtgagtgtgtgaggcattatctgctcccatgagtttgcttactggtgtcctgttacctttttttttttaatgctatatccagaatttggagcttataaagcaagcacaagttaggggttggtttgttctctctaycttaaatctcaagatcagcagtttttgaaatgacctcatgctcgtggtttccaaacctgcactggacttctctggcgatttgtgaacaggagggacatgcccagtttgtgacaggaagtgatgtgactccaggctctgcaaaagattccttcaggtctggtgacctggagactgtagcrttttcgtggcctgaagggtgggtggctgtgctgggcaggcgggatttacctcaacagagcacctttgctttgtccccgtccctcagggagccatttcttcctacwacgtccagcgctacggatttcctccaggatgcaaagtggtggccttcactggggacaacccaggtgagtatctcggggagtttcactctccagtgagcctgactgggtccatgctggatgtttgagaattccagtccagcctcttggtgaaaccttctgtggtcattcctcaccacccccacccatgctggatgtttgagaattccagtccagcctcttggtgaagccttctgtggtcattcctcaccactcccaccctgcgatctgactccttgtacctgccccatcttagctccgactctgccctcaggagctggtcagtctgctctctctggatgaaaactgcccaatgattatggaaggcagtcgtgcccaccccatccctaacctgtcttttctgtttcaagatgaatagctcaattcctccaacccttcctctaggacatggttttaagtctctgccctgtcatctgatctgcagcaatgacttgtttctcgtccagacacctyatctccttccctagcctcttctcttcctcctcctctcctctgggtagccctgaagccactcctggaggggcccttggatctctgaaggaaggccaggtgggctacactgaataacamcctaactactacccctcaacctcacccccaccccaggaaaagtaagtctttttctaacgatccaccagattagggttacatttaacagtaactagaaaggttaattttaaccttaatcagaaagattaatttctgtcctttcagtcttctttctgtgctcataaataagcattgtttcttttaatcaacctgggcagtatctttctcattttaacagttgtctagagctcagttgtcccagcatttatttcactggtccctgatggatggagggtggtgttgcttcagtgtttgggcagtgcagacgatgttgagattcacattcggtctcgtctctttgttgttataggwtaagttctcaaaggtgggattcctagatccaaggcttctgacacacacactgctgattgaacctcagtggcagtgtttgagtgcacctgttcctcactcccatttcacctttattcacatgttgattcactcagcatttagtgagtgcctattatgtgccaggccttccttcagtgctggggcccttcagcaatcaaggcagataaagattgctgttgtgagccatgtgtggtagtgtgcacctgtagtcttagctacttgggaggctgaggtgggaggattgcgtgatcccggagttctaggctgccgtgagctatgatcatgccactgcactccagcctgggtgacagagtgagaccccacctatatatctcttaaaaaaaaaaaagattgctgttgtgggctttgtgtctaaggcagggcacagagagtgaacataacctcacccccttcttttccattactgcctttgtctttctttgctgtatatccttggtgtcttgtcttggcctccttgattctctgcactctcggaagtgcctgacagtggagggatgtttggaccccttcagggaagagacttcacagctcaaatcagcggccctgctaacagagacttcaccccgtgacccctatgaccttctcckcttagggcctcctgagcgctcagctcccctgctcctgcctccaccctagggtgtgggtgggggttggaggtgggggctctgcgcctgcctggagagccctgtggtttgctttgtggttcccatgtggccgccagctaaccagaakctcccctcccattctcagcgtcgctggcaggcatgagactggaggaaggtgacattgcggtaaggcgacttcccacacccataggctctttctgtttccacactcacacccacactctgataagtagcagaggtgctgctgagaccsagatcccagggtcccagggtctgggtcccagcaggatctctgckacttatcagagtgtctgccggttccaaaagacagtggagggaggggatgggggcgcacatctttctcagaaagtcattgttctttgctagatgggcaggacccctgcctgcttcacagtggccagtcttagtgcatgcagtggcagagggtcagatgtggggccaaagggctgtgagcagcgcagatgaataaggaagacataacccagacattcctacttctagtgggaaagtcatatggggaaccagccatcacccaaaccattatttagatgcagttgtgggaaatcagcacagaagatccatgagatctgcatctggggagctaactcctggctcatctggtatgggagggtcagaagtggctcttagaaagtggccttgcatctgaggtctgcagcatgagtgaagtgacagggttaaggtgggtggagtacagcgcgtcgctggcagagggcagcgtgtgtgggcaaagcccaaggtgcccacctctgcctatctctcctcaggtcagcctgggcaccagtgacaccctgtttctctggctccaagagcccatgcctgccctggaaggccacatcttctgcaacccggttgactcccagcactacatggcactcctgtggtgagcttgggtgttggttggcaccattccctrggtgaggaggtgtgggcaggtctggcaccatcttgaggaccccaagtcattccactaagctctggaatgactccctccactttcccgggctctgctgggcaactgagacccccaaggactcaccagctcttgctgacagcagagctgggtggggaataacccaagaccctgtgtccttcaagcccaggttcaaattctatcctcaccagctatatcctgtgtgaccttgggcaaactctgtagtgtggcatgtctgagccacactttcctcatgagatggggagggtaagagcatttacctcacattgttactgtgacccgtctggcatgtggtggaccctcagcaaatggcgggaaggacatcctgcctcccgacggctctcatggaagggacatgctctgtgctctgaccacaggcctttggagacctgtccaaagctcctgagggaaatggtttctgagctcctaagccctaagaaccattggagaatgtggctagttaatctagccctccctgcctcattgtgcccatggtagaatgtgcagaaacccaagctccctstctctacctggggctcctctgygtcagcctcctgtgtaaacagcccaagacaagggcgtttccggcacctcccagggacattcaggggcctgaatctgaggaagagcctccgatacctaagtttcaaagcctgctgtgcactgactaggggtcgtggtccagcctgacctgcagttcctctgcctgagtctcttcactgaaactcatgggtccagtcagcaagcaccagctccctccctcagagctatgcyctcttctgcagctttaaaaatggctccctcatgagagagaagatccgcracgagtctgtatcccgttcctggagcgatttctctaaggcactgcagtccacagagatgggcaacggtggaaacctgggtaggccagttggtggtgcccaggcctgtgaagggtcagcagctgccgactggaggggcagagcctggggccccatgagctgggggagaggagggccgtggagaagtccaggggagtcctgtctgtctgcacttatattccacacatcctacaagctggtgtggaaccctgtgttctgagcaagggtggggctgtaaggctgtccttggcttctgctctgagcagaacatcaggccatagctatgtcttctgtccccaccaagcccctggtgacagcatcaragagggcagcctctaccctggtgcatccccgttcacagcctctgccccaggcacaaggaaaagtccccagtgtctgggcaggcctgagcagggagggtctgtgcctcccttggtcaaacctgttttgatattttaggattggctgggcagctgcttcctattccaggctgccaagtgagagcaggaagagttgtctttgagaaaagctagctcagggctccctggttcccttctatcctgttggagagaaggaactgagaatattcacaggtctcatctgggggatgaaagagccaggggacccagggatatggggtcattttgtcctgttctaagtctgttaagaagctgatcttttgttttttgactaatgacggctgatctcttcctggttttatttcaggtttttattttgatgtaatggagatcacccctgaaattattggacgtcataggtttaacacagaaaaccacaaggtacatgtgctgttggtgttggagttacattggctccatttgtgagtgtaaaatttaacaattgcctatcaaattatgttacttttagggacttcattcattcactcatccattaatatcatacacacttgtggtgtgccagggtgcattctagatcctggggaatctgcaggacctaagacagacacggtcctttccctcagggaggaatgcagaaaacctgagagttctcttcctatttaacaaatgctaacactatcattgtgtatcacagaacttatttccttggcgagttttatcctatacccatcaagaacccatggatcttgagatcatgaatttcctcctggttgaaagagctgctgagcccaggaggtactaacgtttattgagcccatttggtgccaggcattgtgctcatggttttctataccttcctcatttacttttcttttttttttttttttaattttttgagatggagtctcactctgttgcccaggcttgagtgcagcgggacgatctcrgctcactgcaacccccacctcgtgggttcaaacgatcctcctgcctcagcctcctgagtagctgggattatagatgcaagccaccacacctggctaatttttgtatttttagtagataggggtttctccatgttggccaggctggtctcgaactcctaacctcaagtgatacgccccctcccaaaatgctgggattacaggtttgagccaccatgcccggctatcatttacttttcaaagcaataggcactattgttcctctttctagatggagaggttgagactcagaggctcaggctaaataatctgcccagagtcaagcaaggtcatagatggtggagggggctcaaacccattcctctctggctctgaagctgctgttttctttctcctccacaatgtgacctttctcgggaaggatttagttggttcttgctcctcaaaattgacattgctgctggagagtcactggagagtcatcaccacattttgggttgtacctgagagatgtttctgaccccagtaaatggggggtttatgtaagacactctgtctggaaactgtaactgtcagagytggcgttggattcagtggcagatgatggcactacatgttggattatgaatggaaagctttgtataaagtaggaagttcatctcaatcttctgatggaggatcagtttggtttcttttgttagagtgagaagctatgcctgttctctttcatgcatatcaatcctagatttgtcaaggagaaagtagtgttcttcattcattcattcaaccagcagatatgtatgattggtgccaggcaccggggacacaaaggagaacaaaacattggtggcccttgctccccagagcctgctgtctaggagggagagggacagtagacgactgaatgagcaygtacatgaatgcagcaggtgctaaggctaggtkgcagaagaacagagtgccgcaaaggaaagcagctggtgggcgggttggagacttaccctgggtggggtgatcaagcctgggcgtctctgagaaggtggcctttaggttgagacctgaaagtactcaggatctcaccatggaaagagtaggatagactttcaggcagagggagcagcttgggaactagaagaaggtcagtaaggttagagtgtagctgtttatgagggggatggcggcaggttctagcattggtctcaggtgccagagaagcaggagtgagcctggggttgatgcccatcagtgctagcttgaaggacatgccacaggggtgggatctcagcgtaagctcgtggctctcacttatctagtatgtactgcattttccaggctctgttgtctaatctgatcattgcaacaaccctaaaaaacaggcgccactattacctctgttttgttaagaaaaagaatgatagcaagactaatgtaacttattgaagattgcagagctgaatggtagacagaacttgaactctcagctgcctgagactaagttctgtaatgtctcttgactctcttcaaagtgacatgcatgtgaggctgtgagcttgtgtgcttgagtagtgtgtttgtgtgagtgtgtgtgacaggcaaagatagtggttaaagagcccagctatgagtttcaaatctgggctgttgtttaaaaagatcacacacagacacacacatacacacacgaatggacaatgagagttccttmctctgtgcccaccttttcctggagacaggttgcagcattccctggggatgtggaggttcgagcactaattgaaggacaattcatggccaagaggattcacgcagaaggcctgggctatcgagtcagtaagtgagccactggcagcatgtgtcccggggtgggggctcagggccagctcactcgcaggggccagggctagtggggcaatatctactaaagttttcttacagggggacttgygcaggagggaggtggagcctgacctcagggatggggtgagaaagtgtcaattggcacttgtaggcaagcatagaatagcagacaggttgttcccgcttctcagctgtgtccacaatagcctgaccttttggccaggacctgtaagacttsggaatggtctttctgaaaccctaagctccaagctgcagatgagctgtcctgagctctggactgcaaagacataggcagtgcaaggtctggggacatgaatggatcttggccttctagcctggccaggtcccattgcctgtgggacacagtctgggtctttcagcttggacagggaagagggggatgtagtaccactgtcaaaactcggaagactgatgtcttagttcattttctgttgcctataacagaatacctgttcctgggtaatttataaggaaaagaaatttatttcttacagttatggaggctgagaagtccaaggttgaggggccatatctgaagagggcctgcttgctagtagggctctctgcagagtcctgaggaggtagagggcatcacatggtgagggagctgagtgtgctggctcaggtctcccttcctcttctcagaaagccaccagtcccgttcccacgataacccgttaatccattaacctgttactttgttaacccatgaatggattaatccactcataaagccctcatgacccaatctccttaaaggtcccatctttcaatatgtcatgttggagataaagcttcaacatgagttttggaggggacacatattcaaaccatagcaactggcatggagagggcagacccagggccgggggaggcaaaaggaggagaargggatttctgacaacttgagctgtagaataatcagcattaggatgtcagtgagttccccttacaggtggcgttggaatggtctaagggtctgtaaggaggttggactggccgcctatagagtccaggtttctaagatgtatttgtctctctgggctatagctgttgtcattagagaagatagtgaagctgctttgcttgagggccttcctatgatactctatggacaatccaagttctatgtaatatatattttatacctttgaatcaactgagtaaaaggatactataaaaatacctattagggaaacctcttagaaaacctgttagacagcatctgctaaagctgaatatacgcctacccagcaatctcatttctaagtaaaggcacaacaggaatttttgcatgtgtttactaaagatgtacaggagaacattcattgcagtactatgctgaatagccccacagtggaagtggcccagtgcccattaatagtagacagaaaaaatgcattgtggtgcatttgtacaacaggatactacacacaaatgaaaatgaaccagcctcagtgatmcacaatgaaatgggtgaatctcaccaaatgtaacactgagcaaaagaggccaaacatggacatacatatggcaggggtctctgtacatcaaattcaaaagcagatggcactacaggccaggcacagtggctcacacctgtaatctccacattttgggaggccgaggcaggtggattgcttgagtccaggagttcgagaccagactgggcaacatggtgtgttgcgggaagtcagggaccccaaacggagggactggctgaagccatggcagaagaatgtggattgtgaagatttcatggacatttattagttccccaaattaatacttttataatttcttacacctgtctttactgcaatctctaaacataaattgtaaagatttcatggacacttatcacttccccaatcaatacccttgtgatttcctatgcctgtctttactttaatctcttgatcctgtcagctgaggaggatatatcgcctcaggaccctgtaataattgcattaactgcacaaattgtacagcatgtgtgtttgagcaatgtgaagtrtgggcaccttgaaaaaagaacaggataacagcaattgttcagggaataagagagataaccttaaactctgactgctggtgagctgggcagaacagaaccatgtttctcttccttcaaaagcaaatgggaaaaatatcgctgaattctttttctcagcatggaacatccctgaaaaagagaatgtgcgcctgcgggtaggtctctgaactggcccccctgggcgtagcctgtctcttatggttgaggctgcagagatgaaataaactccagtctcccatagtgctcccaggcttattaggaagaggaaattcccacctaatamattttggtcagactggttgatcccaaaaccctgtctcctgataagatgttaccaatgacaatggtgcccgaaacttcattagcaattttaatttcacctcggtcctgtggtcctgtgatctcaccctgcctccacttgccttgtgatattctattatcctgttaagtacttgatgtctgtcacccacacctattcgcacactccctccccttttgaaaatccctaataaaaacttgctggtttttgtggcttgtggggcatcacggatcctaccaacgtgggatgtctcccccagacacccagctttaaaatttctctcttttgtactctgtccctttgtttctcaagccagccgatgcttaggaaaaatggaaaagaacctacgtgattatcggggcaggttccccgataatggtgaaaccccttctctacaaaaaatacgaaaattagccaggcgtggtggcacatgcctgtagtcccagctactcaggagactgaggtgggaggatcgcttaagcctaggaggttgaggctgcagtgagccatgagaccctgtctcaaaaaaaataaaaaaagcagatgaaactatttactattgttggaagtcgggataattagtagttacctttcagaaggggcctgtggggtgctgtcaatgttctgtttcatgttccatgggtgtgtttagtttttaaaaatttatgaacattataggcttatgatgtgtgcatttttcaggatgtgtgttctaggtcaatacaagattttaacatgtgtaaaatgaccaccatgagcattctgattgccctcatcccaccaccctaagtgtaaaaagacgtttcctaaaggtctgcaaagacttccaagttccctgaaaatgagactgggtgagcagggcagggttggtgctggagttggtggagtgcctggcaggggtcctccgrctgtcagaagagaaccccagggaacggaacagcccagcatacagggagaagcagttagggcaaaaggcccccatgggctcaggaggagctgatgggattgtggcattattcccagcctctaaggcatttcttgtgcaaaacagcatagagttacttatcctcttagcaagcttaaatgcagaatcagacctgtcttgccgctctgctgagtgatcacttaaatagacatacttggaaccaacagaggttgcrcgcaygtgaggactcattctccaggctgctgtgtggactggccagctctttcgttcttgcccagacatcatctcatttggctttaatagtgtctaagggcaataaagaggcactttgaataaaaatgattattgtgatactaacagctgccagcatttgttgggcactgagtgtgtgcccggcccagttccttagcaattaatctttattaacaacagtaccgctgaagtaggtactgatatgattcccacttcacaaccgaggaaaccaaatcttgcagtggttaaataacttggtcagggctggcagagctgggatctgaaccaagcsagtctggctccagatgctggattctcaaccactggctgaacctgctttttttaaggaacaatcgccctcttgatgtttatagacaccatcagacatgatagaaaccagctgggcagggctaataagccatagttttcagtttatatttcagtgtgtttcatgttgtttaggttgattgtaaaaacagtcaaatcttgtaataacaagtttgaaaaataaagaaaatgggcctggtgctcacacctgtaatcccagcactttgggaggtggaggcgggaggatcacttgagcccaggagtttgagactggcaacagagagaccatatcttcacaaataataataattataaatatcccagtatagtggcatgtgcttgtggtcccagctactgggggtggggtggcaggggtggcaggaggccggggggatcgctggagcctgggaggtcaaggctgcaatgagctgtgattgcaccacttcactctagcctgggcgacagagcgagaccatgtctcaaaaaaataaaggaaaatgactcataatcccatcycctctctccaaccactggtatcatttagggacattttctcccagtctcctttatgagcttatttccatacagccatagttttgttcctttgtaccttatatgcaaagggtgtatacaagaaccaaagtttgtcagaagtcatmtttgtggtgctgcgtatgatggccaggttacttttcctgcatttgggcactgagggtgttcttgttttytttgtttgtttgttttctttgttttgttttgttttgtttttctggagacagggtttcactcctgttgcccagactggagtgcagtggtgtgatcttggctcactacaacctccgcctcccgggttcaagtgatcctcctgcctcagtctcctaagtaactgggactacaggtgcacaccaccacgcccagctagttttgtatttttagtagagacggggtttcaccgtgttggccaagctggtctcgaacttctgacctcaaatgatccacctgcctcggcctcccaaagtgctgggattgcaagtgtgagccaccgtgcctggccattgttcttggttttccaacgtggaatcacactagagcatcttccatagcttgaattatttccccaggaggatggcagtccttctctcttcccagacactgtcttcacggccagcgatgaagatgggagaagctgagaggtgggggctgaatgtcttcttctggacagagccaaggggctggatggaaagcagcaggtcttaaaaacaactatttgttttaaaatacataacgaatggatgtctttttatcacaaaagaktcatgcaaaacagaaatatggaataagaagcaaatgcccccttcatwtgcctcccagactcctttccagactgtgacttccttcctgtgagtttctgtgttagattgaatcatacggaattgccaatattgaagaagttttgatttacaaaaatggcaatttcatatggttcgacctgacacgtgtgtgtgtgtatatatttaacagaaatgctattacattctatgtgttattctgagacttgctttccataacagtatgtacaggtctacctttttgttttctaatgactggcatgaggtctgataaattattttatagccctagttgaaggacattaagattatttcttgttttgttttgtttttgtttttgttcttgttttgagacagagtctcactctgtcacccaggctggagtgcagtggtacaatctcagctcactgcaaccttcgcctcccgggttcaagcgattcttgcacctcagccacctgagtagctgggattacaggtgcgcgccataccacctggctaatttttgtatttttgtagagacggggtttcgccatgttgcctaggctggtctcaaactcttgacctcacgtgatccactcatcttggcctccaaagtgctgggattgtaacctccactttcaccatctcattctatgccctatacccttgtccctagttcattcttgtttgtgtattttttttcccttgagcatgttagctaaaggttggtatattttattaagcaatgttaatattttgttttgtgctcccttttattaatttctaattttatctttttaaatgctttccttctactttatgaattttttctttttctgtatttttaagttgaaattttagctcatttattcctatcctgtattaacttctaatttatgcatttcagaatgctacatgttaactttatttacataacatatctttcatttctaaaaagatagtaattttcatctttttctgcatcagtgagtggtccttcaaactggcccctcgtccttttgacatatcttccatcattccttgagcatttccatagcttctagtataaaaaaagtttcaggctcatcttgttttttccttggatcagccttgtaatcttccatttatccaaggggccctgacttctctgagtgggagagatgtttggatgctctctctggatgctcattgctactgggatgatgctgttcccagcccctttcagtgggctgagctgggaatatgtaaggatatataacaacccctttcagtgggctgagctgggaaatattaggatatatatatacatatccaaatatatatatgtctgtatcaatacacacgttacctttctatttgtctgtctgtctacttctccatgtgttgaaaaacatgagttcaaccctatacactctacttccagtccaacaccatggggttcattctggctttcttccttcccatatttgtatcttatcctaacagtgacaaagttgattcttctgacccctccagattgctgcctccttgacatgcaagccccattttggcttctctgcttacccttacctgtgttgtctctgtgtcgtctctccagcagcctcttgaatctgccccactctggttatgtacttacatgtggcccttgagccacttctgtttgcctatttaatggctttttagagaaggaagaagaaaaaagaaaggtaggaaggtagacaggcaataaatatttttaaagggaagggtccatttacatttaatgtaattattgaaatgattggatttaattgaatctatccatttattttttatttttttaatccatccatttacaaaatggattacatatcaatttttctttttcttttcttttgttctatatgttcttttttctttcttattcttttcctgtcttatttttggattaactgagcaatgtctagtattccattttatctcctctgttggctttttaaggtatacactttttaattgatttttaaattgaaatccttaatttgaaaagtctggtttgcactaatattatacacttgaattttttacgaacatgcttgcactacaagaatgactaaaggatgtcttccgggctaaagggaaaatcataccagatggaaagtcagagcttcaggaaggaatgtagaacatctataaaaagtggattctcttaagttttactttgtctgaaaatgtatttattttacttcatattaaaataatgttttctgctgtggaattctaggttggcactttttactttcagcactctgaaaatgtcatttcattgttttcttgacttctaatgtttcagataagaaattaactgtcattcttaatgttattctcctgaatgtaatggggttttcttctctggctgatttaagatttttctattaatctttgattttcagcagtttgattatgatatacctaagtaagggttttttaattattattttgtatgtatcccctttgtgattcactgagcttcttggatctgtgggttaatgtcttccatcaattttggaaaattcttagccattatttcttcaaatatttatttttccctattccctctttcctttcctctggacttcagttacacatctgctgttgtcccataggactttgattttctattcttttttttttttctctctctccctgcttcagttggacaagttcattttttgttttgttttgttatgttttgtttttttgagacagagtcttgctctgttgcccaggctggagtgcagtggcatgatctcggctcactccaacctccacctgctgggctcaagcgcttctcctgcctcagcctcctgagttgctgggactacaggcaagcgccaccacatctggctaattttttgtrtttttagtagagatggggtttcaccatgttaggcaggctggtcttgaactcctgacctcaggtgatccgcctgcctcagcctcccaaagtgctgggattacaggcatgagtcactgtgcccggacttcagatggacaatttctatcacacctctttttattcatgtttctgctgtagacagtctgctattaagtccatctaacaaattcattttggatattatattttttctatttctagaatttccatttcattctcttatactttcttatgtctctgctgaaatttttcatattttaaccattttgtccatctcttcctctgactttatatcatctttataattattataaagctcctatctgctaattcatctcagagtctgcttttatttactattttactgccatttcctgcttcttaaaatgctatttaattttgtttgaatgctgtacgttgtgtttaaaagtacggtgttgactaaagtggctaatttttaaaccttttacttttgagataattgtagattcacatgcagttgttaaataaatagctaatgtttacctgcagaaaaggcttgcccttctatcaggaagtgcgggtgaggtggtggtttttttttgttttkttttttttttttttttacttttatcatttaatttttatttttaaaaatgtatatagtaaaaaagctgggttgcggagatgtcggtcagtggattaaaaattttggttagggtacaggaacatattcaagagatttattgtacaacatggtgatgatagtttataacagtgtattgtattcgtcaaaattgccaagagattttaggtgttctcaccacaaaagataagtatgtgaagtaatgcataagttaattagctcaatttagtcattccacaatatatacatatttcaaaacatgttgtataggataaatatgtgcaatttttattgtcaatttaaataagtaacaaaataagtaaaaaaaagtctagaagcctatataacagcatactaacagtgtaactctggtgtaactagggttggtttttactttcttcattttgtcttttctaattttttgtatagtaacttttatcactgggcttaacaggaatctaaaaaatgtatttttagcaattgttatgttatatccacaacatgatctatatattttgtcagggaggtttattttttgactcagaactagtttgttcttgaaatatgtactttattcttttaattagggcttaaaatgttaaaatatttctaaagaggactattttgggactctacagtgtacctctttaatgagaacrcccacagtttaggcctattaaggcatamttcctttattttactaaagaattaaaataataaagatttgataattttctttcttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatkctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccatcgtcatcatggcccgttctcaatgagctgttgggtacacctcccagatggggtggtggccgggcagaggggctcctcacttcccagaaggggcggccgggcagaggcaccccccacctccctcccrgacggggcggctggccgggtttttttttgtttaatcaggggttggatcagtactagttagttttagttcaccagtagttgcagtgtcttgggatcaggatcagcaggatcaggcccctccctccatcaagtctttgggacctaaccactgagattacagagctctttctctgttttccagctcttcccccacttccacatcactgcttccatagtagttcactggagacatttggtgggtagggaggactagctctatattggagactcttccagatttcagtcctccataccagcccaaatgtagttgtttttcttttctagcaaattttatctgcctgtagagtcttacttcttcatgtctcccatgctgcaggtatgaatcagcacttaagggctcatctcattctggaatttattttatttagacttcttgaatttacaattttttgatagcttcaagcaaaaatatgatgctctggttgttgttgtttattccattctgtcattgttacagcacaaatgtgttctttcttgaccatcatcatcttagctggaagtggaactatatgtcttttattagattaaggtttattattattttactatttatttttatttatttattctaaaatggagtttcacttgctctgtggcccaggctggagtgcaatggtgcattctcggctcactgcaacctctgcctcctgggtttaagcaattctcctacctcagcctcctgagtagctgggattacaggtgcccaccaccacacctggctaagttttgtatttttagtagagacggggtttcaccatattggccaggctggtctcgaactcctgacctcaggtggtcttcctgcctcggcctcccaaactgttgggattacaggtatgagccactgtgcccagcctattatatttttttggagacaaagtctggctttgtcaggcaggaatacacccaggctggagtacagtggtgtgatcacrgctcattgcagccttgaattcctgggctcaagcaatcctcccacttcaacctccygagtagctgggaccacaggcatgcatcaccgtttccagctaatttttgtattttttgtagggacagaatctttgttgtccaggttggtctcaaattcctgagctcaagcaatcctcctcctgccttggcctactgaagtgctaggattagtaggcataakccactatgctcagtcagtttattgtgaaaaatatcatgtatacagtagagtatatgtatcttacagcaagttataaaacatattaatcaaacatctgatgatcagcactcgggttaagaaatagaacatcagccaggcacagtcacttacacctgtaatcccagcactttgggaggccgatacaggcggatcgcttgaggtcaggagttcaagaccagcttggccaacatggtgaaaccccgtctctactgaaaacacaaaattagccaggcatggtggcggacgcttatagcctactcaggaggctgaggcgggagaatcacttgaacccaggaggcggaggttgcagtgagccaagatcaccccattgcactccagcctgggagacagagcgagacttcatctcaaaaacaacaacaacaacaacmacaacaaaaagaagaaatagaacactagaaccttggagtcttgctgtgctcctcttccactgtatcctcatcttcccctcatccctgcagagatcatttctatccagatttttgtattataatttccctggaattctttatggttttgccagctgtgtatgcattcctttaaatacattgtggctttttgccctttctgaacttcatgatacatggaattatactacatgcggtgtgatttgctgctttagatcaacgtcatgtttatgaattcatccatgttaatgtgcatagatagctattagctgttaattttcattgtactgtgatattccatcacatgattatacaaccatttatccatttgctatgrcctgactgtgtctccccaaattcacatgttaaaaacttaatccccaatgtgacagtgttgggagatgggcctgatggaaggtgtttaggtcatgagggctcttgtgtattaatgccactataaaagtgctttcaggagtgagttcaccattttctgcttttcagccatgtgaggacatagcattctggggattctgctaaacattctacaatatacgggacgatccctcacaaaaagaattatccaacccaaaataagcagggttttattctggttggaagaggaatcaagcttttttctgtgatgagtagagctactttccatgtttgtctccatgcctgctgtgggagctcagtgtcatttcaagttcctcttcactcagtccccccatgcaccctccccagctagtagcccactttcactaatgagcacttctttactttagcttggggacaaacactgctgctgcttctgctgctgagtgtaagggagtggagggaagggtcttgagacccctgctgtcatgaagtcagttgtgtactctcagcagcagtttatgagggttcttattttcccatatccccaccaacacttaacagcaacaacctttaaatctgttgccagtctgatgggtgcaaactggtatctcagtgttagtttaatttgtgttttcttaattaacgatgattttgttttgttttgttttgagatggagtttcgctctttttgcccaggctggagtgcaatggcgcgatctcggctcactgcaacctccacctcccggttcaagtgattctcctgcctcagcctcctgaataactgggattacaggcgcacaccaccatgcccagctaattttgtatttttagtagagatgggatttcaccatgttggccaggctgatctcaaactcctgacctcaggtgatacacccgtctcggtctcccaaagtgctgggattacaggcgtgagccaccgtgcctggccaattaataatgattttgaacagctctttgtaactctggtttctttctctgaattggctatgtacattctttcccatttttctatttgatttcctatctttctcttattgatttgtaggattttattgtatactttgaatattaggtttttgacagttttttgtgttgcagatatctctcatttatctgttgcttatttatagtgtcagcaatttaacagaattttgatgaaattcatcaatttttcatcttccattttatgcttttgagatattgtttaagagatttccccccactccagtatcacagaagtactgttttatgtttctcctgttgatgttacaattttaccttccacatttaggactttgatccatctgaagtctttgcgaatgatgtaacttgggatccaatttgattttttccacatgttgatccagttttccaaacactatttactaagtggtctgttttaccccattacttgtagtgccccctttatcatttatccagtccctatatatacatgggtctttctctgtactccctttcattttttttttcctttttttggagacagggtctcactttgccgcacaggctggagtgcagcggcgcgatctcagctcactgcaacctccacctcctgggttcctcccacctcagcatcccgagtagctaggactacagacaacgtgctaccatgcctggctaatttttaaatagtttttatagaaacagggtcttgccatttttcccaggctggtctcaaagtcctgggctcaagcaatctacctgccttggcctcccaaagtgctgggattacaggcatgaaccatggcacctgacctgcactcctgtttctacttcatgggtttattggtcttgttcttggggcagaaaaactgttgtattattgtggctttgtagtatgtcwgtattagttggctagggctgccataagaatgtgccacagaatgggtggcttaagcaacagaaatttattttctcacagttctggaggctaaaagtctgcgatcaaggtgtcggcagggttaatttcttcttaggcctctttccttagcttgtagatggtcaccttcttcctgtgtctccacatggtctcctcctgtgtgtccctgtgtcttcatttkctcttctcataaggacatcagtcatactggattagggcccacccctaatgactttatttttaacttaattacctctttaaagaggtaatatctgtctttatcttcaaatacactcacattctgagawactggggtttaggacttccacatataaatttagggtagacacacttcagcccataataatgttttaatatgtagkatagcaattatcccctccttgcttttctttttaaratmttgtctgagctgtttataggtcttcatttttccacaaatattttataagaaattggtctagttccttaaaagagtccagctggaatttttatttaggttgaataggatgtatacattaattggaaaagattgacatatttataatgttaattcatattcattcaagaccatggaatatcttttaatttatttagatattcttttttgtactttaacaacaatttcaactttttcttaatagagacttttgaattctttgttaaggtattcccttacatgtaagtctaccttacatttctggttgctgttgtgaaagttaatttatatattttctattgtatttgatagttgattattattagaaatgccattgattattataagttgattttgtatctggcaaacttattaaactcttgttagttttattagtttgtttattctttattttttccaaatagatggactattgtctgcaaatgacagttttcttttcctttatttcaatacttatatattttagttgtttttgttatcttatggcattgactggtagatctaatactgtgttaaacagtggactggatactgtgaatctttgttttgtttgtagttgtattagttatctattgccatgtaacaaattatctcaaaatttagcagcttaaaacagtaataaatgtttattctcttayacagtttctttgggtcaagaatttggtttcagcatggttgggtgattctgattgaggatatctcctgaggttgcagtcacaatgtcatctggggctgcagtcatctgaaggcttgactgacgctggaggatctgcctccaggctggctcactcatgtggctgttggcaagaggcctcagtctcctgccatgtagacctctccctagggctgcttgagtgtcttcaggatgtggcacttagctttccccaaagtgagtgatccaagagagcatgatctgtgtcagagcgagatggaagcctcaatgtcttttatcatctagtcttggacttcatacttcatcatttacacaaggttctattgggtatacaagtcggccctattgaatgtgaggggggactacttgaaggtgtgaatatcaggagggagggattatgtggaggccattttggaatctggctgacacaccagtctgaaagaaagtgcttctaaatctctgttaagaatgacatttgttataagttgtggatatatgacttttatcatttaaggaagttcccttctcctgttttgttgagatatttaaaacaaaaaaagtattaaagacagttaaggtgggtggggcagcaaccttacaagcaaatgaatgtgacaggcctgcacacacagagccagctttggatctctcccgtagtcctgtgtgataagtgggaggcattggcccatcatgagccctctgtagctgaagaactctgcaaaaacagccctttctgccttgggagaactggcatagctattttacttttttcttttcccttgcagtgtccaagacaaagattttggccacaggaggagcatctcacaatagagaaatcttacaggtaagcgttagtagtgggccttacaccatggcctctcccatatctgttatgtctaagagccagagactggataggaaggacagcctccattcccactcctgcagraatggggagctcttagctcacactccaggaagcagctctgttgccttacagctcacactgtgagtgggatctgtctcacatgcaggtgaattctatggctgtgtacaatccactctctgataccagcactgtcctctggagtcacatggaaagtgcctgttcttccacatggcaaaccttctcacatctagtgccagtgttcttgtcttcctcaaggcctctgccttccaatgtaaccatcgctgattctccaaccagtcctcttataacacagttgccagactgttactgtccttctggtccttcattatrccagaaacatatgaccaaaagtagaatcaacctgcagatgtctgacactcaractgtcacctgtggggctgtcagagcctgttatggagacattgtgcatttttgggtgtagcctggggctgccttaactgttagagtaactgtattagctgtttgcttgtgactacctatcttaggtaagatttttctagaaacagagcctgaaatgggaattcttctataagcagtttgttgagagagtactcccaggaagaaggaagtgagggactcagggcagtgcagaggaagaaggataagtgaggatatggtcttgtctggagtctacttcagctccatcctggtggggaggtggggctctggaacrtgaattataccacagagctgattttaccttgggacaagggggccaacaggccaccctggggaggttaaatctcctgtgagcggtggccyatgctcagccaaggtcagctttcttgaggaggtagtgctgcaarccattagtagccagtactcacagcagctggggcaggatgcacaatggtccagtgagggggatctgggtcggcatcagtggcatctactacaatatctctggtcaactaagacctcccccaagttctttccatgtgaactcctcttagtacaggtcctccatttgaaatgtatgcaatttatttgtgaacctaaatgggaaacttcaccattatscccatgaaacatgctcttgttagcttgggtttgtttgggcttgttaatgttagtctaatacccagctgtctccagccctaggtcagtgccatttgctaaacatacttcctaaatcttctgccttgtctttggtgaaatggctaaaaagtacagggacagcctggggagctgtggctctccactacggacytcccccagctcatcctgactctattatcaccagggtagcatgaccaagcatactcctcttaaggcagtcgaggtggaatggaagrggtcagaagacatatgagggagagagcctggaaagtgcatcccacaatgtctgtgttccctctgaggaatggctcaccacagtagaacctctgtgtccttttcaggtgcttgcagatgtgtttgatgccccggtgtatgttatagacactgccaactysgcctgtgtgggttctgcataccgagcttttcatggtaggttgatggagggagacagctatctctggaagtggccaggacatggrgtgggctgaggagggtggaaaggggagagtgaggtgtacccagtctttggggacattggagtcttggggacttcagcttcatttttctagctcccagcaggtgagaaccaacccatactctctgttcctttattctttgcttaaagtggagaaaaagaggctgggtcctaactgaatgakgtctggtcagagttaaggtcagcacagggacatgggaaaagaacacagggcatggttgagagcacgtgggcatgagtctggacagctagagggcaggagaggtggacaaagtccagagccgtcttttcagcaagaacagaagttgaaacaaaggggaaggcttcaggcccaagcagtccaggaccctggacagcaccatggagccctgttgccctgttggaggcctcgctaaaactctgggtattaagggaagctccccgatctaggcgagttctggcaggagcagcacctacctgcaagggcagtccttcaagttggatcaatttgctctgtctcctgcttgctcagggagctcctgtagcagcccaggtggttctattcttttcatattcttaacatttaacatacctatttcagcttatatttttcttttctttttttttttttttgagacggagtcttgctctgtcaccaggttggagtgcagtggtgcaatcttggttcaatgcaagctctgcctcccgggttcacaccattctcctgcctcagcctcccgagtaggtgggactacaggtgcctgccaccatgcccagctaattttttgtatttttagtagaggaggggtttcactgtgttagccaggatggtctcgatctcctgactttgtgatctgcccaccttggcctcccaaagtactgggattacaggcgtgagccaccgcgcccggcctaagcttatgttttctatcaacgttgagaattaatcaggcaacatatccttctctcaataattaaccttggccgggtgtggtgctcatgcctgtaattccagcattttgggaggccgaggcgggtggatcacaaggtcaggagttcgagaccagcctggacaatatggtgaaaccccatctctactaaaaatacaaaaattagctgggcatagtggcacacacctgtagtcccagctactcgggaggctgaggcaggagaatcgcttgaacccgggaggcagaggttgcagtgagccgagattgcgccattgcactccagcctgggtgacaaagtgagattccatctcaaaaaacaaaaaaaaataattaacctcttactcatttattctctccccaccccatctacctcaccctgcctcatgccatatcctatatcaagatcacttgggaatttatttccagattcttatattaagtacatttaatattatattggcttttattcacacttacctatgagtctgcctgcctgcctgcctgcctgcctgcctgcctgccttccttccttccttcctctgtttgttactttgtctttttttttttttaacttcctgacatttcggtcgggtgcagtagctcacgcctgtaatcccagcactttgggaggccaaggtaggcggattatgaggtcaggagatcgagatcatcctggcctagagggtgaaaccccgtctctactaaaatacaaaaaaaaaaagaaaatagctgggcatggtggcgcgcgcctgtagtcccagctactcgggaggctgaggcaggggaatagcttgaacttgggaggcggaggttgcagtgagctgttgcagtgagccgagatcgcaccactgcactccagcctggcaacagagcaagactccatctcaaaacaaaaaacaaaaaaaaacaaacttcttcttctttctcctttatttctatgctgaggttttgttttgttttgtttaagacaaggtctctgttgtccagcctggagtgcagtggcgtagtcatggctcactgcagcctcgacctcctagactcaggtgatcttcccacccccacctcagcctcccggatagctgggactacaggcacacaccaccacacctggctaatttttgtagatatagggtttcgccatgttgcccaggctgaactcgaactcctgggctcaagtgatcccacccacttcaccctcccaaagtactaggattacaggcatgaatcctagtgctaggattaccgcacccaggctgtatggtagttttgttggaatatacaacctaaataaatattttaagagagaaattcaataggtgatggttttgaggcctgacatgtccaacaaggcctttgtttcatcctcccaaatactggctgggtaaaagactctatgttcaaaatacttttcctgagaactgtgaagatactcttccataatcttctggccttcagggttgctgatgagaagtatggggtctgcttcataattcttttrtggaagtgggaaaggagtttccctttagggacttcactgccatcctgcactgtgttttgttttattctttttccctttctgtgcttgccaaagggtacctgggccactgccctgctctgccctccaaaaccaaagcccgagccaaatcttagctcaccagtccctacccagagggatactaaccacttcatttggagatatcttctccccatctgggtctggggatgactgtcttgtgtagccagtctgcgagtatgagtggagatggaaccagagtcttttgattagtttctytgctgtccaccccaccaccattccagtccctcatccattctgctctgagctgggattttctagcatttggttaggaaaactggtcctcacatcttcagagggcmcttcttcactcctggtggtggtggtgtttgtatatctgacgctactacctaccttccctagaaattgctcattgtttcttgcccaccaatggcaaccttccccctgctactcatttgcttggtgagtaattattgagtgccccctgtatgccagatggtgtgctaggcaccatggttatagtggtgacccggagagacacagtatctggcctcgtggactttacagctcagcaaaagagggatcttaaaccaataatcactgaaatatatgggcacaagttgggaaaagtgctctgaggaaaagcagatggtgytgagcgctaaggagggcctcctgagcaagtgatgktyttaggtgcatcttagctgaggagaagggaacaggcatgtgaagagtggaaagaacattccatacagtgaaaaggctctgaggcagaatgagtggagagaagaccaggctgtccagaatgtggtgaacgaggggagagaggaggggcaggcagacccttccccatcatatgtcgaggttacccgacctattccatgaaaggcacaaccacaaagagaaagacaagctgggtcctgctggagacaagcctgcacttgccatttttttgttttgttttgtaattttattgaggtacaatctatatgacataaaaatcatccattttaagtgtccaattcattgatttttcataaatgtactgaattgtgcaaccatcactataatccagttttagaacagtttgccaccccagtgagatccttcgtggtgtttttggttaacgtcttcacttgcaacatgcactaatgtgaagtgacctttcccttctaggtcttgcaggtggaacagatrtgcccttttcagaggttgtgaagttagctccaaatcccagactagctgctaccccaagcccgggagcttctcaggtgagagaccatcrgaatttgtttgtarcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatgsggtgaggcagctctttatagctaaagcagtctccaaagtgggctgtcagctgagggctctctgccaacagcactcccatcagttgggagaataagttcttcattcccgaggtgaatctggatggcacaccayagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtrgttcaacatgagaactctggtcatsttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaattwgaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgtctcaaaaaaaaaaaaaaaaaagttactaatatgatattttacatttccttttttgcatgaagcttttgaaatttggtgtgcatttaacacttatagttctgggcatgcttcaagtatgcaaaggtatacatggcttgcagctactgtattggataktgcagctctggatgtgctccacatggtgacaggacagctatagctgccccaaacatcatgtcttcacagctgtattcgaaggcagggatcagaaggtgacattgggcagagagtctctcctcacacacctcttgctcatcagggagaaaaatactggcctatccctcccctatcccacacacgcccaacaggctaccacttggtcatatggtcaattctggttgtaggaaagkctagggtagggtctggctctttcattctatctagaaggaggccagcaaggaggaagataaytggggaaagttttagggcagcacagcagcgtctgcctcatctagagtacggagtggccaatcctctgagctgtatgtgcctcatcactctccctggcctgcccatggccgaaatcactgacaactcatggaaccctttaccattggatccaaatgtaacctcaaaagcccacccaacagcaggttgcaagcagtgacagtctatatgattgtcagcgtatgtgacttatatgcagactgaatttgtggactagagttaaacttcttgagagcagggccacatccttcattctctctgtggcacctacagcactgcttgtgctcaaggggaaactcaaagcagtaagaatgttttctcccttagctcagctgaacgttgcagtttctccatgaggagaaatcaaagccccttagctttgttctctgactccttaatgtccaatacaggctaggacaaccttaggcccctcgcctgtgggcctctttataaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggcygaggcggatggatcacatgaggtcaggagttagagaccagcctggccaacatggtgaaaccccatctctactaaaaaagaaaaaaacacaaaaattagctgggtgtggtggtgcacacctgtagtcccagctacttgagaggttcaggcacgagaatcacttgaaaccaggaggtggaagcttcagttaatcaagattgcaccactgcacctccagcctgggtaacagagtgagamcctgtctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgtgtgcttgcctgaagtgcatctgcatttctcaggtaagatggacagccacagggaaaactgcttagggggataaaagaagagtaagaatgtggggttgtgtttctttttggtcttttttctctgttgggctttttgtttatttattttggcttataatgcagcacattgtatatataattttgtagcttctttaaaatttctacattacaaaataaatatttcattcttaaaaatgtatgtgcataccatttttaatgactgtataatattctatctgrgtagaccaggcacggtggctcatacctataatcccagcactttgggaggctgaggcgggaggatcacttgaggccaggagctggagaccagcctgggcaaacatgagacctcatctctttaaaaaaaaaaaaaaaaaaaaaaagctggcagccaagatggccaaataggaacagctcsggtctacagctcccagcatgagcaacgcagaagaygggtgatttctgcattttccatctgaggtactgggttcatctcactagggagtgccagacagtgggcacaggacagtgggtgcagygcaccgtgcgcaagccgaagcagggcgaggcattgcctcactcgagaagtgcaaggggtcagggagttccctttcctagtcaaagaaaggggtgacagatggcacctggaaaatcgggtcactctcaccctaatactgcgcttttccgacaggcttaaaaaacggcgcaccaggagattatatcccgcacmtggctcagagggtcctacgcccacggagtcttgctgattgctagcacagcagtctgagatcaaactgcaaggcggcagccaggctgggggaggggcgcctgccattgcccaggcttgcttaggtaaacaaagcagccaggaggctcgaactgggtggagcccaccacagctcaaggaggcctgcctgcctctgtaggctccacctctgggggcagggcacagacaaacaaaaagacagcagtaacctctgcagtgttaaatatccctgtctgacagctttgaagagagcagtggttctcccagcacacctctggagatctgagaatgggcagactgcctcctcaagtggktccctgacccctgacccccgagcagcctacctgggaggcaccccccagtaggggcagattgacagcccacacggccgggtactcctctgagacaaaacttccagagaaatgatcagacagcagcattcgtggttcacgaaaatctgctgttctgcagccaccactgctgatacccaggcaaacagggtctggagtggaccgctagcaaactccaacagacctgcagctgagggtcctgtctgttagaaggaaaactaacaaacagaaagacatccgcaccaaaaacccatctgtacatcaccatcatcagagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactatgtgaagaatgcagaagcytcaggagccgatgcgatcagctggaagaaagggtatcagtgatggaagatgaaatgaatgaaatgaagtgagaagggaagtttagagaaaaaagaataaaaagaaacaagcaaagcctccaggaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcactaaacatggaaaggaacaacctgtaccagccactgcaaaatcatgccaaattgtaaagaccatcgaggctaggaagaaactgcatcaactaacaagcaaaataaccagctaacatcataatgacaggatcaaattcacacataacaatatcaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaaacaaatggaaaacaaaaaaaggcaggggttgcaatcctagtctctgataaaacagactttaaaccaacaaagatcaaaagagacaaagaaggccattacataatggtaaagggatcagttcaacaagaagagctaactrtcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatacccagaaattgaactcagctctgcaccaagcggacctaatagacatctacagaactctccaccccaaatcaacagaatatacatttttttcagcaccacaccacacctattccaaaattgaccacatacttggaagtaaagctctcctcagcaaacgtaaaagaacrgaaattataacaaactgtctctcagaccacagtgcaatcaaactagaactcaggattaagaaactcactcaaaaccrctcagctgcatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatacagacacaaaaaaacccttcaaaaaattaatgaattcaggagctggttttttgaaaggatcaacaaaattgatagaccactagcaagactaataaagaagaaaagagagaagaatcaaatagacgcaataaaaaaaataaaggggatatcaccaccgagcccacagaaatacaaactaccatcagagaatactgcaaacacctctacgcaaataaactagaaaatctagaagaaatggataaattcctcgacacatacaccctcccaagactaaaccaggaagaagttgaatctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcagcatcctgataccaaagccgggcagagacagaaacaaaraagagaattttagaccaatatccttgatgagcattgatgcaaaaaccctcaataaaatactggcaaaccaaatccagcagcacatccaaaagcttatccaccatgatcaagtgggcctcatccctgagatgcaaggctggttcaatatatgcaaatcaataaatgtaatccaacatataaacagaaccaaagacaaaaaccacatgattatctcaatagatgcagaaaaggcctttgacaaaattcaacaatgcttcatgctaaaaactctcaataaattaggtattgatgggacatatctcaaaataataagagctatctatgacaaacccacagccaatatcatactgaatgggcaaaaactagaagcattccccttgaaaactggcacaagacagggatgccctctctcaccactcctattcaacrtagtgttggaagttctggccagggcaattaggcaggagaaggaaataaagggtactcagttaggaaaagaggaagtcaaattgtccctgtttgcagatgacatgattgtatatctagaaaaccccattttctcagcacaaaatctcctaaagctgataagcaacttcagcaaagtctcaggatacaaaatcaatgtacaaaaatcacaagcattcttatacaccaagaagagacagagagccaaatcatgagtgaactcccattcacaattgcttcaaagagaataaaatacttaggaatccaacttacaagggacatgaaggacctcttcaaggagaactacaaaccactgctcaatgaaataaaagaggttacaaacaaatggaagaacattccatgctcatggataggaggaatcaatatcacgaaaatggccatactgcccaaggtaatttatagattcaatgccatccccatcaagctaccaatgactttcttcacagaattggaaaatrctactttaaagttcatatggaaccaaaaaagagcccgcatcgccaagtcaatcctaagccaaaagaacaaagctggaggcatcatgctacctgacttcaaactatactacaaggctacagtaatcaaaacagcatggtactggtaccaaaacagagatatagatcaatggaacagaacagagccctcagaaataatgctgcatatctacaactatctgatctttgacaaacctgagaaaaacaagaaatggggaaaggattccctatttaataaatggtgctgggaaaactggctagccatgtgtagaaagctgaaactggatcccttccttacaccttatacaaaaatcaattcaagatggattaaagacttaaatgttagacctaaaaccataaaaaccctagaggaaaacctaggcattaccattcaggacakaggcatgggcaaggacttcatgtctaaaacaccaaaagcaatggcaacagaagccaaaattgacaaatgggatctaattaaactaaagagcttctgcacagcaaacgaaactaccatcagagcgaacaggtaacctacaaaatgggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacayatgaaaaaatgctcaycatcactggccatcagagaaatgcaaatcaaaaccacaatgagataccatctcacaccagttagaatggcaatcattaaaaagtcaggaaacaacaggtgctggagaggatgtggagaaataggaacacttttacackgttggtgggactgtaaactagttcaaccattgtggaagtcagtgtggtgattcctcaaggatctagaactagaaataccatttgacccagccatcccattactaggtatatacccaaaggactataaatcatgctgctataaagacacatgcagacatatgtttattgcggcactattcacaatagcaaagacttggaaccaacccaaatgtctacaatgatagactagattaagaaaatgtggcacatatacaccatggaatactatgcagccataaaaaaggatgatttcatgtcctttgtagggacatggatgaaattggaaatcatcattctctgtaaactatcgcaaggacaaaaaaccaaacaccacatgttctcactcataggtgggaattgaacaatgagaacacatggacacaggaaggggaacatcacactctggggactgttgtggggttgggggagaggggagggatagcattaggagatatacctgatgctaaatgacgagttaatgagtgcagcacaccagcatggcacatgtatacatatgtaactaacctgcacattgtgcacatgtaccctaaaacttaaagtataaaaaaaaaaatctggcaaattttttgccagaactgcaatttactcgaacattttccttgccttagtacagttgcttttagtttttcaattataattaagtcttcttagataaaggatttaaaaaaaaaaaaaaccctttcctattctacatgagaatttgacctttggttaactttctagctctgttttccttgagatctcataaaagtggactatcaacggttttactaggcaacattgcttatgtaaaaatggcctttgcttgggaaactgcatctgaactgagaaaaccataactacctggtgagaagtcttcctcagggcctccttgagtgcagtgactcctcctggtcctgcctcctacctamtaagttgttacaggagatacttttgtagggcatatgaggttttgaagccagggtcattcttttgtctgtatgatgtggatctcaactcttttttttttttttcttttttttgagacagagtcttgctctgtcacccaggctggagtgcagtggtgcaatcttggctcactgcaacccccggctcccaggttcaagtgattctcctacctcagcctctcgagtagttgggattacaggcacctgccaccacacccagctaatttttgtatttttagtagagacggggtttcaccaggttggtcaggctggtctcaaactcctggcctcaggtgatccacccgccttggcctcccaaagtgctgggattgcaggcatgagctaccatgcccggccagatctcaactgtttgtgcctgggctgtaacctggttgggaggcaaagagaccctctcctggacagctgtgtgaactgctgtatggactgctacatggtcttccattgagaggagcacctcctgccactgtgtttctccaggctgtcttcccttggctcatggtggtcttataagtctgaatgtttagtggtatcaaagaagacccttggtggacttggcatcctacatttaggattatttccttaggagagcttcaccaaagtagaataactgggtcccatactatgggctccttaatacagatataaagtcaagtctatttcccaaagagttgtatcaccagctttcaccagctgtgcaatgaggcagccatttctaggtactctcaccagaatttttttgaaattttgtagatttgatcataaaaattggtttcttgtcataatttacagttttaaaaaatcttaaactgtaggtttgagaactgctagcatttcctcttttgtgaattgatgctttctttcgcccagaaaaaaagttaaattgcaagtaaacgggatttaaaaattttaaattgcaaagtgcaaccagatgtaagaggcattttccccctctgttctaaactgctttttctgcccttctaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccrcaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctyactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatackcatgttctcacccagagtgacaaaatcctgcagataggtttaagacctagtggmtcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccraagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttggaaaacaaaagaaaaccttaaactttatcttgaaagggtctatcttgttacttagaatattgaatcagaatgattagctctgagacatagcctaccaactatactttgaagccaaagaaaaagaactatgtaagcctctaggccaaaagacctagtctcttacaaaggaaagacctggttggcctcaaacttctcaataaagcaagatagcaatggggcaaccttttcaagaaactcaaagtatgaactgaggatttcatatttcaccaagctgtcctttaagtatcaaggatataggaagaagttttaattacacaagagcccagggactattatactcacaacttcttccttagaattctactaaaagacaagcttcatccaactagatgattggggaaacttgagcaaaaggactggacatgaccattgaatatctttgtagatctgaggccaaatggaagtggggataagggtggaagaaccgtattagtcccttctcacactggtataaagatagtacccagctgggaatggtggctcatgtctgtaatcccagcactttgggaggctgaggcaggaagatcacctgaggtcaggagctcgagaccagactggccaacatggtgaaaccccgtctttactaaaaatacaaaaattagctgggtatggtggtgcacgcctgtaatcccagctacttgggaggctgaggcacgagaattgcttgaacccgggggcagagattgcagtgagccgagattgtgccacttcactccagcctgggcaacagtgagactctgtctcaaaaaaataataaagatagtacccaagactgggtaatttataaagaaaagaggtttaattgactcacagttccacatggctggggaggcctcaggaaacctacaatcgtggcaggaggtgaaggggaagaaaggaccttcttcacatggtggcaagaaagagagagcatggacgcacaagagagcaagcagggaaaactgtcttataaaaccatcagatctcgtgagaactctctatcatgagaacagcttgggggaaaccacccccatgatccagtcacctctcaccaggtctcgccctcaacacctggggattacaattcaagatgagatttgggtggggacagaaagcctaatcacatgaaatagtatcaaactatatatgctttgacaagacagaagtaacaaaacaaaaaagaagggagagaggaagaggaaaatacaaagaactccttgttgcttaggcaatatgtagaagtcaaatagtattatttaaagttgacaaaccaagtatatgaagtgtaagtaaggaaaaagggagatttagagcattaaaggtgtactatactattaatagtatagaatacatagtataattactagaataaaaatgtaaatcatcaatgctcaaagaagcaataataaagattacagtgaaaaacatgcagtaaatgtaccatcatacagtaaatatattaagtccaagcatataagttaaatcagtacatgtgaaaggacttacctattaaaaggaatatcagattggcttacaaaccaatgtcttattgtctgttatttataagagacacatctaaagtaagtgattcaggagaggctaaaaaaaaagagatgggcaaaaatagaccagacaagtaggaccacaaaaggcaaagattacagtatccatatctgaaaaggtagaattcaggaaaaaatagacaagacaatgaaggatacattaaaatgctaaaagccacaattcacaaggaggatatactatttatgagtgttagagcttcagttatctggtttgtcaactttaagtgatattctttggctcctgcctatcccctgtacaacaaagagctctttctactttcctctttctctctccctcctttttcattgtttccgttgtgttacttctgccttgtcaaagcacataacatttgcataacaaattatgcaaggaaaaatgaatagaaacctagaaataacagagaaatttaaaacacctctctctcatccaagactgaagttaagaagacaaaaaatacatataacgatataagtgatctgagtaacagtatctataaagtagatctaatgaatatatgttgaactttctaccttgataatagagaatattactctagggcaagcgtgatggcccacacctgtaatcccagcactttgggaggctgaggcaggtggatcgcttgagctcagaagttcaagaccagcttgggcaacatggtgaaaccccatctctacaaaaattagccaggcatggtggcaggagcctgtagtccctagaaatttatgactcttctaggaatcaagattgttgtcccacagcagcctcacacacctggcatagcagtgattaaactcattgggagctatctcaaaaataattgtgagtgaggcttttggtacatagagtagactccaatcagacacataaagcccacagtacattttaggaagctatactaatggcattaacctggattaaaagggactaaatgttaaaagaccctggacccccaactttctatgggcaacaagcaggcatagttgctcaaaagacagtttctagcccaggcatagtagctcatgcctgtaatcgcagcactttgagaggccaaggcgggcggatcatgaagtcaggagttcaagaccagcctggtcaaaatagtgaaaccccatctctactaaaaatacaaaaattagctgggcatggtggtgcatgcctgtagtcccagctacttgggaggctgaggcaggagaatcgcttgaacccgggaggttgaggttgcagcgagctgagatctcgccactgcactccagcttgggyaacagagtgagacttcatctcaaaaaaaaaaaaaaaaaagtatatatatcaggccgggcgtggtgtctcatgtctgtaatcctagaactttaggaaaccgaggtgggtggatcacctgaggtcaggagttcaagatcagcctggccaacatggtgaaaccccgtctctactaataatacaaaaaaaattaggcaggcgtggtagcagacgcctgtaatcccagctactcaggaggctgagacaggagaatcacttgaacctgggaggtggaagttgcagtaagctgagatggcagcactgtactccagcctgggtgacagagcaagactctgtctcaaaaaaaaaaaaaaagatatatatatatgtatgtatgtatctatgtatcagaaaaaaacgcaagtacactttaagcatattttaaaatgcttactgacaaaaatcaaagagtttgataaaattctgtgttaccatggctgtggagaaataggcattcgtatacatttctggtaggagtgcaattttgtgaaactcctaaagggggaaattgggcaacatcaacaaaactaaatatgagtatgacttaaccattccaataggaatctgcacaaagacacaattccaacatacaagacaacatatgtataaggttattgtgaaattattgataacagcgaagtacttgggaaaaggcacatatacattaatataggacagattgaatagattataatgcatccacacaataaaaaagaatgaggaagatctctatgtaccaatgatgggtaaattccataaacaaaggacagttctctacttagttctttttattccacttaacaaagttttatagtttttagtgtatgtcttacacatattttgttaaattatttgatatttcaaaaatgttttgtgataaaatgtgtgacatttatcactttaaccatgttttgtgataaaatgtatgacatttatcattttaaccatggaaaagtgttcattttttcaattgtttttgctagcatttaggaatattccatggtatgttgaattattcattgtgaacatattaagatcaaattcagtagcattaggtatattaccaatattatgctaccatcaccaccacacatttccaaaacctttttatcattctagactgaaactctactcactaaacaataactcctatttttctctccccagcccttgataaccgctatcctttctgtctctatggatttgcctattctaggtttttcatataagtggtatcatacatgtttcctcttgtttctggcttattccacttcgtgtgatattttattaaattttgcatgtgtaaaatagttaatattttaatgttttaaatttaaaggttcattcacattgtagcaaggctgaataatattccgctgtgtttatataccacatcctgtttatccattcatccatcagtggacatttaagttgttttcaccttttggtgattgtaaataatgctgctatgaacattgatgtacaaatatctgagtccgtgctttcaattttttgggtatatacctagaagtggaattgctgaatcatatagtaattctgtttaactttttgaggacccaccacagttttccacagtagctgcaccattttacattccccagcagtaatgcacagggatctagtttctctacatccttgtcaacacttgttatttttctttatatttatatatatatatatatatatatatatatatatatatatatatatatatatataaaatagccatcgttatggatgtgaagtgaaatttcattgtggtttttatttgtgttttcctaatgactagtgatgttaagcacttttcatgttcttatttgccgtttgtacacatttaattgttttgatgctgttggaaaagtgtttcattttttcaattgtttttgctagcatgtagagatagtctatggtatatggaattatttgttgctaacatataaaaatcattttttttttagatggagtcttgctctgtcgccaggctggaatgcagtggcaccatctcggctcactgcaatctctgcctcctgggttcaagcaattctcctgccttagcctcccgagtaactgggattacaggcacccccaaccatgcccagctaatttttgtatttttagtagagacgggatttcaccatgttggccaggatggtctcaatcccccaaccttgtgatccacccgcctcagcctcccaaagtgctggaattaacaggcgtgagccaccacgcccagccataagaatcaatttttgtttgattttgtgtcttgcaactttattaaattcacttactagttatggtagtattttgtattagtaggatatgtagggtttctatccatcatgtcatgtcatctataaaaacaaagacagttttcttctcttcaatctgtaagcattttatttcattttcttgcctttctgcaatggctagaatgtctagtatagtgttgaatagaagcagggagagcaataatccttgccttgttcctgatcttagcggacagcattttatcactaagagtgtgtgtgtgaatacgccctccatcgggctaagaaatttccctttcatttcttgctggaggtggggaggaatatttaaaaagaatgtgtaggtttgtcttgaattttgttaaatgttttgcatgtatgtgttatggttttggtattatgtgttccttaaatatttgattgaattcaccagtgaaaccatcttagttagatgttttctttgtggaacttttaagtgaaaactcaatttacataaaaatatatggcccttcagattttgtacttctttttgtgtcagtgttaataatacgtatctttcaaagaatatcccccttttttttttggtagagatagggttttgccatgttgttggtagcaagccctaaccctgtcataaacaggccttaaataaactggccataaacaggatttctgcagcaatgggacatgctcatgatggctgtcatgcacactgcgaaaagttgttggtttactggagcagggcaaggaacacctggccccgcccggagcaaaaaactgctcaaaccacaa

SEQ ID NO: 12427 - DNA, 15593 bp, Homo sapiens
ggcaggttttaaactcttgacctcatgttccacccgccacggcctcccaaagtgctgtgattaccggtgtgagccactgcgcccggccttttttttttcttttcttttcttttttttgatacagagtcttagtcacccagactagaggtcagtggcaggatctcagctcactgcaacctctgcctcctgggctcaagagaccagcccacctccgcctccaagtagctgggactacaggcgtgcgccaccatgcccggctacttcttgtattttttgtagagacggatcgtcaccatatttcttaggctggcctttaacttctgagctcaagagatgcactcccctcagcctcccaaagtgctgggattacaggcggccaggcctattttcaattttcaagtattgcatatcattgtgaataacattgtaaatcctttttatattaagtaacaggtagttaatccatttctaatgaataattttaaggttttaatcctttccaagtgtacaataatttactgattattatttcttattctagaaaactgactttgatttttctcttaggttgttttgttttgttttgttttttgagacgatgtttcactcttgtcgcccaggctggtgtgcaatggcgtgatctcggctcactgcagtctctgcctcccgggttctcctgcctcagcctcccgagtagctgggattacaggtgcaccaccacacccagctaattttgcatttttagtagagacggggtttcaccatgttggtcaggctggtctctaactcttgatatcagtgatccgcccgcctcagcctcccaaaaagctgggattacaggcgtgagccaccgtgcccaggctcccctagtatttttcactgtctgcatcctatgatcctaaccacctgtgtattgtagtttcttcatgggagaagtcatatctgcccttccaaccttattctaacattctatttattcatttaaaaagccacatcatctagttctaaatcacagcatttaaagagaaacatttcattattaatgtgctcatggtaaattaaatattattttgtgatcaatattatacttcaatactaactttgtgcttgtattattttcttaaatatactacacttacttggctaatatttttaatgcttttgtgtgtgtatatatatatatatgagagagagagagatcatggcttataatccaaacaaaatgtaataaactgcatgaaaataaataggaatattaaaacattttgataattttgggatgaggatattggtggactgttggaaagatattcacttttccttttattttgtaaatttatttcattattttcaaatgtaaaaatcaagatgaactaaaggttgaaagaaaaacaaggcctgcctcagtggcttggctgggtgggttagatcacacctgtaatctcagcactttggaaggctgaggcgggcgggtcacctgaggttgggagttcaagaccagcctggccaacacagtgaaaccccatctacactaaaaaatacaagaagtagctgggtgtggtggtgcgtgcctataatcccagctactcaggaggctgagacaggagaatcacttgaacccaggaggcagaggttgcagtgagccaagatcttgccactgcactccagcctgggtgacagagcgatactccgtctcaaaaaaaaaaaaaaaaaaaaaaaaaagaaagaaagaaaagaaaagaacagaacaatattttctttaatttccagtctccttctattgagtggcttcttctagaattacctcaatacttctaaatgatatgtttttgctgttaaatcttgctactccattttacattttaatcacttcttgctatgtattttttaaaaaagatttaactttcttttcaactaatgtaaaccaatataagcactgcacattccctttctcctattctcccaataaaattgttacagttttttttttctttttgacagagtcttactctgtcgcccaggttggagtacagtggtgtgatctcagctcactgtaacctctgcttcccaggttcaagtgattctcctgcctcagcctcctgaatagctgggattacaggcacccaccaccacacctggctagttttgtagctttagtagagatggggtttcaccatgttggccaggctcgtcttgaactcctgaccccagctgatcctcctgcctcagcctcccaaagtgttgagattacaggcgtgagccacagtgcccagcctacagttttttttaagttaaactaatagtgtccatattgctaagctttcttcaaaatacacattagtgtagtgtgattaaatttcctttcttgagaaacatttttcctagaactgaaaattgttttgtacttacataattttccatttactaatattagtttctttacattctctaatttgaatctctttcttctcaaaatattcaaatatatcagatacctgtcaattatgtttatttcttggtgatcttgcacccagatctctacttcattcatactggttgctctataggctgtcaccctaggactttaaaaaatatttttctttgttggtccttttttataagatccagtacattcttctttcttagtttactcacttattttgttgatgcacatctctcagtaccttcataaaaatggatacagaggaaataaaactttttgagagcttgctttgttattttctttttttttatttgattgatagtttgggcataacattctaggttgaaaataattttccctcagatttcaaaagcactgctccttttattgactgcatatagaattgctgttcagaagactgattccattctgattcctatgtctttttatgtgattccccccctttttttctttctttctgtgagcattgaaaaaaattcccctggtcttctgaaaataccttagtactggctctttattgattaatctggttatatcgctatgccctgttcatgtttaactttttttttttttttaagatgatgtctcactgtgttacccaggctggagtgcagtggctattcacaggcacaatcacagcaccctgcaagctctaactcgagagctacttctgcctcagccttccaagttgctgggactacaggcatgtgctagaccccttggctaatgttcagactatcaattttatttctgagaaattttggttgggcatggtgactcacacctgcaatcccagtactttgggaagctgaggcaggattatttgaggccccgagtttgagaccaccctgggcaacatagtgggaacctatctctacacaaaaacaatttgttaaaaggaatttccttggtatgttttactcataatttctcctctgagttttctggattctcacttcaatgaaaatctcagttaaatattagacctcctagattgactctataagactataagccatttttcctttcttattttctctttgcctctcattccattttttggacaatttatttaatcactcaatgttttatgtataagtttttctttatgactgaaaaatatttacttttaagagttgtttttggttctctgaatgtttttcatggcatcctgtcatagatttataaatgtaatattttctctcatttataattaatcttttctttaaaaatgcattaggcagtatcattattatatatccattttaaaagtgaaagtgagtctaaggggagttaagaacttgtccaaggtaatatagctagtaaaaagcactgaagtcctaatctagtcttcatcttacaataggaatatgtacttcatatagttactatttagattaagtggataaatacatacttcatacagctactatttagattaaatggataaatgcattatgaggcacttagaacaatgagtagcatagagtaaatactaaataagtattagcttttattagattttctttctctgggaatattaaccagacattttcaaaggctttcttctgctttctatattattgttccttttttttttcttgatggtagcgatggtggtagttttggtctttctatgttatgttgcaggcatttcctcaaatgccttggctatcttctcgtattttagaaggatgatatatcaaaatgctgacaatcaactctgtgagcgaacagtacctgttgatggcagggcttcattctaatataaccatgctaggataagtctattaccttatgagatgccaaatattaatatgtgtcttcatttgggctttcatattctccaggttagaattctacaatatacactatggggatagactaggggtcaggcatacactttgtgtcctacagtctaagagtattgcatgaaaagggattagaagtctcaccatgcaaaatgcaaaggtttgcttactctccctattttcagtttgacacctcacacttgtgctcagctgtgcctagatccccaagactagagaaagtcccattaaatttctccagagaataaactttctattttctggctgtgagttatgtttccatctatgtagggtgatgagaagaacagagaattcaattatcctctacacatacttccaactaataacttttttccatccttaactgacttcagtcttcttaaacatctggttcctccagatcttgcgcttaaaagagattatgtttcttgtgagtatcttcaatgcaggaactttactttaggggcactttttggaactgctaagttaattgctcttccacctgctttctgtcatagaaaaatgtatgtgttcacttgtgtattcttaatctttgttagttcctaccattttaattacttttctgccattttagtgcatatttttttttaaaaagagaggttaattgtgtgtgctcaattcatctacttttcaagttttacccttctgtaccaattactatttcaaccatgtatccagcttacatttttaagaatattaattgaatttaacattttaaaatgcagacttgttggattcttctcccatccattcttagtgcactttaagactttctatagtgaatatcactgatgagcccttagcatctgttgcaaacagtctccctcattttgtaccaatgaggtactttggctaggactgaaaccttcccaagcttaagaggtggtcccagacaggattaaaacacagtaatggccagagacaggtctttagattctaggactaaaatctccaactataattctatacctcttgaaacaatgattgcttcagtggcagacacatgatcttacttggtctaattagagtgaaagttaggtttttgttctatgtttagggatagactcttactttctcttcctgggctgaaagagaaaacagatagctacagttgtggctacaataaattttgggaacctaaggcaagtcagctttaggaataagagtctgctttaaattaaactaacttgctcatgcttgtgtacttatgaatttttttgtaaattatgaaaaactggaactaaatgatgggtttacataacatgttccaccccaatctcttgcttcattttctgcctgttcacaattcattgctattaaggaaatctacagaagtgcctttttatgctgttgtgttgacctatatatgcctcatctcatggttaatccagtttcataacttcagaaaggatttctgagatgacctttcctttaccttatcacgtaaggaaagccaagtagtaatagaatttcattcagcttaacaatcacttataccctgcttgtttcaggcttacaattgtctcagaaacactatgaattcctgggagccagggatcacatcttgtatctgtgtttaccacaactgaacacatttggttgtgagaagagtggggaaagacactgaataaatgctttaaaacaaaatcatcatcacaaactataaagaatataaaacgattattatggaagataaaatatatttttaattacttcaacagaaggaattatttaaacgcaatatttatttgcttctggaggacatttatgtaaataaaatttaggtagtgttcatcaaactgtgaaaatctgtggagacgcgtggtggcgctgcaggataatatcaagaaaaaaattaccctggaggatgttgtagaccctgttatccagtacacgcggagaactgggaagacagaaagaacaatcctttaagggagaacctagaagccattcaacaaggttaaaatcttyaggcttccgaggatttggtagacagatcagaggcacgtttcccacaactgcgaagaggcgctgaggcaattctgcaagaagattttggggttttggaaaagaagctatggaaaacggaggggcaggcactctgcagataaggcaagtcctgcttttctttgttttgctgggaatgtctcaggcgggctctgaaactgggaactttttggtgatggaggaattgcagagcgggagctttgtaggaaatttggcaaagaccctgggactcgaggtgagtgagctgtcttcgcggggggctcgggtggtttctaatgataacaaagagtgtttgcagctggacacaaacactggggatttgctcctgagagaaatgctagacagggaggagctctgtggctccaatgagccttgtgtgctgtatttccaagtgttaatgaaaaaccccacgcagtttttacaaattgagctccaggtcagggatataaatgatcactctcccgtcttcttggaaaaagaaatgctcttagaaatcccagagaacagtcctgttggtgctgtgttcttgcttgaaagtgcaaaggatttagatgtaggaatcaatgctgtaaaaagctacacaataaatccgaactctcatttccacgttaaaataagagtcaatccagacartaggaaataccctgagttagttctggacaaggcgctggattatgaagagcgcccggagctcagtttcatcctcactgctctggatggcgggtcccctcccaggtctggaactgccttggtcagggtggtggttgtagatattaatgacaactcccctgagtttgagcagrctttttatgaggtgaagattctggagaatagcatccttggctccctggttgtgaccgtctcagcctgggatttagactctggaacaarcagtgaactatcctataccttttcccatgcctcagaagatattcgcaagacatttgaaattaatcaaaagtctggtgacattactttaacagcacctttggattttgaagcaaytgagtcatactcaataatcattcaagccacagatgggggaggactttttggaaaatctacagtcagaattcaggtgatggatgtaaacgacaacgctcctgaaatcactgtgtcatcaattaccagtccaatcccagaaaacactccagagactgtrgttatggttttcaggatacgagacagagactctggggacaacggaaagatggtttgttctatcccggaggacatcccattcgtgctaaaatcttcggtaaataattactacactttggaaacagagagaccgctggacagagagagcagagccgagtacaacatcaycatcaccgtcaccgacttggggacccccaggctaaaaaccgagcacaacataaccgtgctggtctccgacgtcaatgacaacgcccccgccttcacccaaacttcctacgccctgttcgtccgcgagaacaacagccccgccctgcacatcggcagcatcagcgccacagacagagactcgggcaccaacgcccaggtcaactactcgctgctgccgtcccaggacccgcacctgcccctcgcctccctggtctccatcaacgcggacaacggccacctgtttgccctcaggtcgctggactacgaggccctgcaggggttccagttccgcgtgggcgccacagaccacggctccccggctttgagcagcgaggcgctggtgcgcgtgctggtgctggacgccaacgacaactcgcccttcgtgctgtacccgctgcagaacggctccgcgccctgcaccgagctggtgccctgggcggccgagccgggctacctggtgaccaaggtggtggcggtggacggygactcgggccagaacgcctggctgtcgtaccagctgctcaaggccacggagcccgggctattcggygtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccggcccaggcccaggccgactcgctcactgtctacctggtggtggcgttggcctcagtgtcgtcgctcttcctcttctcggtgctcctgttcgtggcggtgcggctgtgcaggaggagcagggcggccccggtcggtcgctgctcggtgcctgagggcccctttccaggacatctggtggacgtgagtggcaccgggaccctgtcccagagctaccactatgaggtgtgtgtgactggaggctccaggtcaaatragttcaaatttctgaaaccaattatccccaacttcctaccccagagcacaggtagtgaagtcgaagaaaatcccccatttcagaataatttgggtttctgataaagaatgaaaaataaaacctgtgtttatgaatacatttataattaggaacttatcgtgaggtgcctgtaaagtagtatttttgatcacttcaaatacatactcttcaagtcaagaaataaatttctttacatagaaaaggatacagatttagtaccaagaacacttcacaaagcaggaaatgtgcatgtgtaatggtttatgtcaaacaattatgcttaatataaagtctattaagtggtaagtcttgtttgagatattttaaattgctttccattgttttcaatatttactgtgacttttgttttctgagttgattagaatgctgttcgagtatacctaccctagtttcagaagcatagattgtagtgtacctttttaaactttatttttttaaaaaaagttgttttatgaatcatacactattttcacacttttaatctcagaagaaacatatgtgacatggtattttagtaatgaccaaatagacggtcttagagattcagtaagttcactaaggtccactaactaataagtgacaaaactgagcatccatcctagatctgcctgactctaagtcagtgactttgctcccattccatactgtttttgtcattggatatcacctggcaagtttctgcctaactaaagagaagaaaagtttttatcgtattcatactactgttcaatctttatttagaaataaactttatctatgatttcattttcttataaaccagtaatcttgcttttctgggtaaattttcagctattattactaatgctctgatctgcccaaatcttaagtaaaaaacaaaattgaaagagcaacctgtgccttctcattgtctcctgaacatataactatcatttcacagaaaagattaatggtcctgattaggaatagtacataattttgatggcattattagttaattattttctttacattgtagtatatttccagagtcacccatgcttacatttgtaatatattttcctgatttgagagtttgtttttagcagtttttcttacctatactgcactgctgaatcaggaaaatttaagaaaaagaatagatttaaatgtgtaatatcaaagagaaatatagatgatcattaaatttttagaaattttggggagttaaggagaagcattgtttgttaaaaatatataaccgattcttatatttaaaataggtaatttttgcatagttgtgttctaaatatattataaactagtgccagtaactctaataaagctagtattactgcatatcactggtgggatagaatctaaggacaaaaactcacagtagtaaaatctaaaattgctttcatggtctcagggtaaaattatccaatttctctgacaaataaatggctcaaaaaataagaggagtgaagtttacacaaggaaaaatcttaagaggtctaccactcaaatacaatgtgtggatcttttttggatcttgattgaaacaacagcaatgactttgaaaaacttggaagaatttgaatatagatgggtattaaataatgttaacttgatttttaggtatgataatggcattgtacttaagcatatttttagagtcatttaaagtcatgatgcttttaaagaaatgtataatgacgtatttgtgggagaaaattcagtttgtctgggatgtgaaaatgttgaagggatagagtcaagaattatggcaaaacattgataatagttgaagctagtactgagtccttggaggatcattatactcctctcttttatgagatttgaaaaatttcaaaataatgtcttttaattgatgctgttagaagtggaggtaataaaaaaggacatccttcccagaaacaaaatcaccactgctgttacagatattgtctctatttagacaaactctccagcctttccttgttcatttcctttcattattggacataacctctctacctgagatagtcatgctcctgtattcttctaccatttgaatttcgaggtgtttatctagttatagtaatggatttatgctagacttatgatggatttatgccatcaagactcagttacttgatggcatcaaattgctttatacttggtatataccttatttttaaggttaatatctatttgcattagattcctcatgtttaaggtggggaattcacaacagccctatgtggtaggtactgttcttatcctcactttacagaggagcaaactaaagcagagagattaaataatttgttcgaggttcacagctactaattattcctatggttcatggaaataaaactataaagatctaaatgttgtccatgataactacaattatatttgaaattctttttgccaagctagactattacctaaatatttcctttttgcccaaaactcagttatcattgttgaaagactaatgtgatttctcctttgggcagttgtctgctcactaaagtccggcgatattaacggtggtgttgtaaccttacatagtctcggggtgcatacaggcagagttgggaatattacatccattatcattccacaaaatgtaagatcctgtgaggacgcgtggtggcgctgcaggataagaaggcacaaaccagaaccgcagctgcagctccattaaccggcaaaaagcagcagaacctggaagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagcccyaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatrgaagtcctggatgtcaacgataatgcccctgaatttgagcagcctttctatagrgtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttytctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatcsgcagcgtcagcgctacagacagagactcaggcaccaacgcccaggtcacctactcgctgctgccgccccaggaccckcacctgcccctcacatccctggtctccatcaacgcggacaacggccacctgttcgccctcaggtctctggactacgaggccctgcagggkttccagttccgcgtgggcgcttcagaccacggctccccggcgctgagcagcgaggcgctggtgcgcgtggtggtgctggacgccaacgacaactcgcccttygtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctgrtcaaggacaatggcgagcctccgcgctcggccaccgccacgctgcacgtgctcctggtggacggcttctcccagccctacctgcctctccckgaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtgaccatagttgacttttacattccataggtattttattttgtggcatttccatgccaatgtttatttccccyaatttgtgtgtatgtaatattgtacggatttactcttgatttttctcatgttctttctccctttgttttaaagtgaacatttacctttattcctggttcttaaaaggtgacaattcattctttaacccagatggtcttaatttgtaattaatttgcctccctaaagagcaataccaaatcacatttttttcatgcccctatctttagctgaacttcacccactattatgcttatggtaaaattaaatagagcaatttggaagtgattccaattttccagcatttcttcatttgattctctttttttagtcttaaaataatgactcctattcagacatatcatttttcttttttgtaaatccagtgcgtttttagttaacctttaaatatgctttttgctttcaaaaataaaccagaaaacctatatcctatgatacaactctaagtgttatcacttgattcgaaagggtcagaagaccagttttttagtatcctttcctcattcatcctggagaggattgtgcaggcacattaatattgtgrccaatcacagaatctgggaatatgaagctataattttttaattaatgtcacaaagctctagtgcaatctagttgaatgcagatgcctgtgcccaaataataattcatatagcataaattggagttgtgtgttaatgtgtaaaaatttttgcctgtactatcatataatttaatgtatatacaccagaaactatttttcaaactttttttactgcaaccaatagttaagattatattttacatattttgaaacacacaagcttaatagaaataaatgcttgtgaacaatgcttagtctttttatgacataatttgaaattacctatatatttcattctattcaattttcaaatgtggtcatgatccactaaatttatttcatggtatactagtgggtagtaacccaaagtttgaaaaccacttttctcagacatataaaagcataccagatgttgaacattgatagtatcaaaagatagtcccttagggttctaattttaaaaaaattttcaaagcattgtaggggagtagctttgtctcatgttaaatcactcttacctttaaggatctgacacactatgtaagaaaaagacttcaaggttggaggaggagattttccatgacttttatcaaagtctacagtctatgttgtgggagaaaaatgtagaataacaaaatgagtaaaagtatagaggcaaaacaagcatgtgtatgagagagagagagaaagcatggaaaagaggaaattcatggggatgagcaaaatgactacttccagtgccacagactagactcagttgcttctcttatgttattttttgagacaaggtcctgttctgtcacccaggctggagtgcagtggtgtgatctccactcactgtgatctccactcactgcaacctccacctcctgggctcaagtgatcctcccacctcagcctccctagtacccaggactacaggcccaggccaccacacc

SEQ ID NO: 12428 - DNA, 15577 bp, Homo sapiens
agaactttcttagtctaagccttctttccgaagcatgctaggactgagatcactcccttccaggttctgaaatttattttttccagtttgaaaaaaaaaaaaagcttggatttgtgagggaagtgaagatttatttattcttgccctgtctctatgggtgcaatgaagagcctttcgaaacgccaataagacttcggtacactgagagacactacttgaaaatactcaatttcgattgccatcagcctgaaagaaagcactgggattttcttaaagtttaggagaaaataaatactcggaagagacgcggggtggcgctgcagccttagaagtagcagaaacaaagcacccagccgacgctcccttacccagatactcagctaaagaagcagcaagcaggaagaggaggctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaaggcaagtcctgatattctttgttttgctgggcatagctcaggctagttgccagcctaggcactattcagtggccgaggaaacggagagtggctcctttgtggccaatttgttaaaagacctggggctggagataggagaacttgctgtgaggggggccagggtcgtttccaaaggaaaaaaaatgcatttgcagttcgataggcagaccggggatttgttgttaaatgagaaattggaccgggaggagctgtgcggccccacagagccctgtgtcctacctttccaggtgttactagaaaatcccttgcagttttttcaggcggagctacggattagggacrtaaatgatcattccccagttttcctagacaaagaaatacttttgaaaattccagaaagtatcactcctggaactactttcttaatagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacattcgcaaaacgtttcgattaagtgcaaaatcgggagaactgcttttaagacagaaactggatttcgaatccatccagacatacacagtaaatattcaggcgacagatggtgggggcctatctggaacttgtgtggtatttgtccaagtgatggatttgaatgacaatcctccggaactaactatgtcgacacttatcaatcagatcccagaaaacttgcaggacaccctcattgctgtattcagcgtttcagatcctgactccggagacaacggaaggatggtgtgctccatccaagatgatcttccttttttcttgaaaccttctgttgagaacttttacactctggtgataagcacggccctggaccgggagaccagatccgaatacaacatcaccatcaccgtcaccgacttcgggacacccaggctgaaaaccgagcacaacataacmgtgctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggacccgcacctgcccctcgcctccctggtctccatcaacgcggacaacggccacctgttcgctctccagtcgctggactacgaggccctgcaggcgttcgagttccgcgtgggcgccgcagaccgcggctccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagsgagcgcgacgckgccaagcagaggctggtggtgctggtcaaggacaatggcgagcctccgcgctcggccaccgccacgctgcacgtgctcctggtggacggcttctcccagccctacctgctkctcccggaggcggcaccggcccaggcccaggccgacttgctcaccgtctacctggtggtggcgttggcctcggtgtcttcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggagrmtccgggacaaatgagttcaagttcctgaagccaattatccccaacttcgttgctcagggtgcagagagggttagcgaggcaaatcccagtttcaggaagagctttgaattcasttaagtgttaataaggatctactgagsctagtctcgtttaatttgtggaaagtccttttttactgctttgcccattggaggtgtctccttttattagaaagtaaccatcttattccaattctatgcatgttactggtatttataaatgtatgagtttttttgcggtataataaatgtaaattttctttgtattctaattgttggttagtttcattgcaatttaattgcatttaaagtgtaaaagtaaattttgtattttcagaaatctttaagttagagcatcttttccagacctcacagtctatggtcctagataattttgaagtcctacatttgaaaatatttgttatcattacatgagttatattttccagcccagaatatttgtgttttttatatcctcttaggctagtgtaaattctatcctgtgaattcacattggctaaccctttaaataggtatatttatgaataatatagcaagcaccgtccttacgtttttcaatatatgtaatttttttttttttttgagatggagttttgcacttgttgctcaggctgtagtggagtgcaatggcgcaatctcggctcgccgcaacctctgcctcccgggttcaagcgattctcctgcctcagcctcccaagtagctgggattacaggcatgcatcattatgcccggctaattttgtatttttagtagagacagggtgtctccatgttggtcaggttggtcttgaactcctgaccttaggtgatctgcccacctcagcctcccaaagtgctgggattacaggcgtgagccaccgccccccagtccaatatgtatacttctttcaagtgttgacatatgaaaagtattagtctttagagattgtaagaattttaactgttggattctacaaggcactaacatcataagtgctctaataaatttttgtcaaaagtcaatcattaatattcaaaaatgtagataaataatacatgtctagcaattttcaaaggcatgctaattcatcatgctttctctttcaaatagtttttttaagagccctctgcttattccagtccccccctttaaaatcttttaaaattattaataacctattaactttgagcacttcattaaaatccaaaaaatttgagggagtacatgtctttgtcctttacctttagaaccctcaaacatagcttggtattgctgtttttaaaattttctggagcatttaggattcacttagaaacaagcctttagggagaaaaatttatctagcaccactcactctatttttttgcactgactacttctatttttccccctttcatttccctagacttttcaatgcttttttataaaggtgcttgagttctgtttctcaacagctccctcatttattgaatgattcacacagtcactggaatattataggctcttaataaaatttttgaatgattgaaagagagaaaagtattttacctgtgatatattgatatttaaataaactagaacacttaaaggaaaacattttgctggaatcaaatactctttggtgtacaatgaattataattttgttattaattgaattggttaccattgtttgaacatgcagttatcattctgttgtcgctttccttcaacatatttttactttttctcttaatgcttaaattgagcctcctttcctgtccactggcttaaggaatacagatggcttttaattttattacttaaatttccttccatagttccctaaatgactcacccaactgttttcatttcttgcagtttactttctgatccatacattaaaacaaatcttaattcttaatgttactcagtctatctttatatttttatatcatttttacatacatttgaatgagctatcctattaaaattttaatattaactttgaaggtcttgttttgagattagcaatggtgtagagcgctgtgttggtatcaaaagtctctgatcaaccaactcattacctgtaggattttggatgagtcacaaagtttcttttcttctacccaaatgatagcaggtatttgaatagcttgcagttatactcaatataaagacataaaagtgaaattgctgttatttttagtatcactagtattaagagcaaacattcttgataattgtgtagaagtacaaaagcggctacattgaacacatatttgcactgttttatttctgtaccaacaaccttgcaatggcttccttttgttcttagaataataaaatccaagcgcccattatttggccttggtttaccttttcagccttcctttccacttactcttgagacattaagttttgtattcactgtccttcattcattatctmttaatagctatgctttgctctctcagggccttcacacattctacagtcttagcctggcacacttctcctatttcatgtttcagattaaatggtgcaccttgggggaaactttcttaatcactctccattaagttaggtccccgtattgcatactttcagtgcactcagtaccttttctatgtagcacttttcacactgtttaaacatctgtttaaagactgtacacccactagatggaaaattgttgtaagatatacagacattgtcttgttaccaccacttgcctaacttctacaaactcaacaattatctgtggaaataaactaatacagatgaaatgaataattgtaaatttgctctgaaataagaagagaaagcactttaagtgttccttgagcatgataatctggaagaaattaggtatttgtagtcctctggatccacctctgacatgatatattttcttttttaccaccttgcaggaggtgtcttttccttgtatttttctggtatatgcaattcgggctcatttcacaaagtttaggaaaaaaagaaaaacataaataggatagtgaagcatgctatcatctagagcaaaaatcttttgaagtttgtgtgtaattattacaaaaggggaggggtaaactagtatgtgtacacttccgttaaatcgtgtaaatgaggactctaccaggaagaatcgctgctcgtagataaaagtgcattttatttccctagattgcatttatttaattcatataacatgagaaactcctccagtagcgtcaactagggttgataagaataatcgataaagcaaaataaaaacaccttctccaagattttgtaactgcaagcgaacgcatggtggcgctgttgactaagaaggcgaattaaaccacaggcattgtgcatgctcggtgacgcacggatccagtgtggtaaaccagcggttgagagcccaggcagatttttgasccagcaastctgagcctctggaaaggcttattcactaggccgtctacaaaggttgtggggcaaaagactgtttcccagckctgtctgaggttcagcttggcgacattccctggaagagcgtgacggaaagtgcaatggaggcgggaggagagcgatttcttagacaaaggcaagtsttgcttctctttgtttttctgggagggtctctggctgggtccgagtcaagacgctattctgtggctgaggaaaaagagargggctttttaatagccaacctagcaaaggatctgggactaagggtagaggaactggccgcgaggggggcccaagttgtgtccaaagggaacaaacagcattttcagctcagtcatcagayaggtgatttgctcctgaatgagaaattggaccgggaggagctatgcggccccacagaaccatgcatactacattttcagatattactgcaaaaccctttgcarttcgttacaaacgagctccgtatcatagatgtaaatgaccattctccggtattctttgaaaatgaaatgcatctgaaaatcctagaaagcactctgccaggaacagtaattcctttgggaaatgctgaggacttggatgtgggaagaaacagcctccaaaactacactatcactccgaattcccacttccacgtactcactcgcagtcgtagggacggaaggaagtacycggaactagtactggataaagcgctcgatcgggaggagcagccgraactcagcttaacgctcaccgcgctggacggcggctctcyccctcggtctgggacagcccagataaacatccaggtcttagatataaacgacaatgcaccagaatttgcacagccgctctatgaggttgcagttctagagaatacccccgttaactctgtcattgtcactgtctcggcttctgacttagatacaggaagttttgggacaatatcatatgcattttttcatgcttctgaagaaattcgcaaaacttttcagctaaatccaattactggtgrtatgcaactggtcaaatatttgaattttgaagcgattaatagttatgaagtcgacatcgaggccaaggatggcggaggcctatccggaaagtctacagtcatagtccaggtggttgatgtcaacgacaacccaccggaactgaccttgtcttcagtaaacagccctattcctgagaactcgggagagactgwactggctgttttcagtgtttctgatctagactctggagacaacggaagagtgatgtgttccattgagaacaatctccccttcttcctgaaaccatctgtagagaatttttacaccctagtgtcagaaggcgcgctggacagagagaccagwtccgagtacaacattaccatcactatcactgacctggggacacccaggctgaaaaccaagtacaacataaccgtgctggtctccgacgtcaatgacaacgcccccgccttcacccaaayctcctacaccctgttcgtccgcgagaacaacagccccgccctgcacatcggcagtgtcagcgccacagacagagactcaggcaccaacgcccaggtaacctactcgctgctgccgccccaggacccgcacctgcccctctcttccctggtctccatcaacrcggacaacggccacctgttygccctcaggtcgctggactacgaggccctgcaggcgttcgagttccgcgtgggcgccrcagaccgyggctccccggctttgagcagcgaggcgctggtgcgcgtgctggtgctggacgccaacgacaactcgcccttygtgctgtacccgctgcagaayggctccgcgccctgcaccgagctggtgccccgggcggctgagccgggctacctggtgaccaaggtggtggcsgtggacrgygactcgggccagaacgcctggctgtcgtaccagctgctcaaggccacggagcccgggctgttcggcgtgtgggcgcacaatggcgargtgcgyaccgccaggctgctgagcgagcgcgacgcggccaagcacaggctggtggtgctggtcaaggacaatggcgagcctccgcgctcggccaccgccacgctgcaygtgctcctggtggacggcttctcccagccctacctgcctctcccggaggcggcaccggcccaggcccaggccgacttgctcaccgtctacctggtggtggcrttggcctcggtgtcttcgctcttcctcttttcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccaatacgaggtgtgtctgactggaggctccgggacaaatgagttcaagttcctgaagccaattatccccaacttcgttgctcagggtgcagagagggttagcgaggcaaatcccagtttcaggaagagctttgaattcagttaagtgttaataagsatctactgagcctcgtcttagttaatctgtggaaagtccttttttactgctttgyccattggagaggtcttttttggtctggttcaaggcaagtagcaagaatagagcaaaatatcaaatccagggatggcttaggtttcattaacagtactggaaagtagttgtgtggctctgaatgttttgtatttcaatcgagaatccttagtcgatagaacattttgtttatatattgatkctactttttctgtagttaatccttgcatattctcctttcatcctggcttgccaacgcagtcttaattccgccttttttttttctaatggggagcaaaaagaaattcactgtcttttaatagtgatttcaaatagcttattaaaataactccattcaaattttacattataaagcaatgtagagagagttccaaaccaccaattttataatttcccttgttgaatatattcatataatgtgttctataatatgcccaaagcagctttgtctatagttaacaaagttttaaggatagacaagaatgtgttttctttaataaatagtaatatatcatctttttagggatatagtactcaaatgaaagtaatttagttcattttctgtgttgacatttgcaattaatatttcaatattttatgtgcttatattggccaaaatatggacacaaatatagactaatatgggtaattaccctttggtttatctaaagtgtgttcatgatgacygaggaaaaaaattaaacctatgccatttaaaaaactgactgttcttttccatttgacacaaaaacgttgtttagtaagacatctggtggaacaactatttgtttcataaattctgagatgtaagtgttatgaatctgagagacaatttttaatttcaagaaaatacatgggtatatgatatctaaatgcttcaaggtaaaagtggtgtcctatccagtcctatttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacacccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagtcctattttattattaatacctacttgccacttgtatgatgatataggagaaagatattttctttttttcctgtcttggttccctccttcagattttaacctgacatgatttaggattatatatggtctttctgggatagaaactgtccatccttatcagcatcctacctcctgcaatgtaattaaaagaagatgtacaagaatagaaagttctaaaaaggagagggcaatatcgttgtgaaactctaaattagctacaactaagaataaaatctggaagcaaccaaaacatggaatcttatggttatcttgagtaaaataaaaaaacttattttaagcgacaaaatatttagctcctaattagggaagtgtattaggaaaaaattaattttcttcttacaagcatttcttcacccacagaacatccatataactttctagcaattaaatactcatgactagagaaaagagaatttctcaaagattttaaaaattccccaaaaagcaagagtttaagattgacatgctttcaaacatatgttaaagtgtagttattatcacatttaaatggtgtaattttatgtaacagcatcaaattcataaatactttttaaaaaaaatttttgagacagggccttgctctgttgcccaggctggagtgcagtggtacaatcatggctcactgcagtctcaatctcctgggctcaagggatctgaccacctcagcctccagagtagctgggaccataggtgtgtgccaccacacccagctatttaacaacaaaaaaaatttatttgtagaaatggggtttccccatgttgcccaggctggtctggaactcctgtgctcaagggatcctcctgcctccacttcccaaagtgctaggattaacaggtatgaaccaccatgcccagccaaatatgtgaatctttaatagtcagaggaaaattaatataatatttcctttcactttaagtactttatagagatgtttgaatctggctgttttggtcagatatttttcttctttgcatacgtagctgattttccatgaatatcaggaaaaggcatagaattctgatcaagatttctctctctttgattaccttagtcccaggtggtatcagagccagggaagtactcaactgtggaaaatatagagggcagttcttttggggactaatatggtatatgatcggagactaaagttcaaaaggcaatatgctgagtcatttagacactgaagatagaagaacagataccatttgtaatttagtttttagatgtactggacttatacattgttgagaaaatgaatagaatttagcaaagccagaaaagataatctatactaaatttgaaggtgggaaacaatcacatcttactcttggttcaaagctgcttctctttcagggcagttagaaaccttttacccttttatttgaagacaacttccaaaaacatattcatctggatatttcattaaatacagaacagagagagtaccacatgtacagtactaactagtgttgccacgttttggaattccacgaactaaatgcctggcacaaggtaaaagggttattaataattttctagtaatttttcttctaggcaggctaattcattattgtaaaatatttacaaatcgatctcaccagtattccaattatcaaaaagtaagagaaggaaaaattttactcccttccctcattctagaatatataaaatgaccttactagactctaaacaacttgaaggtagagtctgtttctggtttattcacagtggtatttccagcaaatagcacaatgcctcattcatagtagacactcagtttatatttgttaaataaataaattttaaattatttgggaaataaaataatgctgtaaggacttacaaacttgtttatttggacctgatctacacattgaattttaaaagaactatctgtattcagaaaggggtggagtatgaagaataattccctatagaggcaattttttatttaatgtctccctttgcatcttgagacttgtggaaacttggagaactgtaaaattatgtattaatctccaagttggttccaaattgagcttatttatatctttgatttcagggacaaagaagaaattaaatataagacttttttgtacatcaaattaactttctgaaattggtatttaaattctctggcctctaattggtacttctgttgaacttgggttagtcttaatgatatcaagattaaataaaatttgcaagatcccaaaggcttaaaaatttttttaatagccaatcattcatttattttcaaaacataattctcgatcacgtgcacactcctttcttctctctacaaatacattagttcagaaataacttaaatatttccttgacattcacaatctagtttttagcactgaaaatcaaagggatacaaatgaattttaaatttttatttggggagttgttataagactaagctatattcaaatatcaatcattaaaactagtgaggccactcactataccaccatacttttcataaatctcctttgatgaataaattctacttccttacaaaagaagactctgtttaaaaaaggtaccaacttttctatatatccccctactttattctggaaatgtcttttgcttcttaaagtaattgttagattttttaagccaraaatctgttagtcctaattatgaattattttaatgtcaaatatgcatatggttaatcaatagttttctttatcatagattcaaaattttaagcttattttccttccattctttaggcattcaacacgttgatgaaaagtacaatgtcagtctacttctcattcttttatccgtaaacttctttactctcttttagattcttaaatttattcttgctgttctgatatatatggtaggccccaacctgagattcacataacgtactgcatttttttctttgagaaattacaattttcttttgaaaactttcatttggcaagttttcacaactatttgttcttgtttcaaaattgctatttccttctttgttgtttgagtcttttacgtttaagttcttgccatattgtttcgaatttcaatttcttatagtagataaaacaattcttttatttgttgagtctctttttcatggtgtcaatcttcatttgcttggtgatattttactgagaacttatctcttattggaagcttctttcacagtagtacttgttttgacaatcctggggaagggaagaaggagaagaggggtctcaaggtggtttcagccctggcctctgcaaacccaagccttaatttaaaagcttagctcgccgggcgtggtggctcacgcctgtaatcccagcactttgggaggccgaggtgggtggatcacgaggtcaagagatcaagaccatcctggctaacatggtgaaaccccgtctctactaaaaaatacaaaaaattagccgggcgtggtggcacgcgcctgtagtcccagccactcgggaggctgaggcaggagaatggcgtgaacccaggaggcggagcttgcagtgagcggagatcgccccactgcactccagcctgggcgaaagagcgagactctgtctcaaaaaaaaaaaaaaaaggaaaaaagaaaagaaaataaaaaaagaaaaaagcttagctcaactttgccacacccaggtaaaagttctggaccaagcactaaaaatatgtttgagttgggacccatgctcttttgggtggtattgttctgcatttgctcaatgaggcaaaaatctcagggaatgtcactgcttcttggttgtcacggtttctgctaaggctatagacatggaagctaatggagaaatttaaaatgtttcaatcttcagagtaaataagttgatttttaggaaaagtgaactgtaactgaagcaattgacacatggggactatgtggaaaacatcatggtctggattcaagttacagcattcatggtaatgctcagaaagataataacatactccaagattccactgaaatagtggttgctatttttttttttagaaaatagcttgggactctggtgataatgcaaaatgggcttgctccttccaagacaatctcctcatgaaaccatttgtcaaaaattagtgttctgggactgggcacagtggctcatgcctttaatcccagcacttagggaggccgagacaggaggattgcttgagcccaggagttcaacaacagcctgggaaacatagtgagactctgtctctacaaaaaattttaaaaattgactgggtgtggtggcatgcacctgaggtcctagctactgaaaagggtgaggtgggaggatcctcgagcccaggaagttgaggctgcagcaagccatgatcatgctgtagcctgggtaatacagccagactctatctcaaaaaataaaattattttggtaacagagaagtcagggctctgcaccatctcttactagggtggaatctaacatgcagaaatatagcacaacataatcacactgttcttcaacactgtcaacaattccctgacccaaacctcatgtaccttattaattcacaataaaaagaaagtcctactcagaatgatgatagtatcactgccaaaaacagagactatctagggactaatacctaagtcactttcccacagctgcccaaagacgtattcctcagccctctcttggtatccatctgcatggacaatggaacctgtgtgctttgatgtccctggtttttgagattcttgaagagtttgagttctaaatgtgtctggagctttctggagttgagcatcaagatgtgcagatcctggatgacacacagctataatagctagataacaaagaaaatttattataaagcaattctatattgtgtactgagctgtccaggtagaaaaaaagtggtaacccagtgatgacttgggctagaactcatgactattttattggtgattcgaggcctcagagccctggatgttagcatgtgggcccacagcctggaagtacagagtatgtgaagcacatctaggcttctaaaagacaaccacaaccaggcataagctggtgctgttattaaggacaagtggaagccacctttatttgccatgatcatcctacacctggtctaggacttaccccagtcttctcttccattcctttaaccacccataaaaggatttccattttcttgatcactgatttgactcagtcttctttctctttcaattctctctgttcctgtgctactcagatgtggagggtcaactgggaaacttcagtgcattgctgctcaaaagaaagactcttcctgagcattttgggagtatcaacaccactgggatttagttctagagctttcagtgtgagaagtttctggaatatcagaaacaaatatcaaatttctgaagccaattgtctctaattaatgtgagctatctatgaggaaagacttttaaaa

SEQ ID NO: 12429 - DNA, 30510 bp, Homo sapiens
ctgggtcccacctgggactgaatcctcctattccatgctcctcttcagatctgggcacgtcgggagccttgggaagccctggctgagctctcgaagttctctgagcagggaaacccgtggtgctagggttgaagcctgggggccatgaatggagcccctgacttaggtgggatatttgttgctttctgatgcttgtttgggttcaggaaggagcctggacttgcctcacagacctttctttggtttctgtgtgagctctgactttgctgtggggctttttttcttccagaaagaacccaggaagcattgccatttactgctctcactgccctgaacgcctgccctgaacccctgctctgcctaccccttggatttctttctcttcgcaggctcttgcagcaggtcctgatgcccctccttcatgctttacccagtccttcatctgtccccacatccactaagaccgcagcatctcccttcctcatcctgcctcctcccagcagacatctggcctatgggctgccttcctgaaaactatctagcttgtggttacatgaagccagagtccacttgtggttatgagcacacgattgtcctgggccacataatgtgtgtttagcttgatcctaaatgagtttcaacctaacaccctcatctggcctctcctatctgagtctggatgtcagctacccatccgtttgacaggtattgagcacctttgacctgccccagaagtggcatcacattgacctaagaaatggcatcaaggacaaagaaaaatgaccacatcaagaccctcctacacaagaagacacgggatgacagagaaccaattctgctactgatagtggagctatggtttccaggacgagagtagatgaaggggtttgccagctgctataacaggatccagtaaatgggctggccctaaggggtgaaagtgcagattcctccctcaacccctgaggagtctgactggcacttctgatatttggggctcaggaagttaaaaaccatagaaaatattaattccccattcataatataattggcatgtactattcccatatgtgcaaattaactcttcgctgtgaacatatgcaacttggcattccacactcaaccggcataggggcagactaggagtcccatggagctgatgttcccaggagcacccctcagcctatgctggtggataatacctggtgtgggggtgagtgagaaagatcccagtagaatagcctttctcctccccactccttcctccacccatgaagactattctttattcaagagagacatgaaattggggcagaagtgtgctgagaaatatttaacaactggatttccaaaaaatacatattcataataaattttactgatataaagtatttgtagcacactgttgagcactcaatttgtcgctgttcggggtgccactatgtaactctcatggacctagggtaactgaacaaagggaggtgaacgtaggaataaaagacaagagacaaaagagcatgtttggaagaaggggtcagggggcaccttgcctctagtggacaagggccctgaactttacacagccctctgtatttattaggcaaaagagatagcgagaagtggggtggaagaagaggtcagctgcttggtccagagtaggcttgcaagactgcattctctagatgtcccagtagataacttcaaggagctcggcgccaggaagcaatggccctcagcaaaccttctggcagtgggagtaattgtgagtttgcccacatcctgcattcatgataaacagtttgctgtttgatcatatagcctccagtggaatgctgagttggtcacgtcccacgggccttcatctccctgcagcacgtaacttttaaataataataaaatgtactatactttttattgtaaattctacataatcaactgattctcacagaatgttttcactgatttttctgaacttttgcaacttgagctaacttataatggcaattgatgaacagtacactgtgtagttatgaatgttggttgatattttcatttacattaaggagtaagataaaacagaaataatgagatgtatggtgggattttattcttctgtcaatgacaggagtaaactctttgtttaatcagataagttttggaatatctacactagaagaatatttctgaatttttgtgctatttacagtgtaatgactgcagatattaacatcttttaagttgcattattaatattttattcatcactatatcaagcgtagacaatcaataaaatgataaatcaagacttgatggatagtatttgccaatttctgcagtgtaaacacttctatcatgactgacttcaagctacaaatgtgactcgtgtaaaaatataatttctgattatttccgtagaagatatttttagcagaaactggatcaccttttcaagagaaagtaatatgtttgcaagacaaagatgagtatttacaaactgctttcaaaaatggctgtaacaggccatgcacagtggctcacacctgtaatcctagcactttgggaggccaagatggaaggattgcttgaggccaggagtttgagaaaacggctgaaacagtgtccatttccccaatcttgaatgagagtaaccattgcctctctcgtttcaggaattattaatttttccagttttgttaattggcagtttggatagtcattctagacacaagaataaaggagatcacactcctgattaaaacctgtcagtgaccttcattcctccagccaaagccctcagccattttcccacataaaccctaagcagactaagaatctcattttcataggcttggccaaagtttgtcttcaggccacatgcaatttccaagggctcctcttcctttacttctgtggaaggtgcaatatcagaatatgaatgaatcagaatgatgttcttagaatcttaatattggatccatttgaacaaatcagtaattgaactttgggaaaacttcagcacacttccttagcatacaatttcttgtgatgcgaatcacaactgttaatttgtattttgctttcgaatcctatatctcagagtgatgaagtctctttttaccagaggtcttagaataggtttgcttaaaatgagatatatgaaagaaaagggtcattttagtcagtgggcgagcatttatccttagctataaatgaaggtgataaacagtttcatttctgtatatagaatggtctgttcaatactatattttttgggtaaagtttcttttaatgctcttggttgtttactttctttgatttccaggaaaaaaaaaaacaggcacaattgctatcagatattttgagggcaggcatcttgttgagatcattatttaataaggcgttgagtcatgaaggcagtagactggtttgaagttggccaggatgagagttcttggcatagtttaaagcaaagcatttgaaattctgaagtcctcataagttgcaaacagttgtctttattttttgaagcactttaattttgaagcacttttatttaagtttcaagaaccagaattgtttttctttttcttttttgactttcatctgcacaagactttttgtctttattttttgaaggcttttaattttgaagctctttatttaagtttcaagagccagaattctctttctttttatttttcttttttgactttcatctacacaagatatatgaagattcatagtcagaaagttttgtctgtcttcttgaggaatagccaactccaatcttaaaaaactcttctagaatgtcataatcaaatttttaaacttctaaagattagaatagatgaaataaaaaagcaaccacagactggaagaaaaatgtttgtgatatgtatatctctaaaagacttatttttagaatatataaaaaattttcacaacacagtaattttaaaacacaatgaaaaatgggtggaagatttgaagagttgcttcagcaaagaggataaatgagtggccattcggcacttgaaaaaatgcttgatctgggaaatgcaaattaaaattactatgagataccactatgagatactcactaaaacatattaaattaaaaagactaacaatactaagtattgataaggcagtggagcaactagaattaccatgcatatgataaaagataactattaaaacaccaactctcaccctaaataaggaaaattcaggagcattctcatttgaatcagaaacaagacaaggatgcccactgtcaccactgttacttgacattattaaagaggttatagccaacaaggtaaaaccagaaaaataagcaagaaatgtaaaaattagaaactgagaaatatttccagtatttgcagatgatgttcaagttcccatagattttaatatcataatctaataatagagataagtcccataacttttgccatattctgttggtaagaagcaaatctcaggttccgtttgcactcaaagggatggatttgtacaaggtgtgactcagtaggtgtcaccttagggtatgcctgccccactaagagtatgagggcgcagttacccctcatcctacagatatacagatgtcccagtggagggacgccttaacttgccctgaacatacacatgcggggctgttgtacttaaagcctcctacttctatctcaattttcactctctgcattttcctttttttaaataaaatgtaccaaagccgtagggtaaatcctatgacacagtaaagaatagtctcagatttataagtggagaaaattcaaaagttctaagtccggggaatttcttagtaactcaaacaaaatgtcacactttctcacataataaagataagtgtttttattgattttacactatttgcttacagtaaatatataattgatgttttaaaataaaagcaggtttcatgcttcatgtaacaaagttaggttcagatactaatgtgaaaactcaactattcctgggaaaccatgttcaaaaaaatgcttcattggctaagcagtcttattttattattcaaatggactaaaaatgaggtatgaagtaattaaaagtaatatggtggctttaagtgcagagatggggtggcagaagctgtgaacacagaatgtaaaatcggtaactacaaaatggcacaaactacgaaagcaatatatttaaattactattttttaaaaaagaaggatcatttcagatcttcaccttcagatcctcactcagccctgcctcctatttcccataatcagccatttttttaattttatgattgctattactcaccttctagaatatatttttgtttatttgattgaacaacctcttcctgaaaattctgcccagttgggctggctgacattgatctcagtaattgtgtttttttcctctaacttgattatatttttttcattcgcctctctttaaatgaagtgtcccaagagccctaaattctctcttcaggtggtcgcttggtaggttacttcatcaataggttcatccaggtatagagagcaatggtgtaaggataacaaagatacaatttctcagaaagataacattttcaaaagtgctattaaagacagtgagttgttcagcaattcaggaaaaaaaagtctttaaatcagagggaaaaatatagagaaaaagtatttttcagaatacatgtcagtttctcctagaaatatatatacacaagtattgaataggtcccctgccaatgtaggacccaagacttttactctgtgacattccatttgtccttggctgtacggaataaaagccctttgacgatggcggcctccaatatcataatccgtatgggtgcggccatgccgtcctcccgaccaagtttctgaagttgaatgaaccgcggaataaaggtacgccgttatacgccatgataactgttggcggagcgtagcttcaaaagtgttagtgggcatgcgcgcctttcaacagcgcctacggaaatcctaacgggaatgtaacccaaaccggaagtggcctagagcgrccatttagcttctgttgttaagtggatctaagcytatgtcgcttactggacgctgaagtgattgggaatattagcagtgggggttctgtagggtcaggaaggggcggctggctttgggkgagtgatgaggggcttgttgggggtgggggtgcgtgataaagggatttctcggctgaagacgaggctgtgaggtgagtgacgggcttgttttggctgagcgatgrggggtttctggggtgggtgatgggtgctgtggggtaagtggcgtttgctaattttagytggataattagcctgttaattttccctcttttcttgcttattttctgcttgtagtatttttgtgacttaaattccaagtgtactttaatatcggattttatattggtccacgaaacttgctaacttgaggacagtgaacgtgcatcttaagagcgcctttgcggatggtgctggaggacgttcagggaagggattcactgtccgtrggactaggggagtcagtgattgattggcagccaagagcttcagaggttggaggactttgaggatcacactgtaacactctcaggggaccagtgatgggcaacctataggaatcagtagagtggggttgccaggggtagcctatggcagccagttgactggaggcgtagggggtcaatgatggggatttgtgagggtgaatgcattgctttctaggcagtgagtgttggggtccttcagggattggtgggtgggtcagtgttggcctcttcttgggtcccttggacatggtaaggatcagtaattgacagttgagcacatcgatgatggtttcctattggggcatttcatttggacccctatgttggggattatttgtcgttttatggaaaccagaaaattgtgctcgctgggaaacatttcttggctatcagggcagtaaagatttcagaagcctgtgccatgtcagtgactgggaggcattttggaactttctggcagccctgtagtacactcattggggatttctgaaagtcagtcctgtcagtgattgcattcaggtgcggtgggggcaacttattgtggacaggcaagaaatrgtaactggaggccctgatgcatgtctgcaaattttctgtgtcaagatggggattgggacagtgattttaagttttagctctagtcagaagaggctggtctgtgtgtggtgtattatggacggggactgaaaagtccagaagctcagaataggtacaccagacagagccacctcccggcctgagttctatgaaggcaacagaaagaggaaatggtgtttctggaagctggccacgtatgggtacatgagatagtggagacagtgtacagtttagaacaaggcagatgtggggctgattccctgtttttccatttacagactgagtaaccttcaggcaaattatgtaacagcacacagcctcattatcctcatcctcaaaatgggtatgataatgcccatgatatttagctgacaattaaattgacaactttctttttttaattcatatttatcacgtgccaggcaggcactraggacttgacaagcttcatcttggttaagtttcccaacayctgtgataaatacctgcattttcattttggaaactacaactaaagtaatattttcatattctcacagtgaaaatgtggcaaagctgcaatgaattcaccatttagtccagactcagtctttatttttaaccctgactaataactagagttgggctttctgaactttgtctactccaatgtctgacacagtgacttcacctcagtgccctcaggaaatatttgtggagtgaatgttgaatgagtgaccatgtactcattgcttttccaaggcttctgcagaacccccaggtcaggccacatcattgaggctgcaggatctctcttcayagcccagtacgactctccrcmgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggtaaacaggggcagccctggggatagttctccagaacgtgagggcagacacaggatgcagcaggtctgggctccctgctcctgagtcagtcttgagcctcctgtcaagcgaggaccacagaggctgatgtttccacattcataggctatctgtgttctagaggaaaccatgaactggctgataaaagaggatagtagagggttggccttgggtcaagaaagaagaaactgtagtccctggtctgatcagaagccccagtcataggatggaaaagctgactctttcctgctaagcactggttctgcyccttcatccaccaytgggtctttgaaaaatttcaagtggtcccccccaccaaattccttgcttggtccatggggtttggcccgtttttcctctgttctcataaggtgcggcaaaatctccttcctttgtaatttaaatagtcacagggaggtagagtgagaagaggcttttaaggaccatgtgaagaggcttttaaacactttttcctgtttaaaaaggtgaacaaaaaatgctggaaaacagtgtttccagattgcccacagatagaaatagtcaggatttggtaacaagaaatcagaattcttggtatagtcaagatttcctgaaatcctaaattattctgtgtatctcttgatgctttatttacaagtctttaaatagtatgtgactataatagtaaacagtgtaccattgttctgtgatgggtttataaccaaatttacagagatgttctgttttttaaaaaaagtataataaatatgtgtgttattatcctgaaccaatatattgtgagattatatatttcagtaacctgttaaaatcatctcaacctgctagaaacatttgataatagaaagtattaaaagaagggaacattaacacaaaataaattgcacatataaatcattttcaaaattgtaaataccccaaatatttaaaagtcgttcttaaaagaaaaattgaaacatacaagtttaggtggggcacagtggctcatgcactttgggaggccgaggcgggcggatcacttgagcccaggagttggagaccagcctgggcaacatggcgagactctacaaaaatacaaaaattagccaggtgtggtggcatgcacctgtagtcccagctactgagtacgttgacgtgggaggatcacctgagcttgaggcggtcaaggttgcagtgagctgcaatcatgacactacactccagcctgggcaatagagtgagaccctgtctcaaaacaaaacaagtttaaaacatgaaattgtctaagtctttgtgacagcagtgcagatgcacaaacgtttctctcatttgcattgatgttggtcaacttgcgtgttcagaacatcttcaagtttagcgttttaggacacatgttcaatataagcttttttccttttttaacaatgaaattttttttctgcttgacctgatttccagtttatcatttgaatcaatactgctgtcgctaattcagattttccatcagtgtctgaattcatgtcagagtatatcccagtaccatgcacattatcttctctttgtggtgtgtatttccctctgctctggacagtactatttttattttgttatttttatcttttctaatgtgatggaaataaagatagtatagtgttttaatttgcattactttgtttacaaacaggcttttttttcataattttattggtcaattacttgtctttagtgagttactttttcttaccttttgatttatattttggtttggtttagcctccggatttttagagagktttttttttttttttttttttttttgagacggagtctcgctctgaagcgcaggctggagtgcagtggcgcaatctctgctcactgcaagctgcacctcccgggttaacgccgttctcctgccttagcctcctgaatagctgggagtacaggcgcctgacagcactgctggctaatttttttgtatttttagtagagatgaggtttcaccatgttagccaagatggtcttgatctcctgacctcgtgatccgcctgcctcagtgtcccaagagagttcttacacagtaataacctaaggtcctttttgcatatgtttgtaaatactttttgttactttttcctttgaaagtaggttttagttttgtttgaacataggaaagaggatcagatggttttgtgaagcctgtaatcttttaaaagggctgtcacttgctatatttttaccaaagttccagctcctcccaggcaatcacattttacatttttagctaattattttggcatttacctcctaatcttttagtgacatgcttatattgctgcctcttggattgttaattaacacgttaattaattaagaaacatgtcattaaaaggtttgcttttacccgcttcctcatactttcacccccaacacctgctttccttgcccatccttctctagaactggttcagattctgatcaggtcaatcttccttgtttgtgattatgactgtgtaaactatattcagagctgcctgtatagacaccctgataactctctgcctgcataacttacggtttttccctggagcacacaattttatggattatttacttgcctatatacatgttaatgtattataccattttctccaagtgtgtacacactgtcttcataaattgaatttgttactaggtaattgcaaaccctcgctatttcagggacagtttttttttttgkttttttttttttttgagacagagtttcgctcttgtctcccaggctggagtgcaatggcgcgatcttggctcactgcaacctctcctcctgggttcaagccattctcctgcctcactctcctgagtagctgggattacaggcacttgccaccacgcctggctaatttttatatttttagtagaaacagggtttcaccatgttgggcaggctggtctcaaactcctgacttcaggtgatccgccagcctcggcctcccaaagtgctgggattacaggcatgagccaccacacccggccttcaggaacagttttaatcctcataactttgcgaggtactgctgccattatcccccctttacagacaagaagactgaggcacagaatgaaataagtggctcaagtttacatagtcagcaagcagccagcctgggattgaaggcaggcagtttgcttgagggttggggctgtcaatgccatctccttgaggaaacctttcctattgcttttttgtcttgatgcgattggacctggctgttctcctggcgcctcacgctgtcttctcatggtgctgtgttcaccatcacctgggaattctktttttctctgtcaagtgtccagttccttgtgtcttgaatcctttcttgaatcctttggctttctcttccacggtttaccgttactctcatttcrtgaaagtgcatcccctaggagttcttggggacggtacacggcagtaaatcctgtgagaacttatctgaacatgtctgttcagataacggagactaaacttaagaataggagaatcacttgacccaggaggttgaggctgcagtgagctgtgatggcaccactgcactccatcctgggtgacagagtgacatcctgtctcaaaaaacaaaaacgaaaacaaaagacctgagaggtttacatatatgagcrtgacatgaaagtgaaatgatatgaaaatgaatgatatgaaaatgtcacgccaaaaagcaaagatcatatatttgcatatttaatagaaagatgtcacggaaaatgacttgatttaccctcacactaagttgatctttgcctgggttcataggttggaaatcatttttttcttcctaaaacaccccatatactacttccttaccacacacatatagtctctctgctctcaaatcctgaaactctttatttttaagctgttagtctccatttaaaagggtttttatgctctgtcattttctatttctttggttttggaccctctttctggaagaatttctcaactttattttctagccctccgataatcattactgccttaaaaaatttttaagagcttttagatatgaatactccttttaatgacatgatgtttttgtttaatgattgaactatcttacctaaggatatttgagatattttaaaatgtaattttatgaatagataatacacagcattcacaaattaaaacatcatgaaaagtaatttttttacaaaatactcctttctctctcttttttttttttttttttgagatggagtctcactctgtcgcccaggctggagtgcagtggcacgatcttggctcactgcaagctccgcctccygggttcacgccattctcctgcttcagcctcccgagtagctgggrctaaaggcgcccgccaccacaccaagctaattttttgtatttttagtagagatggggtttcaccgtgttagccaggatggtctcaatctcctgacctcgtgatccgcccgccttggcctcccaaagtgctgggatgacaggcgtgagccaccgcacctggcatacccctctctcttttgtccctgatttgtccaggtttcttccacataggtaattatagttagtcatctgcctttacctcccaaacactaccactttcttccaaagttaactactttcgtcacttttaagttaattacttcattttaaaaaacgaggccggatgcagtggctcacgcctgtaatcccagcactttgggaggccgaggcgggctgatcacgaggtcaggagtttgagaccagcctggccaacatggtgaaaccccatctctactaaaaaaatacaaaaaattagccaggcatggtggcgggtgcctgtaattccagctacttgggaggctgaggcaggagaatcgcctgaacccgggaggtggaggttgcagtgatccaagatcatgccattgcattccagcctgggcaacaagagtgaaactccatctcaaaaaaaaaraagcaagccccagaatgggaaaagattcttgttacacatacagctgacaaaaggttcctataaaacgttgaggacggctgggcgtggtggcttatgcctataaccccagcacattgggaggccaagatgggaggattgcttgagcccaggagtttgagacgatcctgagcgtcayagggagaccccatctttacaaaaaatagaaaaattagctaggtgtggtggtgtgtgcctgtgatcccagctactcaggaggctgacacgggagaatcacttgagcccggaggtcgaggctgcagtgagctgtgattgcaccactgcattccatcctgggtgacagagtgacatcctgtctcaaaaaacaaaaacaaaagacctgagaggtttacaggacaatgagatactccttcagaaacacagaaatggccacgtgcagtggctcacacctgtaatcccaaaactttgggaggccaaggtgggtggatcgtgtgagctcatgagtttgagaccagcatgggcaacatgctgaaaccccatctctacaaaaaatacaaaaattaaggctgagtgtggtgactcacacctgtaatctcagaactttgggaggcagagatgggccgatcacttgaggccagagtttaagaccagcctggccaacataatgaaaccccgtgtctactaaaaatacaaaaattagccagkcatgttggcaggcacctgtaatcccagctacttgggaggctgaggcaggagaatcgcttgaacccaggagtcagaggctgcagtgagccaagagcrtgccagtgcactccagccttagtgacagagtagactccatctcaaaaaaaaaaaaaaaaaaaaaaagctggacatggtagtgcacgcctgtggtcccagctacttgggaagctgaggcaggaggatcgcttgagtctgagaggcagaggctgcagtgagccatgctcgtgccactgcaatccagcttgggcaacagagtgagattctatctcccaaaaaaaattttttttttttgaggaaaagtgttttttaacccagtagaaaactgaagaagagacttgcttgaataggctggtaaacatgggaagatgctcagcttcattagtcatctgggaattgccagtgtaactcccatgcctgtaccaaaatgcatacagttaccaacactgataataccaaatgtaggtgaggatacagagcaaccagaaggattttgtgtgctgctggtaagcatataaattggtacaaccaatttggaaaatgatttctaattttctactaaaggcgagcatgtttttcccatgacccagaattccacccctgggtatatgcccaacatctgttctgaactggtatttaaatgtagacctgtgctgtccagtatggtagccactcaccacatgtagctattgagcacttgaatgcggctggttcaccctgagatgtgcttgaagtataaaatatatgctgacttctgaaaacttagtatgaaaacagaatgtaaagcatctcatctcgatgatttttaaaatattgaatatagaatattcaatatatagaatatagaatgttttaatatatgtaatattaaaatattacatatagaaatgataatgttttgaatataatggattaagtaaaaatatcattaaattgattttatctgtcttttaaacatggctactagacaattttaagttatatgtgtggctcacattcacggttcatgttttatttccattggatggctctcctctagaggcttgatcagagtccacttggatttctttgtttttggaaatgatacttaatagtttgcacaccaygtattttcctacctctctacttttatttttttattttgcatcatrttaggtgcactttaatatctggttatctctctccttgtgataaaattgatgattgggttcagatattgtcagcctactcctccattataaagacccatcagtctttcatatggttttagcagtcattggtgatcagtaacagtgacatttttgttttgtccttcaggctgcatttatcatctrcagtacttctgtaatgaagatctttccatcatcagtcctttcattaacctaatattagttattacaggagagatcatcttgttgaaatattatatgatcatatctcttccctgcacttaaaatcctgaaatggcagtccgttcattaaaataaataatccatacccattatatattgaggcaccagcccacttctttggagcttggatggtaaccaccttccaaacatgacatagtcgcctcttatcttacacagagctgtctgcttctccctgaattcacagtgttttcctacctctctagttttattcatgctcttttctggaaaatgatttccttcacacatcctgcatcacagttcttacttccagcgtaagcttcaccaactctaagtagcattaccttctactcctaggtagaatttgcctttccctaatttgcccttccccaacagtgtcctctgcatatatttctaccatgttccctttttaaccctgtagttgagcttttgtatttacatgtcttccaagtctctgagttgctgcaagagtagaagcttatgtaattctgtgttgagcaccagaacccagctcaactacagcctcacatgtagttgcttcgtcaacatcatgctggttattcctaaattagctaaaggacttagagggaacccatttctggcctcatttttgaaaaaaaaaaatgaatgaatgaatgtaggtgtacagtggatggaggatatttctcttatttttttttaaatccctaaaaatgtgaaataggtgtttggtgggaagcctctgtgatggatcgtggtgaaaatcattaaaagcatgttcctcctatatgtgccatccccactcgccaatgatgacctaattcacagtgagctggggtacactgttacaggcatcagtgtcatttgaggacgtgaccgtggacttcagcagggaggagtggcagcaactggaccctgcccagagatgcctgtaccgggatgtgatgctggagctctatagccatctcttcgcagtgggtgagcacaactgacctgggaatcttggctggatcctgttgaggagatttccttcctcctcattgyagaacgcagtgggatatcaaagtatgtcatgactcttttatcggtttgtcctggattgtttgtttcttttgggcaccttctagtattattttgtgcccagtggaaaatgttgacttttctaatgagccrgtgtaaagcttcattgaatggcctctaaaactgaagaagctacacccaaatccagtatcctttctaattaacagggtatcacattcccaacccagaggtcatcttcagaatgctaaaagaaaaggagccrcgtgtggaggaggctgaagtctcacatcagaggtgtcaaggtgagtaagttgtacccgggcaaatgtagatatctttgcagggaaccattaccagtctaccatacttttctattccctccattcccccagtgatggcccgtagattgcctcctactcccagtttcccatcaaacactgtaaatgtgctataaatgytaaatgtcctataggggctgccttaagaattttccattggtgaatactcaggaatgggattgcctggtcctggagataagtatacttgactaaatcaaccatattgctcttctgatgggctgcaccagttcacactccccatgtgcagtgcacaaggatttgcatttgcacatcttgcttgctaacacttggcattaacaaaattggtgaatttatagccctactgatrggtgaaagggctgtttcatttttttttgtttttggttttggtttttttgagacagagtctcactctgtcacctaggctrgggtgcagtggcaygatcttggcttactgcaacctctgcctcctgggttcaagtgattctcctgcctcagcctcccgagtagctgggactacaggcacccgccaccacactcggctaattttttgtatttttagtagagacagggtttcaccctgttagccaggatggtctcgatctcctgaccttgtgatctgcccacctcggcctcccaaagtgctggaattataggcgtgagccaccgcacccagcctgtttcattgcttaagtgttatttttctaataactgaatggtgagagcctctcatcttatctgttatctgattggctttttcatttgtttgttgcattttcttaccgcttatctctttacgtccatggagttttctgccttttttttccagtttttttgcccctaattttatttattttcttttctttgctggatctgctgtcttcttttcctcccagttgtggcacctctagcttggggccctgttcttccatatgggcatcttttcttttttttgaggcagagtttcactcttgttgcccaggctggagtgcaatggcacgatcttggctcaccgcaacctccgcctcccaggtttgagtgattctcctgcctcagcctcccaagtagctgtgattacaggcatgcaccaccatgcccggctaattttgtatttctagtagagacggggtttctccttgttggtcaggctggtctcgaactcccgacctyaggtgttccgcctggcttggcctcccaaagtgctgagattacaggcgtgagccaccgtgcccggctatgggcatcttttcccacaggaattgacttaaaggacccatccattctgaactcytagtcctcatatttttattctaatgatttatatatcagtacctctagtccctgtgcttaaactgtgttctgctaccttacttagctccacggaggacagttcccatgagatgactcacttccttaattttgggagatcagaaattggaatcatcatcatccaaataaggaattctcacctgataaattttgtgagatttttctgtttctgggctcagaaacacagtcctctaatttaatttattactttggaattcttaccagtttttcttgttttaattaagaaaaaagtgaccctttttcttaatcccagtggtattacaacaaactagatccccattttctcatatttagacaattttgttcccagtgagatatgttgatttcaggtttttgagtttagtcaagatactgacagattttatgaccccaaacatggctattttgtttcttttttcctcagtagatatgataaaaacaggcagttctatttcctactgtgtaggattaacaaattcttttcagtgatattgtcctcatggccacatatttccaatttaaaaatatacctgaatagttttcatcactcatgctctgctccattgtttttgtatgttgtttaatgtctactccatagaatgattcactttgcatacactctgctgattactttgtactttcttaatcttcattatatcaatgtttagcatgaggaaaccattgtatttaagatataggattaggatttttgtatttaggatacagaaattactgattttctgaaaatgggcagaaaagaatatttcacagtattttaaaaggatgctttaaatatttgctgagataaattcaaaagaacggagattgtatttggatggagaggacaatggcattaaatgttaaaagtattagcctttgtgcatcaatcatgtctatttcatggaaggctactcaaaaagtaagtgtatcaacatgggaagcatggatagcaaatgctggtgaagttcagaaaaatgatgtcagcctagaggtggagtgacattgggaattaattttaagggcatagtacctataactggttcaagaagccattttgaattgaaacaaagaagcagatgaagcaagcttaatgggaatagaggacatgagagtgtgcttggatttgagaataaattggacttcttttttgcaatcgacattgttaggctgtgttggagagttgtggaaaagcttttcagtacagttctgatagtttacattgaacattttgggcagtaatttaagtgttaccaggttcagcaagatttttatgacctgaataaagtgagaagttaaaaatgtttcagatcgctgcctggggacacagtggaagattgccagaataaatgaccacctgtatatgggtaaaattgctatttaagagtgaaaaatgaaatagaaaacaacctattttaataagtgggaaaaggatgtgaatagacatgtcttcaaagatgatatacaagtggccaataataggaaaaaatgctcaacttcactaattatgtgggaaatgcaaatcaaaaccactgggtgatatccctttayatccattagaatggctacaattaaaaaaacagaataacaagtgttggcaaggatatagagaaactggaatccttgtgtattactagtgggaatgtaaaatggtgtagtcctatggaaaacaggatgatgatttctcaaaaattaaacataaaattaccatatgatccagcaactccacttctgggtagatacccacaagaattgaaagcaaggacccaaacagctgtttgtacactcttgttcatagcagcactattcacaatatccaaaaagtggaattgtccattgaccaatgaattggtaaacaaaatgtggtctatacatacaatgaaatattattcagccttaaaaaggaagaggaattatgaarcatgttgcagtgcggatgaatsttatcatgatgctaagtgaataagccagacacaaaaaatccaaatgtatcattctacctgtatgaggtactttaagtagtcaattcatagagacagaataagattgtggctgccagagaatgagggatgggggaaaagggaaattgtttaatggatacagcatttcagttttgcaagatgtaaaagttttggagatccattgcacaacagggtgaatacaggtagcactactgaactgtacaatacaaaatgggcaagatggtaaatgtaatattatgcacttttgctacaataagaaaaagttaacaataaagattaaaagtgtccttttttwaaaaaaagaatgaaagatgattgagtttttttgataggacaagagtctgggatacagtttaagtgactgaaagcgaaaagaaactacatgtgatgttcatactcagtattaaaatctggtagaaaaagtaatagtaaaatttagtaactattatttttattgagaacctgctgtgttttgtgcagtatactagtaaagtgcacaggatgatcagggactcttattcttggcaaaaaaacaaaacaaaacaaaaaactaaactaaaaaaggcatatttgatagcataaagccaaaagttctaacaaagaacaattaatttcaatggaacaagggtgaaacaaattctggggaacagcttgcttgtccagtcttttagaatatatttctggggatatgggtatattcctaagttcaagaaaaaaaaattgtagcttcatggagagttgaggcataggagagttgaggcatagtcattctttcactggttggccatgtcaagataggtgaagctttaatagttttcagaaggatatacagggctgatggacttggcattgtttctaacaagtaagataaagcaggcagattggtgaggattcatctctgaaagttaatgaagacctacacactgagccccctccttcaagccttggctgcccacacatgttgccctgcaacacttgtctgttttatcctactcatcctactasatctgggtgtctagaccacttgcataagtgtcctcaggttgttgaaatctaatccccacagattagcaaagtgatcttggccaattacataaccattatgtgcttccttttctttgtaaaacaggaacacccatcatcgctacctcctgaggttattatgcagattaaatgagtatgtgtgcaccatgtaggccactgcctggcacatgctaagtgctatgtagataaatgctcatcatrtaataagggctctgtgtttctgctcattgtcagcatcattagcagcattattacatgactcagcaatttccttgtgttctgtgtcaatcagcttcatgcagtttctcctctttcttgttcattgtgtctatttcatcttctctttctccttttagaaagggagtttgggcttgaaatcccacaaaaggagatttctaagaaagcttcatttcaaaaggatatggtaggtgagttcacaagagatggttcatggtgttscattttagaagaactgaggctggatgctgacygcacaaagaaagatgagcaaaatcaaattcaacccatgagtcacagtgctttcttcaacaagaaaacattgaacacagaaagcaaytgtgaatataaggaccctgggaaaatgattcgcacgaggccccaccttgcttcttcacagaaacaacctcagaaatgttgcttatttacagaaagtttgaagctgaacctagaagtgaacggtcagaatgaaagcaatgacacagaacagcttgatgacgttgttgggtctggtcagctattcagccatagctcttctgatgcctgcagcaagaatattcatacaggagagacattttgcaaaggtaaccagtgtagaaaagtctgtggccataaacagtcactcaagcaacatcaaattcatactcagaagaaaccagatggatgttctgaatgtggggggagcttcacccagaagtcacacctctttgcccaacagagaattcatagtgtaggaaacctccatgaatgtggcaaatgtggaaaagccttcatgccacaactaaaactcagtgtatatctgacagatcatacaggtgatataccctgtatatgcaaggaatgtgggaaggtctttattcagagatcagaattgcttacgcaccagaaaacacacactagaaagaagcccwataaatgccatgactgtggaaaagcctttttccagatgttatctctcttcagacatcagagaactcacagtagagaaaaactctatgaatgcagtgaatgtggcaaaggcttctcccaaaactcaaccctcattatacatcagaaaattcatactggtgagagacagtatgcatgcastgaatgtgggaaagcctttacccagaagtcaacactcagcttgcaccagagaatccactcagggcagaagtcctatgtgtgtatcgaatgcgggcaggccttcatccagaaggcacacctgattgtccatcaaagaagccacacaggagaaaaaccttatcagtgccacaactgtgggaaatccttcatttccaagtcacagcttgatatacatcatcgaattcatacaggggagaaaccttatgaaygcagtgactgtggaaaaaccttcacccaaaagtcacacctgaatatacaccagaaaattcatactggagaaagacaccatgtatgcagtgaatgcgggaaagccttcaaccagaagtcaatactcagcatgcatcagagaattcacaccggagagaagccttacaaatgcagtgaatgtgggaaagcyttcacttctaagtctcaattcaaagagcatcagcgaattcacacgggtgagaaaccctatgtgtgcactgaatgtgggaaggccttcaacggcaggtcaaatttccataaacatcaaataactcacactagagagaggccttttgtctgttacaaatgtgggaaggcttttgtccagaaatcagagttgattacccatcaaagaactcacatgggagagaaaccctatgaatgccttgactgtgggaaatcgttcagtaagaaaccacaactcaaggtgcatcagcgaattcacacgggagaaagaccttatgtgtgttctgaatgtggaaaggccttcaacaacaggtcaaacttcaataaacaccaaacaactcataccagagacaaatcttacaaatgcagttattctgtgaaaggctttaccaagcaatgaattcctagtgcatcagcatattcataaatgaaatatactccgagtttcttgaagaagagaamatcttctcakaatcaggtctaattatatgttattgaattcatgcttcagaaaaactctagggatgcactgcatgtgtgaacacatgataaaaaagtcatgctttattttagtgagggcaattacagagaaaagagtaagcagaaatgtccttctgagtactggcctcattaaggattataaattttctccccgggaagaaaccctgactaacgcattgagaaaagcctttctgtaaagaatggtacaagacaggttgttactcgattatttatagtaaaatatgtgggaaattatatcaatgatraccctgtttattgtgggatatcaatatttttaaagtgccaacacagtcatgataggacaatattttatgtgtgtgtgtgcgccttatgtatataagcatatatataatatataagcatattattatatacaggttgagtatcccttctccaaaatgcctgggatcagaagcattttggatttcagatacttacagattttggaatatttgcattatatttattggttgagcatycctaatctgaaaatccaagattaaatgctccaattagcatttcctttgagcgtcatgttagagttcaaaaagtttcagattttgggttttcagattaggaatacccaacctgtatgtacgtatatttctgtatctatgtatgtatatatatgcatatgcagacatatgtatatggtctggtcagcatatgtgtatgtatgcdtatgtatgtatgtatgtatgccctcagtgcagtggggtttgctgcagaattcactgcatagcaggagatgtaagcagatgagttattttttaagagaatctaatctaattgtttttataaaaattattccctattgaatatttatataatgaggttgtatcaacaatgattaactcctttattatacatacacatgaatgtgcatttttggtaaatgcataaatgagattctataatgtttactgatctttatattacagattttctcttcttttaggattagctcagcttgcccccsctttccatctccaccatctatagtgagcctctccataattagtgccaaccattagtctcgttcatatttttacaccaggagtcaacaaactgtggccattggccaaatatggcctcccaactgtttttttaaaataaagttttattggaacacagccatgttcatttggacatgtattgtctgggcttcttttgtgctgcactggcagaattgagtagttttggcggagatcaaatagcccccaagctggaaactgaaaatatctactctctggctctttacagaaaatgtttgccagcacatgatacacacacaaacacacacacatacacacatattactatgttcatcatcatatacctgtgtaagtactctttcattgatttataaaactcagatctcttacgtgtgtggatggtatttttttcattctacaatccatgatggattgtacacacgtgtattctatgaggttgacctgccataatttatttagccattcccacagttttgattacttatttcctccccacacacattttttgctaaaaaacggagagggaactgttatcaatacttccgagaagcagaccagcataatcttttaagtgcacaggcccaggagccaggttcctgcatttgattcctggctccactctctaccctctgcatctgctgagcaagttatttggtctcatctattctggttttctcatctacaaaagggagatgatgatagtaccctacccccatgcatttggtgtgagaagtgtgtgtgtgttaaacccttggaactgcatggacagaccaagtgctgatgaattttagcgggcctcgtatccctgagcctgcctggttcccttgtgctgggtgtgggactgtggtgggagatttctgtcagctggaagtcttttccagaagggtgttagagatgggcacccatggctttagtctccataccccttcaaggttgataggggcccacacagctggtcaggaaccagcacagacctcaggctgtgtctaaaacaaggtgactgcacatgcaggagcctgtgctgggccctggagagcaaatctgttctgtgtctcactggcctctccctgtccaggggcgtagtatcagtgaccatgtcccacctcctgagaaaggtggaagagtctcacctggggagtccaggtacaagggctggccggccgtagatgactggtgtggggtggaaaggctgcagaggcctctccatggtggtgaggggtggaaatagtgtgcacctgggtcctgggagtggcaccctgaccagtttcagggaggaaggtggcagggccctaggacaagtgtgttaaaaacttgagcccacagtgtagacacactggttccaaagacccctcaggatgtgcctcccttctcagatctgggctttccctgttcctaagcatcacctggggggatcactctgggtcctcatctccagccacatgttcactcctcacgtgggcctccctaactgtccccctcagggcaagcccttcctccccacttccagaaagctgctcgttccctggccatcccacacctctgacctcgtgccacttccggggcctgttggctttaacaacttagtttcctccctacctcgcaaccccctctgtctagagtgctcacctccctcccagcctctgtctcatactattttttctttcctctcagtaccaagcgctgggacaagccagtctgtactcaatgcctgtgggataatagacggaggaatctggagtttggttgggtgattagctttggaattgatgggtcccagggagctatctaaagttttcagtcacatgagggcatgctcacagatctgtgaaaagatctgttggctcagagaactaagagatgaataaatgttagtccaatggcctcatcatgagatgagaggtcaagagttttgagtttccagagggagaagctactattctaggcagcttgtatgaactaactcgtttattcctcacagccattgtaggaaataatctaacctcataaaccccattttagagatgaggaaacaggcttagagaatttgacgtaaactcaagaccgaaaatctaggaacaagaaaagcctggatttgaaccaagctatctgatgccagtgttttaactctcaaccattgtactactttacctcctcatgaccttttttttttttttttttgtgagatggagtctcgctctgtcgcccaggctctggagtgcagtggcacgatctcagctcactgcaagctctgcctcccgggttcacgccattctcctgcctcagcctcccgagtagctgggactacaggcgcccaccaccatgcctggctaattttttgtatttttagtagagacggggtttcaccatgttagccaggatggtctcgatctcctgacctcgtgatccgcccccctcggcctcccaaagtgcccatgacctttttattgttgggcagtgaaagccatggtgaaatgaagaatgtcctactgtcatgtgatgtgatcagaaaacatactgcccagagtcccctgcccccacccccaaaaccagtacttgatccatcctttgactgttgtggggattggcacaaaggttgggcacagtagtagttaggctcatgggctctggagccaacctacctggatgctacacatcccagctctgcccctcgctagtttggtggcaagcaacttaacctctctgccttaatttctccagcagcacaatgggaataataatagatctcgccttgtggctcctttgcagattacatgcgttaattatgtaaagtcaagcattagaatggtggctgtccaccatgagtacaacacaaatgctcgttcttaatgattcaacaaacatggaatttcattaaatctgaaataaaggtattttgagaaattgaattccgttatcaagtgtgaagtcctgatccagactcacctcgtgcacactatttaccacaaaggtggactccctattttaaatgcattcacttaaagagacctttccctgtactaattagtgtttgttaagaaggaccttctggacatagttgaaagaaagagaaaagaagcaggtgtggggaggaggagaaggagaagggaggaagggagggaggggaaagaagatggatggacagatggaaggaaggaattagggatggcagaaaggagataaaataaactctacttttaaaagaaaccaggtggggtgagtgggagggcttccctgtgaccttggcctcaggggctctttctggcttccagataagatacccctcagctttgcactgggtctcctgaggcttggaagttatgtccacagtgaggttggtgtagaggggcagccactctttggagagcaacctgtagcccagacagttgatgccatcatcagaggatccagggatcggaggattggcggatccgggacagaaggcgaggcctggaggatggggaggggcagccatgtgagcctcagggaggacccagaaccaaccaccccacttccaacactgattcacctccagggcctctgcttgtggccaggatcttccccctccagcatatggtagcctctgaaaagcaggtggggctgggagaggagcatcccgcttagtttcacccttccagagacacaggaaggcatggaggccaaacacctgtctctgacagggtccccatgccacagcccagccctccagtccagggtagcccatgtccccctcagcccagggcggcccatacctgcctcatcatgtcaggacctgcagctcctgcctcccacctggcagtgatgtcatcctcatcatcccaaccccactacacgttggagaagccatttatcttcaggtagtgagtggggtgcagggcaaacacccctccaaggcacaagctaacggcttaattgctgttgtttccccatgttctggcttgcagcacttgtaacctctgggctcctgcagcccttaacatctgatacctttacattaagatttatcatccttatctctggaccaggctgaatacacctgtgtcccggtgcatctggccagcgggtcaaagggcctagcacacagattaacaaatgaatgagttccagttaccaaagttcaatccttgaggtggacagaagacgcccaaggcgtgtctcccatcacccttcactctgaatcctccttatcaagggcctcacgggaatagtgataagatctcagaatatacaggagggagcagtttcgggaaggggggcattggaaggaagtggagggcttggatctggggagcaagcggggagagtgctccgttccttggttttgggatcttgccttacgggtctcacctgccctccatcctggcttccacctggcagggtgtgtttgtgtcagaaagacgattgtgcgtaactgttcaccgcgtccacgtcccgagagttgcgcacgcgtggagatctgcaaaacgctccctttcagctccgcgcatgcacagagaccccaccccgcaagtccttgcccttcggcctgggcaggcgtccactcccatggctgcagggcgcgccgaagagcccactctgcatccccgagacgcggcccaatcctaggaatgtgcttagcgcaggtgctatcttcccttttcacattcccaatctctttctccgccccctcaaactcttgccatactcccacaacagcagaaaatctgaaaaaaaagtccatcccatctttgcactgacagcagtgcacagcagctggcagagaattctggcacggctattgtgcttgcgcaggcgcagacgggaagcgggccggaccggcctagtacactctgggaggcgtgcgcagaatgcgcagcgctgccgcgaggatctctgggaactgtaggcccagtttgtccgagagccgcaagtgtttcgggacgacgcaacgcaggggcacctgggagtcgtaggcggatgggcccaaagccttccgggagtcgtagtccttccgcccgctcctcgtttctttggaggttggcccttccagctccagttctgcccaggtgagcgcccatcccgcggccggccggtcctggccctttgtcgcgatgacgtggcggagttgagggtctctgtatttctctcccccgcgttctggtaggcgtccctggaaagatggcacccttttccgtgatctctcaatccctctctccgggtgggagtgctctaagcagctgttgtacctgctgacccgctttggattctgcggcccagcctgacaccttctcactctcgcccttcaacctgggtgcagtgcgagtgcaccctcctctgtcctggttacaacacagagtggtcagggctggcccagggggtgctcaggaggctgtgggaacacagaggaggtgctagacccagcccagggttcaggaaagaccttacagagcaaaggacctcaaatctaccacatccaaacgaaatcccagattccctgtcctaaacctgctcctctcacaatctttctgcctcctccccactaactgtccatccaagtgctcaagccaaaatcttggaatggtcgccagtgttctgtttctctcatccgcttccctcccgcaaccaaaccttgtgtgagtctcatcgtctctatctccagaagaggcccagaatctaaccacttctctccacttccactgtctccattctgctccgagctaccgttactcctcacctgcatcactgcaggggcctcctcactgttctgtttcttcccttgccacactccaccctctattcaggcacagtgccaggaagcctgtggaaatataaatcagatcctgtcaccagtcactaccctgccccccagcttaaaatcatccagtggttcccatctcagaataaaatccaagctccttatcctgccaacctctaagcttctggtcctttctggtcgtcctcagtcacaacacactttccaatgggctgaacacagccaggccctgcccttcatgtcctttgcatttgctattaactcaatttggagcattcttcccaccctgacccaatatctgtctactcattttgttggcctcagctcaaaggcctccagccaccctaaagaaccccctccctgttcccccccagtcataccaccaaag

SEQ ID NO: 12430 - DNA, 104403 bp, Homo sapiens
  misc_feature (1)...(104403): n = A,T,C or G, or insertion/deletion polymorphism (see Tables 1-2)
atcctcatcatttactagctctgaggctatgggcatctgtttttaaaaacatctttaaatccccatttcctcatttttaaaaatgagatgagaataatattatggttctttttgctgggcacagtggctcatgcttgtaacccaagcactttgggaggccaaggcgggtggatcgcttgagcctaggagtttgagaccagcctggacaacataacgagaccccatctctacaaaaaaataaaattagccaggtgtggtgttgtgcacctgtggtcccacctactagggaagctaaggtggaaggatcacttgagctggggaggtcgaggctgcagtgaatagtgaatgcaccattgcactacagcctgagcaagagagtgaggccctgtctcaaaaagataataataatactacttatcgcaaagagatcatgcatacaaaaactctgaataaactgaaagacactatgcaatcatcatcctaatcaatgtgaagttatagtggtagaagaagtgttgaccactgtctcacacatatggctgctaggcagctccatggtgcagatggcagaagtcaccacttccacgatcaggacatttccagtcatcatatgtatctttgcaagcagtcttcatttcatgttctgctccagtgagaggttactattgactttttgccatgacttttttcttttgcttttttgtctttaaatttcactttcattgaaatattatgattcaaatatgtgaatttatcattcctcaaaacatatacatataaaatcccagacagtacctggtatagagtttcgacttacaaaactggcaaatatgacccaagtattttgggggattttaattgtaacatatctcagacaagactaggatgatggagggctcgaggtcattgtcttaagtgataacacctaaccctgcaaatgagttggaagataaataatacattgtctcaaatgcagcagagaggtctagaaagatgaggactgaaacaatcactgaatttggcaactgggacatcacaagtgaccattacctgaatagcttcagtaaagatttggaaggggctactgagaggccaaatctgatctcagtaagtacaaaacgaatgaaagataaggaagttgggatatcattcctgattactcttttgagaaatgtaagaaaaagactaggtgggagctaaaaagtgattgaggggtcaaggaaagtgtgaaagaagaatataagagacctgtgtggtttccaggctgagtaaaagaatctgtagaaaaggaaaagtcaagaatataatagagagagtgtggaaagggtgaatgtactggaagtgggcaggatcaagcacgtgcacccaaaaactactaaaccaccagcaattccttgtccttggccatacctgcaaatctcctgggttcattttaccagtgtgtccacagaagtcttcatgggccatgctgcccccttccaggaggtaggatacctttgaaaaacaaacaggaaaaaaagtagatcctttgcctatttttaaattgggttattatttaattatccctactgacttgtatgagttccttgtatattttggaacttaatcccttattggataatatggtttgcaaacattttctcccattccgtgagttgccttttcattaaaaaaaaaaaaaaaataggcaaaggacttgaatagacactttcccaaggaagacatacaaatggccaacaggtatatgaaaaggtagtcaacattgtcagaaaaatgcaaatgaaagctacaatgagatatcatctcacatctgttaggacagctactagcaaaaagtcaaaagataacaagtgttggtgagggtgtggagaaaagggaatccttatacattgctggtggaacggtaaattagtataggcattatggaaaagaatatggaggttcttcaaaagatgaaaaatagaactcctatacaacacagcaatctcatcctgggtatatatccaaacaaaataaaatcactatctcaaagagttattttacactcccatgttcattgcagcactattcataatagccaagatatagaaataactagagtatctgttgaccaataaatagataatgtggtatatatacacaatggagtactattaagccttaaaaaataagtaaatcttgccattttcagcaacacggatgaacctggaggatattatgctaagtgaaataagccagacacagagggacaaatactgcatgatctcacataaacagagtagaagggtagctaccaggggtcaggaggtagggaacatgggaagatgttgattaaagggtacaaacttgcagtgacaagatgaatatgttctgaagacctaaagcacagcatagtgactagaattaatagtaagtattatacacttaaaatttcctaagagagtaaccttctgtgctctcaccacaaaaataggtaactatgtgaggtaatggataccttagcttgattgtggtaatcattccacaatgtatacatacatcaaatcatcacgttgtacaccttgaatataaacaatttttatttgccaactgtacctcaatgaagcttgaaaaaaaggaaaaagaaaaagtgttattgggtagctgtgaagacgtgtttgctttttccacagaaaatttgttgaggaaagtgtcaggagcaactaagaggagtaaactgagataaagaatctctgtgactgggccacattagccatacaatgtctttgacagaatctcacctaggtgccccttcctcctagcagatgcatccctgagcctgccagagctcacagctgagtgaaaagagccgccactcaccccttcagcccagcagatgatggtcctggcatggtgggccctggagattggggtgaaagagagacagctcctgttgaaccagcagggtccctgttaccaaggcttgttcacacaggtgtgtgggatggcatatgtgaggtctccacaccaccaaaaagctgcctcaggaaatccaaaggaaacatatttctgacaccaagcacacaaactcactaggtgctcaataaatgtttataaaatatgttaaatgaattcatagaaaataagtcaacttttccagggacatgtccatactaaatctaaaaatggaaagaaattctatgctgcccaatagagtagccactagcgacatgcagctatttaagtttaaattaattaaaattaaataaaattggctgggtgcggtggctcacacctgtaatcccagcactttgggaggccaaggtgggcggatcgcctgaggtcaggagttcaagaccagcctggccaacatggtgaaaccctgtctctactaaaactacaaaaaaattagccgggtgtggtggcaggcgcctgtaatcccagctactggggaggctgaagcaggagaatcacttcaactcgggaggcagaggttgcagtgagccgagatcgcaccattgcactccagcctgggcaacaagactgagacttcatctcaaaaaaataaataaataaataaaacaaaaacaaaaaaaattaaataaaatttaaaattcagcacctcaggtgcacctgccacattttgggtgctcaaaagccccatccggctaatggctatcatattgggtagtgcagattatagaacatttccatctttacagaaaattccctttgatagcacaggtttagatagaatgaatttgaaaatcagtagtcaactatggtaggcattttgtgtagatagaaaaaccttcccaggactttctgcaatcacagtaccttttggtagaacaagacttgcatcaactctaaaaagcagaagaaaagtaaacccttcttatttcattattctactaaagggaaaaatcaagcaactctaaacttctcattttaaggctatagtgattactctagcaaataaagattaaaagataccaaataattagtaagaatttaaaattacctcaggaacacggcaacattgttatttgaaatatataatttagcacttaaagcgtaaaatgttgtgtgtcaggacatgggctctttttgtgtaatctatttggattcgacatccattttgtatgcatttgggaaatttatctgttaactccttcaagaaatatctaaatccacaataaaaaacagagtggaaatattgtaagatataaagaagaaagaaaaaaaaatgcccaggaggcaagagaagagaaaatatttatgaatttctcagcatatacatcagatattgctgttttacacaaacaaaattgttctttcctcctctatacaagcactcatcgaataagtcaaagccagattgtttttgtcgtctatgtttttgctttatcctaaggcataaaaagtagacctaaatagtcttttttcacatgaaaattcaaaaatttgttttaaaaatcataaacagcaatggttattattttgccctacatatttgtatatttaggacataatcataagatatcaattcaaatatataaaacctatgatacaataattttaaaataatatattgagaaggtaagtgcaccaacaacattcattgaacaaatactcactgaagtcctataatgtcctaggtactgtgttgggagataaaaaagtggagaagacagatacagtaattgtcttcatgaagcttatattctcatgaggaagacatatagtaagtaggactggtagagttgaaagtagaaattgagtttgcagagccaagccccctcctctctccctcctcttgagagtcagcctatccacagaaagcaagtgtcctctttctctttgtctccgtgagagggactagcacccgtggtggtagcctacaggggtctagcacagctggtgagatctgagtaagtctgccttattttcaggtgcagtattcagaagcccacctgcccgcagatataagccaccttctccagtatcagctttatcagaaataaaggtatttttgtctgccatctttcttactcctttatcttctcaattggttgagaattcaggctgggagaacaagttattatttattatgcctcctaatacctaaactaaaagcaataaaagccttgctactgtcatgttgttgacgtttttatattgcagatttataataaactctcctcttcctgagctaactttattggatgccagttcttgaatcaaaatatttatagagcacataatacagtgcaaatcagggctggctgacacaaggactctccacgtttcatcctgcagaataatatcattgaggtatactgtgaacagaatagcctaggcagggcctttaccccagcaggtcacaggcagatggctacaaaaattagaggttctaggtttgaagtctaaaacccccatctgggaactcgctatggtaatggcaacaatgcaacactggcacagggatagaagagacccatttgtatgggaaattaatatatgaaagtagcaatttcaaatcagtggggcaaggatgtatttcccagtgaatgatgttagaacaaatgaccatatgagaaaagacagtaatcccccactacatacaaaaacatgttccaaatggatgaaggatttaaatgcaaatagtatacttctgagatttaaatctaaggaaacaaaaaaaacaagattttctgcacaattccattctctgcaatatttactgcaatagcaaaagacagggacattctggatgataggttaataagtaacgcaactaaattacagtgtagccatataagagaatactgtgcaaccgttaaaaagtgatatagatctttatttattgacacagaaaaaaatgaaatattatttaattggaaaagcaggttacagaacagcaattctatttaaaggggacaaataaaacaatgtatttaaatggactcatttaaataaaattatcgagttgtgttagtatgcatggaggtgcccggatgaacatacatcacaatgtgaacagtggtcatctccagatagtagaatttcagatatgtttctttccatttttctgacagtttgaattttctgtaataattaattgacttttatacaatggaaacaacttttttgttttggaaaaaagaaagatgctgccgctaatcagtggatgaaagtaagtgatatagtttattttacatagacgctgatgaatatcttgttccctgcttaggtgaactggggctggatagaaaggcagtgagacacaaggagaaacactaagaatcagaagagtagctccatattacatgtaggacaatgcagctccgactttaacatgtgttactgtgtggaaaagacctgcattttttatagagagcgcttatgtcagaataggaacaaagcatttaggatctaatacaaagcttaaaaatttaagaggacaaacaaaagcttccagatttcaaacaatcagccaaactataaggagtggtgtctagaattgctttgcttttcctgctgcacatgcatttttaattaaaataattgcatgagaaaggcaatctccattctgtttgggctgaagctcccttttgggctctcaaaggagtccctttcaaatcatattcttttccatccccaaatatttttcaattatccaagcctaagggctttcaggttgctaaccatctaaaaatatgtcaagcaactttaaaaagtaaattgtggtgagtatgactcatttaaggatgaaaaatctaagtggacatcaagatttttttttccaaatttgattttaggaagcaatttcaacacttttttaaaaagattcaggaaacagttatcccccctttcctctacttttgcagtgtggatgctcctttccctggttatacaattaaacctcgttgctcctatcctaaatatcataaaatctgaattagagaagtctggtcaatgaagttttattgaattcaaaatgcctatcttttactacttgaagcaaaaaacatactttcagcctttggggaaaaaaaaatcagaaaccaaggaaaccactgaccttttacttattataaccttttatttgtttttttgctaagtagtgtaaatgctagactgagactttacatataaattaatgtctgtagaggattttttaaaaaactgaagcagtacttctgagagttgacacaatccagatgattttttagggcattacataatcacaaacacctggagaaytgccgtgggtggctgacgaattgtgagtgttatgtttaaactcaagagttgcatgtgtctaattaagtaagaaatttgtaatctgaaacaggtgttttcttaaagcacttgacgtgcttcttggtcctgcttcctcttttcctccttctaattctttccgtgggtctttactaaatatttttgcttccttgtcagttcttatttccttgtgtgtttgtgtttgggggcagaaagacaaaacacacaatagtgatgaaagaaaagtgtcacttgccatgtgaagtttaggaaaggtgtacctcaaggagctataaattaattctgaagaattacaacgcaagagataatatagtttgttgtttctttctggctggtatttagaaggcagagtctgagtacctcattcagtgtttgggaataagatgcaagacctgttctttaaagcaaaatgtttatattacagggaaaactatgttttcctttaatttccatttgctttaaaatggtggctgttttttttttttttttttttttggctactagtggcttggtaggaaaaagagaaaaacaaaacaaaacacgagttgaggtcatggctgatgagagatgccagcaaggaacatattgcataatagaagctgctaactggtcttcaaggatgtctgaatccatacaattaaggactcaagttattttacaaaaatgttttcatgacttgagtagaaaccgggaaaatcacccaattgactaaattgactcacccaatcccaaccccacatacgcaccttcacaagttccaaaaggtggttttaacaaaaaggaaaagataaccaacacggttcaggtattcggccaatggataaatccgagtattttaaagctctaccaggtcctgccttacatttccctgccaccaccctgcagaagcaccagtgcttcagagactcccgccactctgccccctgcaggtgtggccctgcctccaaaaactacaccggctttggggctctggtgcaaacctcaggtttgccatttaccaggtttggtatgcagggtgaagtcccttcacttcttggaggctcagtctcctcatgtacagcatagacctgggaggtgagctctccgagagtggtaaggactaagtgagtaatgtgtgcaaagcacctggcccataacaggtgatgggtaagtcctagagttggcacagccaccacagctccgtgggcagagatcccattcgtggatcttcattcacgcttcctggaatagttccccctaccccctccaacagtctcatagttcacctcctcgcttcactcaggcctctgttcaaatgttactgcctaagaaaggccacctccaaccagcccatctggtctaatttatcaatcaattctgtatcctccaaccatggtttgtttcttcttcctagctttttcaccatgggacactatattatgtaattatttgttattcatttattgtctgtcttcattaagagaatgtaagccccatgaaggcagggacttttttaacttagctactatggtgcctagcatacagctggcactgaagatttgttcaatgaatgaatgaattgatcaatcaatcgatggatggatggatgaatagcatcttatatttgcatagcatttcagcatttacaaagcatctgatcctggaaatatgtgatcacctatatattactgatgaaaacatcgtggcttagtgagattaaggttacagttaacaatagcagaacaaagatctaaaacaacattatctgtccctgagaataaaactactttcactcccccacccccatgctgcctcacaaatgctgacggcatattgccagtaacgtatgtgctgggagcacagggcttgtctcagaggagaaatcccatgacaattgcaataggagccagaactgcagggatttcacacaggtaacaaggggactttgccaacttcaatggcttcaggcaaactggctatttcaggcaaagaaagggtcctactgctaatatacacaaagctgaaaataggcctcatgatttctgagtgaagggagtaggtttatggaagatcccaaagctacaggatcctgagatgaggtgatcatgaaatccttctttggtgtgggtatcaaagagttctacctaccatctaactacaaagaaaagaacaactgacttatttgtctcttatttttttacgttgttcccattctcaagtctcccaaacctatttttttctttcactctgattaaaatttctgacatggacatcaaggttctatgataatcatattcccaaacctaactactcaaaagagctgaattacaaactccctcagaaacttccagctgcttctagaaccccaggaccaggcatgccccttctccttcaaacccagatcaggaataaatgttttggggaatctcttcagacaagctatgcctgggtcgccatgtaatcagcagcccaacttcttaactggcaccacctacatctggcaaaactgtgctcaagatgttcatttccattgttttaatttccatgttatactgaaggggcctgaagggaatggtttgctaacttctatgactacccaaatttccacataaacgggtagtcggaactattgttgcttaagagagccctctgctgacacaaattatgtgtgctcattcttttcctaaaatcaaacctcaccaaaccagacctatgtctcgccaacagatccactgattactaaatatgtcttgtagcacatgcatggcgtctctgcttaaagactgtgtgtcactgtggcaggctgccatctagtcattaagggatcagctatgttgtggcatagagggaagttcttctgcttagtacagtctccagttaaaagttgttaaggcagatgcctaagaatgaagtgcctgaaaacacttgtttgcacatatggtcttgggcaggtttgggactcacaggggtcttacagaggaagaggtttcagagactcatgtcgattttccttttaatattttgttaaaatttcattataacaatatttaattaagcagctgacacctttttatgggtacgttattattatgattccctgattcaattcactgtagatttaatttctcaaactttgagtgagtgtgatcattgaacttgatgttattgggccccaggccccaggattttggacatcaagaagcaataaaacattttaaaataaaggggtctgagagagggatgccaattttttgccttccttagtcttttaaaaataaaagttaaattttggaataatttttaagtttacataacaattgtaaagatagtatggagagtccacccagcttctcctgccattaacatattatataacctcagaacatttgccaagactaagaaaccaatgttgatacactgccattaactaaagtatatcacttatgtggctttcaccagtttttctatgaatatccatttttggttcaggatccatgtcatcatgtccccttggtttcttccatctgtgacagtttctcactctttccttgtttttcatgagcttgataattttgaagagtactggtgaagtattttatagaatactcctcaatggtgggtggkggtgccaacttttaaattcagattgtgaaaggtaaaaattatctactatggtcatcatttcataaaagaaaggccattctaacaaccaaaaaaaggaagaatagcaatatctgaataaagaacagtcttttaaataaaataaatttatctctaggaaaaggcccactactttgctaatcattcctccctcccctttctttttctttctttcgttctggcccacccaagataaaatgtcattacaaactcacaaacaggaagtcaggaatcacctagaaggaacacagtggtcattgcttccataccttcagggagctaccactctagcagaagataaaccactaaaatatgcagacaagagaaatgaaagctaaagagaagtacaagcaaatctagaagaaagattgattgtgacaaagattccagaggaatgagggagtaattcgtggaggaggaatcctcccaggtgggtcttaaaaagaagaaatttgggggaaaaaattaaggtagggtggggagaaaaggtatacagaaagagggaaaaattaggttgtagtaagttataagcgactgaaacatgaatttattatcatgttactactagatcatgaacagtgttgcagctataagaagtaaggtaaatgattgtccttaaatagccaggtacaatcaacctaacccatttcctcattatactggaagttcagaggacaagtgagagcactattttggacttacagataggaaaattcagatccctggaccatgaaagcataggtcccacagtaagtgagtggcagaaggagtatggggtgtttattcatagttttatggtctatgtcacctgcacaatctcatttctaatggtattaaaaatcttttaatcatctgaatgtgtcaaagtattgagaaaatatcagatatatagaaagggaactttgttccagaaggagtggtagcaaaaaagagtggacaaatgtgggcctgggatcatatgggcccaccaaatcttgctctgtatggcctgtgtgaacttcgcaagtcaccgcctccctgaaccttagtttcctcatgtgtaaaatgggggagataacaatttttacttttcaagattgttttgaggcttacaggtaacgtatcaacatatgaagcttctcatatatcagtagttaatactgttgcatggcaaatttccttcaagtttaatccygtgtagtcaggcctgtgattctaagagtctgttgattggatgactctgaagcagctttgttaatagtgtggacaatttgcatgaagctttttatcatttaatgatctatgttaatttactttggacttatttctcgtttcacttgaaaagctttattttatatttggtgatataaaataatgttttaatgattggcttatagtctttattacatttccccccactcaatttttctttctttctttctttctttcttttttttttttttttttgagacagagtttcactcttgttgcccaggctggagtgcaatggtgtgatctcagctcactgcaacctccacctcctgagttcaagcgaatctcctgcctcagcctcccgagtagctgggattacaggcgcccaccaccacgcccagctaattttttgtattttcagtagagacggggtttcaccatgttggccaggctggtcttgaactcctgacctcaagtgatccacctgccttagcctccaaaagtgctgggattacaggcgtgagccaccgcgcccagcgcaccccggccccccacccccccaacactcaatttttctacttaaaaactcttggaatgtagcctttaagacatgaatggtttttgtttgtaattgcaatgtggtgtgggtaggatgtatagggaaatttgttgggaatttatttggactactttcaaagaatatttcagttaaatttctactctccctcatgtgacctacgcttgttaacacagacgaggctttaattctttgctgtgggaagtggcctgtgcactgtaggaggtttggcagcatccctggcctctacccactagatggcagtagcactccccagttgtgacactcagaaatgactacagaaattgcaaatgagtcacttcttgggcttttggctaagatcaaatgtagaaattgccatatgacccagatggacaaatcacctccagttgagaaccactgacatagacagcactccacaaaaagcagaacttttaggctaaagatggttttattttaacgtgattgtgttaagttgacagtttcaggatgtgaaatattgttcattcatctatagctagagatcaagcttgggcttcgaagcttgggccttccccaataatggcccaacctaaaattttagaccctataatactcctccacctcccatccttccacatcccatttgtaagcccgattagatgactcactgtttctactatatccccataccgcgactttcacctttacctccactatccagagagtcaaatcttacttattggttaaggccttactaaatgggcaaattttccctgaagccctcccagatccttctgttagaagggayagcttctgcctcaaaacatgaaacttcttcaactatacccatcttgttcctccttaattattttctaactttcatgcaatttgaaagtcctctgcctccacttctaaactcatgagtgcactcactattttaatatcctttcagctaggcaaygtgttgtggaggagaaagttatgcttttgatttaaggcactcctaaatctcatgcgcccctctaatggtgcacagatgttttctagagaaagtcctcatccccattacacaatggcatatattattagcttatctggttgacaggaatagaacacaggtaaggttcactttatctggagagggcaaacccaagtaggaggcctcagcaagagttcctggagaacaagtgatcatcaggaccttcactaaccatgagggcacagttcatctttaaatatctgaatggctggtatgcgaagaagaaattttgaaaacatgaatttcttaaataattaacaaatacaactgaacattctaaaggtacaaagagaaaaaaagggttcagcgaaaaccaataatcttgtccacaactttcccttgtcacccgctaaccttccctagaggtcacattacaagtttcttggggatcctttcagagataatccaggcaagtctatgaataaaggtgtaaatggaaacaacccaagtgtccaccaatggatgaccggataacaaaatgtggtctatccatacaatagaatatccatacgatacaatagaatattagtcaggcatataaagaaatatatatgctacaaactgaatgaaccttgaaaacattatgctaagtgaaagagaccaaccacaaaaggccacataccatatgattccttttatataaaatagtcagaatagacaaataaatagagacagaaagtgtggttcctaggagctggaggaaggaagaatgagaaaagactgataatgagttcaggtttactttctgggctgatgaaagtgttctggaatcagcagtgatggttgtgyaatcctataagtacataaaccactactttttaaaaagctttgtaaatacatatttgtacctgttatgatgtgttcattttctctttaaacaccatcttctttgggtactataacatgtattttgtaattttattttatttgcatcaggatagtctgtagaaataatcattcattataataatccatcttccccacaataaacttggcaataagccatttaaaaaagaaaaaaggcatagtttttgctttttatataaatgctacactatgccacaagaattgtgcaccttgcctctgtcactttccaaatatcatcaagattgttctatattaggacctatcaagccatgtcattctccttaatgactgcatggtaagccatgctattggacacatatatttaaagtactggttctcagccaggggtgattttgccctctctcacacccccagaggacagttgacaatgtctggagacttttttttattgtcacaactgggtgtaggcagatgcaattggcaccgagtgggtagaggccaaggacgttgctaaacatcctgcaatgcgtggaacagcccccccatagcaaagaattatgcatccaaaaagtcactagttgtggaggttaaaaaaaacaatctaaacagtttatgattgacgaatatttaaattggctacaatatttgtctttatagataatgctgcataacattccatctttcaaatatataattttcttatagataatttctagatatataattattcctctactattttgaatacttttttatttttatttatttatttatttatctatttttgagacagagtcttgctcgttgcccagggtggagtgcaatggcgcaatcttggctcactgcaacctccgcctcccaggttcaaacgattctcctgcctcagcttcccaagtaactgggattacaggcgcctgccaccacacccagctaatttttgtatttttagtggagacaaggtttcaccatgttggccaggctggtctcgaactcctgacctcatgatccgcccgcctcggcctcccagagtgctgggattacaggcgtgagccaccgcgcccagcctctgttttttattttttaaaaactgtaccagaataaacatttgttaataagcctttcttcttactttggatttttcccataaatagagtcatagaagtagggttactgggttaaaggagaataacttttttctagggaattatatcgggttcttactgccattatgaatacgatgctttcccctgttaaaagaaaacttcggacaaattaaatttaacagagtttaacggaccaagaaaaaaaaatgattagcagatctggcagtctccagaatcacagcagattcagagagactccagggatgccacgtkgtcagaacaaatttatagacaacaaaaggaaagtgacatacagaaatcagaagtgaggtacagaaacagctggactggttcaaacaagtgtttgccttgtttgaacactcagcagtgtatgagtggttgaagtatggctgctgggattagccaagacccagctattgttacaggcacatacttctaagttaggttttcaatattgtctatctattaatttaggttatggtgcgtccacaaggactcaaatatagaaatacagagtccttctcaagccatatttagtttgctttaacaccaccattacatctgattattgcttttaagcaggagaattattgatttttcatagttattttatatccagccatttactaataggttttggttgacattcttagtacagtggtgccaaggggtgtcttgagagtagaggtggctttagcttccttcttatatctgttaccttcactctcaaatcatgccaaatgaatatatatgctaagatttgtgtgcttcactgtaatcacaacttcaggacaaatcctgagccttcctccctcctccagtcatatcaacaaccaaagccacattaagccactgtgagtttcattcttattttattacctacaaataatttttctcctcctttccaacactgtaactcttacttattaatagcttcaaagtttccagaaccatattaaactgtgatggtactggtagacagtcttgtcttctttctcatattaataggaatatagctaatatctcagtgttaaatataacaaaagatgctccctgaacaatagagagtctttatgatattgaaaaagtatcctttcccggttttccaaaatggatgttgaatttaatcaagttttttttttcagccttgatggtagggtttgcttttgaaagtggtgcacagcaagctagaaaaaaaaaacaggctatgtgggaggtgggaggtttgaatcgggtcataagttttaggtgtgaatcaccaggacctttcccttcctctcctgggtattgttcaggcattgcacgcaaacactgtcggctaccaacaagtaattatgagcgtggcttttctgatggacacacccttggaaacagggtggttttgttctcgtgaacaaaatcaaagaacttgctgaggcttgtagtgaaaaaattttaaaaacacttctcagcctaactgagaacacagtagacaaggccatcctaaaatgtccctgaaaagcaggcaggatggttttctcctaatagttcctaagtttaattaaacaggagtgaccagtcatctcagtttgctaaggactgagaggttcctggggacaggagcctttcagtgctaaaacctgaaaagtccagaggctatcatttaaggatgatttcaaaaggcacaacacatgtttcttcctaaggtaggtgagaggttcatcaacggagtccgatctataagtacctcctttttcgagctaaactttagcgggactttcccatgtctctgattgttctttgtttctgataactgaagttgccctaaacaaatcacaatatcaggcctgaccagaaacagggtaaatgcagaagtatttcaccttttaccactcaggccttttgaaaaacaatcctccccagaaaacaaactcctggtaggaaaaactgaatgcatttctccttttgtgttgtgaccaccagctgtgcctcttccctagagtacgccttctcaattttcaggcaaatttttaatagaaaatatatagctattcaaacctaagagttaagtttaaaaatggcttagccattaacccagtaaaattgggttctctctcttacttatctcatagaatcgtatttctgatttggaagatctagaccagcatttctcaaattttaatgtgtatatcaatcatttgatgatgtagaaatgtagattctgatccagagctctgaagtggagactgaggctacaaatgataacactgctggttcatgggtcacacctgagataatgagaattttatagaataatattttccacatttctttgatcatgtatcactaccagttaaaataaatgtgagtgtgcactcaaaatatgtatattagttacattttatactcatgtgttagtaaaatttcatttttattaaaaaataaataaatgggagctccagcacatcactattttgaggaccttgatcctgataacacatcaagtatgtgaccattcagtacatgcttatgttgttccagtgcatgcttatattagttattctatctttgcataactaattgttacaaagttcttccttctattttgtatctatgctttgtattcaaaagtttacctctgaaggcatacaaaacaagcccaatccctcttaacactattgcaattcctatcactgaaaatgatctgacttccttaatatatgaagaccttctataaaataataaaaagaataccagcaacccagcaggaaaaaaaaaatccaagaatattaaatatgtatggtgaatgaatgttttaaaatgaaaacaaaatcaatctcgctcaaataagagaaatataaattaaaactatcataaagcattatttttcacttgtaaaaatggcaaaggtcagaaaagtcgaataaatacatttatgttgctgatgttgagggaaaacaggaaccttcagaacacatcactgtggtgatatcagttggtacaaccatcatggcagatgcttaatgaggccattaaaattagttttttaaataatattttttaaatgcttatagtataatactaagctaacaaaaagatgcaaaacatagtgtggtaccagaaaaaaagtactgaatgaaaatatatcaaaataaaaacaatagctatttctggatggtgagctaacatcacaggtgattctaaatttgttctttatcctagtcagcattttcaaaatgtacaagcctgtataatttagaaaatgctccagggaggtgatgagagagtacaagtggggctggctttaaatttcagccttttaaagctcacattaagagataatggcttaccacttgagtctctggcttacctacactcctgaggaaaactgatacagttgattctcatcatttttatagaaaaaatgttctatatagttgccatgatcactgaattagagaatactagaccattgctcctaggataaatacaggattgtgttcctgcaagcctctggtcacaatattttgctcagttgatcaatacatgactttgttttatgtttatttctctttaaagacaccttatttaacaaatattgttgattaattaacattgaactctaggccaagagtgttacaactcatacctgaataaagtttatctaagacagatattttctccgtaaggcacatttcagccttcttacacttaggaacactagacagcattagtgtattgtgtgtgggagccattttaaacagtgaaattacccacacaaagcacaaaaggtggacaaagtggcactaaatacactgtgaaaggtcactttcttgtgaaacaagaaaaaaagagcatcgcttcattcaacctcagctgggaatgtgtgcattgggcagctcaaattttttgccactctacacatgcccacaaattactacaaaagcaccacaggtactgatttgggggttacaaatgaattttagsaagtaaatgaactgacaaataattacagttacagttttaaagaaaattcttaaaagagccaaacaytaatattctacagctgcactccttgagggagttgcttaaagctgagtaccttataatttataaagtattccccccccccmagaaagcattttccataatggaaatcaaagtaatatatttaatcattcattttatttaatatattcattgtcttcaactttttattatccaattaaattcagccagtagttactatctccacayagagaacacagagaatgatctcagctgaagcaatttatgatcctcttgggtatgtgaggggaggttgaggcaatccccaattctaatgcaagacagatagaatacaatcaaggtcatcaaaaaggcataatgtgcatgagactggtaaaaatataatgcgatgaggaccaaatgaaggagaaagtgcatcctcttgggattgtctgcaaaatttgatggagctggtgatatccgaaaagaccttgaaggattagtaaggtggtaagtggagctatgggatggagcacacaagaagtagctcgagcaggagcacagagtggagacatcttccaggaacagggtcagaatccagtatgagtgtagggtaggtgaaaggaatggcttccattattgctgcaaagcaagccacagcgccttcaacgtgttagcagagaagggaactggaaggcgaatggctaaaygaggaagggaaaagagtccaactaccctgatcctacttccagaaacttcttggttcattatccctttacactgtggtggtgccctttcccaaacatctttaacctccttaactagactgcatatgaggcaagcagggatcatgcctcacccttctttagcctccctccctctgccttctgctcacacttcccaacacacaacacaccctaacatacaaaagatcaccctacaccaacgcctgcatatcgccagccttcaataaatatttactcattcactaattgggtttataaacacactgagcctttaacaagccctggtctcttccctactaatgcaggttgttctggtgagtagatggttaaacattgtaactaggaagtaacgatccctgagcttccacagaatatatgtgtgtggacaatgagaatctttgaaagtgccacaatattatgttacacattttatttctgtatctaactaaagctgaatattaagtgttcagtagaatctctaaattttgcaattaaactagtaaatgtatatgtatgtccttaaaatcctaatttttaggctatgttatatttgggccccttgattctataattccttagaagttagtataaatactcttgtagttcttagattgttttttggagtttataatattacaggaggttacacacatctgaacattcttggatagaaacaagatagaaacaggtttttttctttctttttttttttttctaagacaaggtctcactctgttgcccagaatggagcgtagtgacatgattagaaacaggttttctatataaaaaagtattttaatcacaaatagtttattctatccccaatgaattattttaattacaaaaatattttaataagccaacttattaactgcacaaataggaatgtttttggtggcataaattcaaagaatactaaaaacagtaaatatttaaatttgagtatatcttatgtaaaatagcctgcaacttataaatgaatttttagcctattatttattgcttttaaaattgaattttctattagaagaaagaggtatgtttcaaaatacacacttctgcagtcaaattattgtacttactgtttcaaaacctcgatgtggatgatcaggaaatcctcctggtctacctcctttaaattcatcaaacagtaaaaacggatccagattttttaactgaaataaaaataaaatttgcwgattagatatgtcttttaagccatactaccaggggctacatttatgaacagatctagcaagcctcattgaaaactacatagccaatgggcaactttttacaatgaaaattgctttcaggaagaacttcttatacacactgatatggtttggctccgtgtccccacccaaatctcatcttgtagctcccataattcccgtgtgttgtgggagcaactcagtgggagatgactgaatcatggggacaggtctttcctgtgctgttcttgtgatagtgaatgggtctcacgagatctgatggttttaaaaatgggagtttctcggcacaaactctttttttttgcctgctgccatccatataagatgtgacttgctcctccttgccttccaccatgaatgtgaggcctccccagccacatggagctgtttgagtccagttaaacctctttcttttgtaaattgcccagtttcaggtatgtccttatcagcagcatgaaaatggactaatacacacacacacacaaggatttacggattgtgttagagagttgtcattttatgagaagcgcaaagagtggacaaacatttcataatcatctaagatataaatagtcaagtataaacaagatgtattctgtatcctaaacagattcataatcttacaggggaacagactagaaaatcaattattgcaacaagatgataaatgctttggaggaagacaattttacacatatgagagtgggaagggatcaaagaaggtcagaaaactcaggaatatggcacttaatctctgtcttgaagtacatggttgagttaatcaagtagatgggagaaaaagagaaggaaagatattccaggtagaaaagcagaaaaacagcttggcatgcttgaagaactaagggatactaatctgttggggcaaaagatgcatatggaattatgagatacatgggcagacgatggaggacaagtcctaaatgagtttggattttatcctgaaggtgatgggagttttcatcagagtttgatatgatcagatttagaaggatcactctgtggtaaaggaagacaggaaacaaagaatatctagaaggttatctcaaatagtctgagcaaaggcaaaggccagaactaaggcaatggcagtagtgatggagagtggttgagtgactgggtagatatttatgagacaaaaaggaagagcattaactgactcccaaatttttaactatggtatctgggaagatggtagggccattcagcacttaaagaacataatagaagaagctgccttgaaatagctatgatgacttcattttaggtcatactgaatttgatatatccatataaatgttatctgtataaatagaactattaagtgcacattatattatgcaaaggctagcagacaactaaagatcaatctcaagctcaaatgagaggtagaaacatatctggttgtcatcaacatatgtttgtgattgtcttgcttattcttgaccatgttattttatataaattttaggaaatttatcaaattctatgaagaaaaattttgaacatttgattggaattagttttaatctatggatcaaattgtgaagaactgacatttatataatatttagttttcctcaatgtttcctcaatagaaccatggttatccccatttatttaggtctttaaacatatttcaataaggatttgcaattctctccataaaggtcttacatatttttaaaaattatttttctagctaacttgtatttttaatggaattctactgcaaacagcatttacacattatattttgaacagtttgctgctggaaattagacatgcgctaggcaatttttgaaccctgctaagctcttattaattttaatgattcatctgtagcttcttttgggttttctttgtagatgttcatatcaccagtgtatttatcaataaacttttgcttaatagttcacacacaaaaaaattgtcttgcattggattaaagccgtggcagactgcaatttctctgggtttttatgggcctggctggccttgacatgtcttctcactctgggattcaagctgaaacagcggccactatggagggcattatgttctcatagccaaggtcaggagcaaaaagcaaggcaagtcaaccattcacaatcacattaacacatcccattggtcaaagcatgtgacatggccaagcccaaagtcagggaggagggcacttaatcgctccctatgtgtctcatgggtaatgtacctaaaaatggatgcgggtgtaaaatcctattatagagaaggaatgaatatttggtagtaacatttcgaccaacaaccattagcaaataagaagggatttttttttcattttcaatcgttatattttccatttctttttcttgtatttttacaagcgagcatctctacaacagtcttgagtagaaatggtggtggtagacatccttgtcttctccctgattttacatagattgctttataaagttttattggtaatctggttgtttaatgcaggtgttttatagattcccttcataaggttaaagagtttcccttctacttctagtttacaaagttgttgttttttaaacatgaatggatgttgaattgtcgaatgtcttctccacaccattgagacacttatatgattttttctcctttaacctcttaatgttaataaaatacacaaatagattttctaacattaaaccaaatttgctctcctcagataatccaaatttggtcatgatatattatcttttaatacattgttgaatttggttggttaattttctatgattcttgcaaacattctcataaatgtgatgtaattattctttcactggctgtcctcgtctggtcctgatagcaaggtaatgtcagcttcatgaagtgatttgaggagcacttccttggattttatcccctggagagtttgtgcattattagaattacttacaccttaaatattttgtaaaatttgtctataaaatcttctggtcctgctgtctttgttataaacttttaaagtattcattcgattaccattatggctatgaaactattcagattttccattttttctttctttcttattgttttatactctaagagtttcagcaacctcttggcagctcagctaattaattttaagttatttatctcaggatgtctactctgtcatattactagaaattaaagtatgaaactttctcattctccggttttatctttattttaactttctatgaaaaaaacatgcacacatatatacataacatatacattatacatatatatataaattcaacaagctactgcaagttttttaacctaaccaattctcaatttcttcatttgaaaatgtggactgcaacccatataaagctggggcactttgtagcctatctcaacctggtgtttcatccagtccaatatttaaaagtaattgaaaataaattcaaattatttattgaatcctctcaaaaacaccaaaagaggcttcaatttaaagatatgcttaaaatccctcttacccctctccatgtatatatctgtctcccatgattccattttctctcactctaactcttcaaatcacttcaaaccatcwgaagacacctctttccttttctcctctcctctcaccttctgtatttactcttttctcttccactagtaagtctctgccctttccagtgaaaatcaaccaagcaaatttgtttcctttcagtcttgtcattcatttttccacatcagcttattaaaagtccaggaacagaactgggattggtagraggagaggttgagaattctcataccttattatacattgctttctcctcacatgataatatataccttggaagattataaggattgaaaacaatgaatgtagcacacctggtccagtgcccaaagcactgtaggttctacatagatgggtggtatctattatactgcaccagtcctataaatatcacagccatcacttccctaggtacaaaacaaagtgtttgaagctctaagataacttttaaattctgtgttgttgtggttctattaaaatatgggtaaagacaagataaagaaatacttattgtttctttgtatcgaagagttttatatgagcaaatatgccctgctgtcaaactgtgaaaaccaagaggttctctctttttagtcctacccttatcaccatccaccaccctcagaacagtagttattcattgttatcaagaacttggagcactgatgtaatgaatacctaaaactggaagtagccttggaactgcttaaacttaaagagtagaggctggaagtcttgaagtcatgctagcaaaagcctacattgctgtgaatgaactattaaaagcaactctggtgagggcccagaaagaaaagaggagagcggtagatacagtctcaattttcttttttttttttttttttttttttttgagacagggtctcattctgttgcctgtgttggagtgcgatggcatgatctcgactcactgcaacctctgcttcctggcctcaagcaatgcgcccgcctcagtgccccaagtagctgggactacaggtgccagccaccatgcccagctaatttttgtattttttgtaaagaygaggtttcaccatgttgctcaggctagtctcaaactcctgagctcaagtgatccacccacctcagcctcccaaagtggtaggattacaggcatgagccactgygcccggcctcaatcttcttaaagaatacctaagtaatcctgaacagattgttgtagaaatatggacagtaaaggccattctgatgaagtcttagacagaaacatgttattgaaaactgaaggaaagattacccttgttataaagtggcaaataacttggctgaactgtgttcatatcctagtgttttgtggaaggtagaacctgtaagcaatgaaattggatgtttagctgatgctatttgtacacaaagcgttgagagaccgggttcctcttgayggcatatagtaaaatgcaagaagagagaaataatttaaaggcagaattgttaatcaaaagagaagcagaacttaaagatttgggaaattttcagcctacccatattataaaaaatgagaaacatgttcaggagaaaacaccaagggtgtggccaaatgaccatttcaccatttaataaggagccttgtcagccatcaaaacagaaaccaggacctattgttcaagacaatggaagaatgatcccaatttcagtgccaattttctgtcttagtctgtttgagttgctataacataatactataaactggctggattataaacaactgaaatctatttcccacagttctggagactaagaagtccaagattaaggcaccaacaaatttggtgtctggtgagggtccaactttctggttcagacacagtgccttctggctgtgtcccacatggtggaaggagccagctagctctccagggtctcatttgtaagggcattaatcccattcctgagggttctgccctcatgacctaatacctcccagaggcctcccctcctaataccatcatattgagtgttaggtttcatgataggaattaggagtagggaagacacatagattcagaccaaatcagtactatttgtcatatttattgcccatttgatccttctggtcaccaatccatgaaatatgaacacacataggaagaaagccagcacaagaaagagactgaagaagctagggggctgattgaggtaagagtcagaaggatgaattgattatcttgccagaaaattggtgatatgtgtaagacacactttccctccaaaaagtaagaatatcttgcattagactgttgtactaaagtgttatttgcagtactgggtattagtcctcgtcaaacttcctaacattctctaaacatttagcaggaattcaatagcatgtaaaataaacatgtgttatcggtagacaagatctaatttacaaaactctgatttttctaaaatgttttcactaagtccccaactcattcacatctttctctctctacatatcaaattgacaatcttttaacgtttttgagccacatgagaatttcttttcattcaaatagttctaaatcctttagctgctgaattcaagtggcagcttccaatctacttcttttagtctcttaaggccaatcaggccaggcgtggtggctcatgcctataatcccagcactttgggaggccgaggcagatggatcccttgaggctgtgagttagagaccagcctggccaacatagtgaaaccctgtctctactaaaaatacaaaaattagctaggcgtggtggctgaggcaagagaattgcttgaacccaggaggcagaggttgcagtgagccgagggagacagagtgagactctgtctcaaaaaaaaaaaaagaaggtcaatcaaaacttgtggccaccacccctcaggcatgtggtactcccataataaagcctggaattttatttacaacaggaagcactggaagtagctagcaagaataatagttccttgaggatggggccgatgctatgcttttttatgatgctccactgaacttacaataattctgtgtacataaaaggtactccataatatactgagtggtacttgttttaggtccatggcatctcttgtagctagttgtgttcatatgattgaatctagctacaacgtagaagttgcagggtggaacttttaggaaaattccttataagaggaggatggacasmagatgagtatcattttgcccttcccctcttcctcctttctttgccagagggtaaatggttgccatttccctaacagctgtcttggactataaggcgatgcactaagaatgtactaagaattatgacctaggatagaatgaacacaggtccctgataagagtggaaggccaccctggagtgcctattttggcactttacaaaagagaaacaaacacttatgtatatcattggttttggatgatgctttctgttacacacagttgaacctaatcctaactgataaaagggcaataatgyctatggtagtagccaagaatcaggtgattctaggtcagcctacatcaagacaatacgggagcagctgaaggaacaggctcctcaagattgactccaacacctcaggctaccttctggrtttactcggcctctagactggaacctggggataacaatgagaaggcagaaggaaactgcagcacatatcctagacygagatctagatacagccttgaatggacttgagctgtgactatatggcccacttccttgattcaatatctagagaccttgataatgaaaagcatcatctacagaggctaaatcagtgaagaacaagattagtcaaggctatttgatgatattaagggatttttaaaatttttgtaagtatgataatgagattgtagttttttttttcaagttatcttttagagatacaaattgaaatatttataagtgaaataaaataatggctggaattctcttcaaaatactttgaggggagaaatggatgataatatggatgaaataagactgccatgagttgatcattgtggatgcaaggaacatggagattcgtcatactatttctctacttttctatgatgattgaaattcttcattaacaaaataaaaataagagtgacccatggagaatcacattacaccgaggagtgtctggtagcaggagtgggcatagaagcaagtgcagattagtagtggatttccctcctgctgggagcacagaggaaccactccctagcacctatgctactcagccattcaaattccagtctggctaggctggcccatgtataactgtgatgaagggtgtgggccagccccactccatctcttccttgttattaaatcacagaaaggctcagtgagagcattgtatattcctcttctatctccacatttgcagtcaaaggagtcaaaacacttgcggctgtgaatattgagtgctgttgtagacactatgctaaaatagctctgggtccaaagtttatgagatatttctttagagacagaagctttggtgcagagtttgaaaaataacctcttggtcgggtgcagtggctcagcctgtaatcccagcactttgggaggccgaggtgggcggatcacctgaggttgggagtttgagaccagcctgaccaacatggagaaaccccgtctctactaaaaatacaaaattagccaggcgtggtggcgcatgcctgtaatcccagggacttgggaggctgaggcaggagaatcacttgaaccagggaggtggaggttgcggtgagcygagatcatgccattgcactccagcctgggcaacaagagcgaaactccgtctcaaaaaaaaaaaaaaaaaaaaaagaaaagaaagaaaaagaaaaagaaagaaaagtaatctcttgatgttagacagatgctttcattctctgctgatgggagggttagggagtctacctttctggcaagttggtagtatgtagagtgcaaaaataatatggcaacaatctaaatggtcaaaaattcacgagtaagagaataatgcaatgcttatacatgggatatggcataactattaaaatgatgtttatgaagaatttataataacatgggaagtccttatgctaccattgttaaatgaaaaaaattggaacataaaattgtttgttctatataatcccatgatgtaaaatatacaattatatggaaacaaacaaaaagaccctttgtctcaacagtaattaaaccaggctgatgggattaggaatgattcctatccatttatttttccttagggtagagtcatacctggggtacaggagatctgaatcagtaaaatatggggatctgtaaagcataagttatcagccatggacttttacctggcaccactgatagaactcagargggttgtaaacttggactgctaaaaagttatatctctattgtcactaacctctactaatttttttgttttttttttattgtggtaaaatatacataacataaaatttagcattttaaccatttcaagagtacagttttgtggcattaaatatatttacattgtacaaccattaccgtcatctctagactgaaatttaacttcttcaattatgaatgtagtcaatgcaccacagtaaattaccagtacctgtgactttgtcaccaattgaaatcaaagttattttcatatcacattacagttgttagtagatatatcgaaatattgttcgtgttcttcacagctttgaaattcagcagttactagaactgccaccaaatcgtgttatttaatgtaaaattaccagattatgaaatagtttttaaaattgttcttaaccatgtttcagtataaaagttttccttggtaatcctatatattttattttagtaatcctatgtattttattttatgtattttaaaacattgctttcagaagaaattgataggtttcatcaaactgccaaagggattcacaggacaaaaacaataaagaaattctcagcagatgtgttcctgacagatgggctaattaaagtgttagttaccctcaatatataatagtggcttagtaacaggtgtgtttggggccccaaaattctttccaattgttctattggtgatgtagcctagtagaatatgataccaactccatctgcatctccccaacactccctgtgcatttagccattagaataatcttgtttgcaggtatccttcagaaaacactgtttgatggacctcaaaagacattcaggtgtaaacaggaagctaactggaaagagaaatggcctgatggggctgatggagagttgtgttgacagtttttcctctgcctcagtggccaatcaacattacgctaggtgaaataagccaggcacagaaagacaattactgcatgatctcactcatatgcgaaatctaaaaaaatcaaactcacagaagcaaagagtagaatggtggttaccccggctaggggatgggaggatatggaaggagagatgttggtcaaaggatgcaaaatttcagtcaggaggaatgagttcaagagattcattgcacaaaatggtgactatagttaataacaatgtatactcraaattggctaagagagactttaagtgttctcatcacaaaaaaataagtatgtgaggtaatgaatatgttaattagcttgatttagccrtcccacaatatagacacctatcaaaacatcattttgtacatcataaatatatacaatttttatttgtcaatttaaaacataactaaaaaaattgaacccatcaaaaatgtagatcagcactcattgaggaaggccaggagttttttaaaaccctataaatacatttcaaagattaaaaagttgagaaagtaacccttttaaagcttaagttgagcaacaaagtagcatgaaaattatcagagtagagtttaagagggacaaaccagtctcacttttcaaaatggaatccatctctgtaatgtatttcttctattagaaaatgttttggggatctgatatggtgctaggggctgtattccctgggctatgaccaccatctgatacctttctgtgcatataagacttatttcccccacaaatcccaaatttcccatattcaaatgaaaacattctctaaagttgaaagacatctacctaatctataatcaccttctctgagagctagacccatctacacgtgtccctcaccagacgtctacagagttgggtcccagcagtctctcagtgaatctaaatccttggcaacggcagattggccagcagtggaggcctgatctatgctcaaccaatcagattctctctcctgggaatttggaattgagaatcagagttactccctggtgctttgaagtgtgggcaaataaayttaggggctgtgtggtgggcatgtttggcgatatgcatgctgaggcagatagcatgtcagcccagggtggcacrccagtgtgcagagagaagcagagacatttcctgaagctcagctgcactttctgcccaagrcctctgtattcacattacagaaaccccctttgggctggggctggtttgcccccaattgcaaactttaaagtttgcacttatgcactccacaggccagctcacgactatcttggccccctcttcccaaaatcaccatcaacatcccaccagtcccttctgaaaagaaaacaaggagcagccacccaactagcatacctcgggtctgccaatgcttctccggaccstcgctccaaccccttccgactgctcccggctgagcactgagagagtaactttcttggaggaccccatatcggagtctaaaaagagagtgttctgatgctgagctgtagaggatggagggctaaaggaaggacaacaaaaaaaaaagaagtcataaaggagggaacatccaaggactacaaaataaatgatattaagattagatgcgcaaaatagtagcagctacaatttgttgatgtcttactatgtgcagggcctgggttaggtgatttaaaacaaccataatgatggtgaacatgtatgcatacctactaggtgcccagtaccccaccaattatttacaactatctcatgtaatcctacagtaatcttgtgcraaggttagcgayacagtcatgtgcctgccacataatgacattcaggtcaacattacacagtcaacaatatatggactgtatgtatgacagtagtcccataagactataatgccatatttttactgtatcttttctatgtttaggtatgtttagatacacaaatactcaccacggtgttgcagttgcctcagtattcagtacaggaacatgctgtatgggtttgtagcctaggaacaataggctataccatatatcctactacacacctaggttataccagctaggtttgtctaagtgtactctaagatgcttgcacaacgacaaaatcacctaacaatgcatttctccgaacatatccccatcgttaagtgaagcatgactttagcagctctgttggccccttactaaaaatctccaatgaacactttgtctttcttacttcactgaattctctcgatctcccaccccttccccagtgccactcatctgtcagcctcactggtagcacccatgaggtagttgctaccaatgaggctgacagatgggggcaggtttgtgtggcgccttagagaaaatggagaaaaacaaagaggtccctaactcttaccagaacatgctgaagatcttggcattaaaagagatcttcgagggtcattgaattcaaagacccatctattcctgaagttcagggccaacattttgggcaagaaatctttcagcttactcatgaagtctcctagagcataggcaagtcatggaccagctgttcttggcaatgtatctcatatttcaggacttacctatagccagagtttgttattcgaaagtcttttcctctttgggaggtctaggttctaatggactatcccagaaggaatataatctatccctattccacttcaagtgtttgcagacagtacccccaatcccttaaatcttttcttcaagtgaaatatacccaattccttcaaagattcctactgaaacgaagagaggtgctttggcaaaaagcagactctggaaccagacagcctaggtttgcatctcagcttcaccacatatcagctgtgtgacctgaggttttctgtggctcagttttatctgtaaaatggaatgataagaccgcctacctcaaaggggtgcagttagtgctatgagaatgttagytgctgttattcagaagggctctactccacaataccctccacttagtcaaggcctaccctaaaatgtatcctccctgaatagtaatcgataaatatttattgggtgataggttgcaaggcgcagaaacgagcttaatactcaaagcagtacaggccggtcatcacctacatcgaagcaaccagaaagtatctttatccccatctagattatgtctgggtycttccagactcctacgattaaattgtatgcatgtgaacaactgatgaggtacttagatctcagtgctttgcagaaagaaaagycgtctaccattttcaccaaatttcgtagtacaatttaagtatctcttgttatctcccctaggagtctaaagtgagctggggaaggcaggattttgcaaactgaccgccagcattccctcacctagtggacccctgcaggagccccaggtactcacgctgcggtagcggcacctggagccttagcggcgggggtgacgcgaagagccgccgggagcgagtgcagggagggcaggttaagagagtgtgggtccagtmgcctcaccgtgactcagcgcttcgcggccggcggcctagaggaggcgggaggcgggagtctacgggtctcggaggccctggggctccgccctcgggaatgtcactccactctcgctccgccctacgcctctcccaggccagcttggcggccctttggcctccctgcctctcgtgccgggaagagatgctcactcgggtaatttaggcggcacttgctgtgctccaggaggaaatgtgtggcccgggcaggtgctctgatcggcgctccggtcggtcttgtgggaaatctgtttttaactgtagtctccctgtcacccagccggcggagcttggcggcacggattccagtgctgcctccaccgctgggaggcaccacttgacatgacctgggacaggtggctcagtctctctgtgcctctggttcctcctctataaaatgaggatggtgatgataatagtgccagccttatcgggctgaaatgagaattaaatgagcctgtcacattctaagcactacagaatcgtttgttccatagataagttgcctgctgtttgtcagttagaattgcgagaaaaggagtgcgggagtggggacgggcagccatacgtctttattcctgcctgaagagaaggcacactctagtggggagataattggytaagagtttgtatggtgttggaacacagtgggcaggcgttggagagtttttccagaagaatgaggagctggcacaagccagtgaggggatctagttgattactaggattattaactagtggtacaggcatagctgcagtttctattctctaaacaccagaaggctcattgcctggttttgagaaaggaaagacagtggtgtctctaaaataaggttggaaaacyttgtctgtgaaggaccagatagtaaatactttgactttgcaggccatgtacattctccagtttgcctttgtagcaagaaagcagccatagataacatgtaaataaatgaatgtggctgtagttcaataaaactttaattatgaatactgaaatataaattcataaaattcatacaattttgagttcatataatttttacttgtcatgaaatattatccttcttttgatcttaaatgtaaaaccacttaaaatgtaaaaaccattcttagccctctggctatacaaaaataggtagtgggctacctactcattttggctgcaggcctagtatgcagatccctgctctaaaagaacaggttagtagaggaacraacacttttctctgggcttttaaaatatcagtggggcttaaacccgtcctcatcaccttacttaggcrgttcaaggctagctgagataatacacatgaacattaaaggtgctatggaataacaaagtattgtttcttatcgtcattgtaactagttctgcaactgtctcctctacctctgcagctgtaataggtgtactaggagtgaasgtttctcctctttgtctctcagaagccagttacaggtaaaagctaagtccaaggttgtacatggttagagcaatgcaggaattccatttacaggcccctgcagaaaaaagaaaagaaaagaaaaaagaacaagtctgaaaaggtagaagacttaaaatgaggagaaacaaaggtgagagagggaagaattcttacaaatgaacaaagggcgtataatgtttcactgtaacagggtcctgttttgagatgagaaatgtgaccctgtatattaagctttgagcacttttcacactgtcattgacatccagatcaagatgtggagtaggtggctaaatatrtgagtgtgtagatggactgttgatcacctttggaatcttgggaagcataaagaaaactcatgctgatatgacaatgaacaaagccttccctaaatgattccaaataacaccattataatctttaaagacaaccacattatttaggtaccttgactcttttcttttttattcacgaattccattttcctcctctgtaaaacttattgaatttcttttcaaagatacatattatagaagtacatggggccaggcgcggtggctcacgcctgtaatcccagcactttgggaggccgaggcaggcagatcacctgaggtcgggagttcgagaccagcctgaccaaaatggagaaaccctgtctctactaaaagtacaaaattagccaggcgtgggggcgcatgcctctaatcccagctactcgggagactgaggcaggagaattgcttgaacccaggagacggaggttgccgtgagccgaggtcgtgccattgcactccagcctgggcaacaagagtgaaactcagtctcaaaaattaaaaaaaaaaaaaaaaaagtacatggacatctgaaacacttccttatttttgtttctttcttcttcaagccatcaactcaaaaattctttcttgtagattttgttaatttgcccttcagggcagtgtagctgctattcattagatgacaaatgtctctgaaatattccatattataaagactcagactcactgaacycaggaaatcaattggctccaagtcaaggactgattattttataaatgctagtttacgaaggccataaatacactgggtggttaaagacatccaaagatatccagaaaagatgagcacatgtgactcccatatccaccctcatgagagcattctgcacagacacggtctgttccatcgaccagtgctctgaccaagaagctacatgtgatcagctgttgcatgaaactcataattgtgtttttctctatctttcccttgggtttttggcagttctccgaaaaaaaaatagcttatgaccctttcctttgagccacagaactttctagaatccatcacaagcaaaatactctcaggcctgaaaggccaattcatctctgaaccaggaaactggagaaatttagatgaatgattcccctgatacttacctcaattaccctgataacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttccaactctagcaccttgtacacagtaaatgaagtgactctctgttgaatggagctgttaaactaaattccaagctgcaagatcacttccaaagctggcaggatgcttccagagtatgagttggtgatttatttctgtgaaggccagatagtaagtatttgagactttgtgagcatacagtctctgtctcaactattcaactctgccgttgtagactgaaagcagacatagacaacacttgacagtttgccaagtagaggataccatcaatgcaaaggccgtggggcaggaatagtggctgtgttccaataaattttattcacaaaaactcatggggctcatagttcgccaactccatgtagaccacaaatacttacctccgactagaaaaacaggagtaagattgacaaaatgccaacagtctatgtaaaggtttcatgggtgacaggacaggacatggstgataacaaaaggaaacaacaaacatttttgtgtctacctccacctcctactcacccatttcctttcattaaaaacagggcagtttgttccggcactgaacctgaggtttgatatgcaagcacccttaggagaggtgacatgttaatcttcaattctagtaagtgtgaataattcacatctgatcccaacttacaagcagattattttagcaccagaaggaatacatgcaggaggtaatggagtgacgtccccaaagaagagatacccatgaacaaagttcaaactgcagagataagctgttggagcccttgtggtcttactctttagtgaggagagacaaataataaaggtaataaataattaaattatgtattatgctataaggtgatgagtcctgtagaagaaagaaaacacagagcagagtaagggagattggagtgctgggtggagggtgaggctgtgatattaaacagggtggtctgcgtagggctattaggaagatgccattagaagcagaacctggaaatgaggacacgagccagtcagatatctgggacagtttgccaagcagaggatactgccaatgcaatggccctggagcagatgttgctcagaatattggaggagtagaaaagatgccagtttcaggagtggtaagatgaagtagaataatcatgtgatgatgttagagacagtcctaggggaccagaacaggggggacaagcgaagagttcagactggagaagtgctaagatgtgacttacatttaaagaatcactctggccactcagtggagaatagactgcaggggcaagagtggaagaaggagaacagtcaggagactagtacaatattccccctgggggtggtggcaactcagaccagtaggtggcagtagaggtattgaaaagtggccaaacgggggtacatttgcggctagtgctaaccttatttcatgaaggattgaacgtttggtgcaagagaagggtaaaaattaaggatgactccatattctttagccagagcaactggagggggagagttcctattagctgagaagaggaagactgtaggaaaaactagttttgggggtgggggggtgggtgtgaatcaggaggtcagctttggacaagttttgacatatatatcagatatcccaagtacagatggacaagttgacagtcaaacataagtttggaattcagggaagaggtcctggctgtcataagcatatagatggtgtttaaagccatgagtcaagtgaattttttaaagtgagagaaaaatacaggtcagccacaagccagaaggactctgattatctcattttctttcttcctctctctctctctctctctctctctctctctctctctctccctctctctctctctctctccttccccctttctctctctctctctctgacaatggattctaccaggttcttttttattttaaaaatgtaagcacaagtaaacaggcttgttcacatcatgaagtcaaattatcccatgccatgtccctttagctgtggcctgctaaaggcttgcatgaacaagcttaggagaaaattcctaaaattctaactgagtaaagatgacaatgcagagtataatttgagtaaatgaagtcatattatcgtaatagcagrttgccaaaagttaggatgtaactaaactcatggaaaatacagagccaaagaaacaggagaagtagcagaggaagtgaatgaatagaataaagtaaataaatctgtgacattttgccttagaggaaaccactcctcccagctgtccttgggtgttttatgcccccaagaagggatggaaatcccaagagattgtgcccaggtgtttccacagttataccgactgtattagtccattttcatactgctatgaagaaatactcaagactgggtaatttataaaggaaaagaggtttaatggactcacagttccatatgactggggaggcctcacaatcatggtggaaggtgaaagaggaacaaaggcatgtcttacctggtggcaagcaagagtgcgtgtgcaggggaactgccctttataaaaccatcagatctggtgagacttattcactgtcatgaggacagcacggtaaaaacatccactcccgtgattcaattacctcccactaggtccctcccacaacatgtggggattatgggaactacaattcaagatgagatttgggtgaggacacagccaaaccatatcaccaactcctccttcccctaccctaagtttactttttattctagaatcgaacttttgccatattaccatatataagttgtgaagtaaatacaaatcgccatgtggaaaaggaaattaactagcagagtgtagaattaatttatttagccaggttgttgtgccactcttgccctgcttcacccttaattttttgaatgactacctactatattcctaaagaatggagagctatttggaatccatcagtgactttaatttgctattagaatgtaagttacactcttttgaattcttctgaaggactcctttcccttcccaaaattctagtttccaaactgaaatattaaaaaatatttctgcaagttatttttcccatactctactgtaattaaaccactatttgtggttccccccccccccacacagacacataagccccttgaagatgtgggctgcctctcttctgtttgctcttgtgtctccaacccctaacggaatgctcagcacatggcaggttctcaaataagacttgactgaacgaattaatagaaatgatgctaattccatgtacactcaaaagaatacctctttgaaagccagtagcttcactctcttctgccaacccaagacttcttcacatcatagatacttacaaataagttacagtaagcaacaatttataagtaaacacagtgtgtcaatgcatgccaaaaggatgattacttttcttggctatccatagcaggacataaaatatgtccttagatttattacagatggccagccggtatgcaccagagaaaatagtggaatgggggaagccaaaagttgtgagtctgtcataatgatgtcaagtgacacactttttcattgcgatctaggtgtaccataccttagcaaaaacaatctattttccatttctggatttcttaataacttaaactatataaataagctccttttccatcatatgaactgttcttacatattctctggccttcctttgtccaaatgttgagttgaagttttcattgcatattctctgtgcactttgcattacctaatggtttcctggctcatgtgagagaagtcagcgtcagcagtcgggttttgccgagatattttcttgtcctttccagcatagagctctacaaacaaaggcagggttatcacatgtacccgagagctgcctgggaaaagtgggagctatagttatcaaaattggaaactttatgaagtatgcttttgtctccgtttttgttgcgttcaatcagatcaacaagtgttggctaagtgttgagcgtggtttcctgtgggattgtgtaaggctctgtaggacaataaacgtgttgggggcactgagtaatgtagccatttctgacccggcagccaggaaaatgtgaaacaatttgcttctggaaacaggacagccggggccgtgttcctgcaacagcagaccaagcaccgcggcggacccaggcaagcacggaacaagctgagacggtgcgtttaagcggcaggtggctactcagtgtcgcatactatgcggaaaataggtttggttcccggtgttgtggggcctgaagttacaaactttgggaagctcactttaagaaaaatagtacaacatttttaatatgaaattgccagggctttctctgggactttagatgggaccaggtaatttggaggccaacggctgaaactgctataatttcactgtaaattcactccttgctcaaaatctcagttagggaagctctcaggttgtttatgtatcaccaccagttctacctagctttgtgtgtattctctgctaattttctccatccgcttctttaggtattgcctttccatagcctttcatattggcctcataactgcttccaaagagacatagaaatgttccttataccttctttaactgtgtttttatgatgttactttagctacaaatatttgctcttaggttcctgaggtctccctaaatcaagtgctttgtgtattttagatggagatagacaggtgggagggaggtgaaccatgcagttgtactcatatccatataattttgaaagattttgtgggccacaatgatttcattggatttgaaaaggagtgcaactttgtggtccatgtaagtgcttctcaagctttcctgtgcacgtggatcacctggggatcttgctaaaatgaagatttggctgcgcgaggtctcgggtgggaactgagagtctgcatgtctaatgatcgcccggatgatgcaagtgcacggaccacactttgagtcacatccaagtatttatttgtaggaaatatggtggcacaaatacacagtcaataagggtatggttcaacctcattttatggtaactcgtctcaggatggaaagtctgcgacaaacctactatgtatggactggtgtttgttgacatggcaatacatgaggaggtcttcctgcctcccattttctcctatacccaggagctggggacagagggatgagaagtaaaattttatcattaaggatcattattatttcactgtctttagttttttaactttttatggtcctttttaaaactttgcctatggagtgatcagaagggacataagcttttagaatatctactagggtgttgggcattaggctgccattttctcttgactacttgtaacccttcgaagtggttattgtttcactgcctttacagatggggaagctgaggtttagctgggttaagtaacatgacagattccatagagacagagcagggattcgaacccagctcggtgctttcacttgcactaaccggcatcatgaaagcagtgttacatgtttaattcagcatgagatgctagctcatggatttattactttttgcttttctcctaaggaagttgcccagagagagtgccctaagcagaggasagggagcagaaagaaagaggttactgaaaagaagaaaagacttagaaaagctctatggggcactgaagattaatctcacacctaaagcaaaacttagctccaaaaagactagcattaagattcttgccttctttgtgagaaaatgatcttcccaaagtgtctggtttttatacacttattttggatcaattaaggtatgatgctccaagatgctgagaatttgactgtcaatgttaaaagatttctgtccatatcatgccaagatcaactttaactttccctctcctgcataacatcatgtgaaataaggatctgtcaggttctgtgaagccagtatttgtctttggccagcatcctaagactttttgaaccactttacttgatyctcagtcaaactttttgttcttgtttaaacctaccatcacattttgttcagttatttagcacgaagataagcgggcctggcatttggacaaatatttgaagatcaagtttgtcacagggccctccagtttcccttccagatcccaccccacttggagcgtcttccctttctttcccacccttcctgctctactgccctcccaccacatgtattattttaacatcttgacacctacaaaatctttagctatatggcatgtaaagtaagagaggataactaaaccaagtcaaagggtaaggaattgctatccttatctctgaattttaaaagataaatctttaaagacaccaccctgagccagtcagggaatacacttcctggttgagggaactatccaatggccacttaactagataaccctgtctcccttggtatcctgtttcctgctccccttctgtaccactgagaatttattccaacttttgaggttgtatgttcttacctattttcagaatgtggtttcaaattttgctatttaacactgcctttcagcaggagattcctatcgaaagattataggtaacatctttctgatatttccaataaaatgtctcttgcactggtctgttaagactcagatttatgggtagtttcaccaaactatgtcccttagcaaagctgtagtatgtttggctgaacacacagatatctcctactctgtttactgccatcatggagtggatggtgtacaggtatgacacctgaagctggctcccagggccatgcctcttaggtcactggttaacagtactggctaagtcacttaggctgctggggctcagtgttacatctgtaaaatgacttctaggtttcttataagatttgacatcctatgactgccttcctgtatttaggttagagcagtctctggtttaggagggtcacacagcaggcatgtccttctctagcattagtagcgtggtcacgaatatgggatgtggagttagactgccgggattcaaatctagctccacccactagcagtgtgacctgggcaatttatttatctattgcagctccataagctataagcagggaatgatgttacaacttactctatagggtgaatgtgtcacaacctatcccatgggctgggagtatcacaaaatatcccatagggtgggggtgttctggcctaccccataaggtggaggtgtcatgagctaccccatagagcagttgtgaccagtaaactctaaacagcctggcacatagtgagccctccttaagcattggctaggatcattatcataaaatcactctcatccttcaaagtctaatttcaatgtgctcccttctaaaataccttacttggctaccttaaggaaaaaacaacttttccttccttggacctttcatagcaaagtgaatagactctactctagcacctacatttttttccccatcttttcttttttaaaacatagttggtacccacaatgtgccaaatactttcaccataaggtttctcatttaagtcccgtaaagtaagagagttgttacctatctcaatttacagatcagaaaactgaaggttagtgcagggaaggggcttggccagggtgacacagtttacaaatgacagttctgtaacctcctccatgccttccgagtctgccaccccacagcaatctttcatattaattagttatgcagcccatctctcaaacttgttcatygtcactcagggccacggacagctgatctttatttctggaaccagtcactcaatgttggacacactgtaggctcaaaatcaagcatgccaaatagaactgccgacttgaacttcttactctcatgacatcatttccttataaatcctaaaaaactatagtgattataagtcatgttaattcaacacacaccttttatgtatgtaagaggttaacgaatggctgctggcttccttataggaaatactatattgatttctgccaggtttttgtgtctcctctgtgccttaatcactttctagtttcatctgtttatggaaataggcagcctgggctatttggtaagcaaattgataggtctattctatgtgggtggtaatatgagagtccacccagatcccactagctcttctatggaaatagatttcttgttaatactgactgggtttaggatctcattttactataaaaggttttttgtttcaccttcccaactgaattttccctaaataagcataagragagcaggrtttgctagttgttggacaggcatttgacttaacagtaagccctgtttatttattgtcacaatacgaggggggaagatattgcatttctaaaaattaatcatcagcaactatccttctatatcaagagagaccacagaaatgttttcaaattagaatttaggccatgtagaggagaaaggagaagtataaggaagggacagaagtaaatagaaggagaaaggcaagcccaagcctgagcagaaaccacatggtttatcttagaagaaactgatctggaaatgaaaaaagcttgagtcatcaaggtggggtccttcaagactgttaggaagcctcagtagcccagcttagggagtggagctttgaaggactgttcctcttggatgggtacctcaaaaacgtgtggcttcaggtgtttgttacacgagaacaacatattacggactcaagtgcacagtatgtgaacccatctttgagaaaataagcatatgtacataaatatttgaaaagaaaaacatctagagatgtgctgtgtttttcttttccctgtctgtatctcttggctttatagaataaacatatattgcatrtgaatcttaaaatgaaagcaaaaaatgtataaagggcaggattttgaaatgaacaattatgttgaaatttcacaagttatatttcatcagatgcaacaacgcttgtaaacccttggaggtttactggagaaggtgcttgagggctcaataccttcctttttactcaatgttcttcctttcaatacacagaggcaactttgtgaatttgtcagtggtctctgtgactcatcttattaattttttatataaaattccaaaaattctcacctttagtgtgatgcacataaaagttttatttttcttttcttcttctttctttattattattaattttttttggaagacagggtctcactctatcgcccaggctggagtgcagtggcgtgatcctcctgcctcagcctccctagtagctgggactacaggtgcatgccaccatgtctgctaatttgtcaaaaaaattttctagagacaggatctcactatgtttcccaggctggtctcaaacttctgacctcaagcgattctccctcctcagcctcctaatgtgcaatatgctggggttacaggcatgagacactgtgccctgcctaggtgtgaaagttctatagacagaaaaatatgtataccagcacatagtactgggaaagactgaatagcaccttggacattgggatttttacatttttaatacagtgttgttaatgtcacaaatcaattcagcatctaaaaaaattaaaaagtaaattttctattcaactaatcagatctatttaattagcactctgctttgaggaatgatgtttcagctgtggatataaaaaattgacaagagttttcacagttttctccttctgcttcattagtaaaatacggaaatataaaaggcaaaagtaccctacaaccatgtccaatgtgatattgcctccccaaaggaggctttcactcaaaaaaagtagaccctcattgtttccataagtctccgagcaaattctcttccggccacagactttggatgtagaaaataagcttatctgggcaggtggatatgcagagtttgcaatggaagcaaagataaaaggaaggcatgctactcttacctccataggctctactctaccctgatctctgccctgtctttgatcactgggcaaagaaaccagtgaccatggcaaatagtacccattgtactcagaagaaacccattatacttttgtgaaagaattatcctttttaaatagctaaaacaatatcccagggaaaaagtaaccaagactttattatattgaatggataagatttccactacttctgtctaaaaatcaaataatgcccttggaggacattttaggaattaataaataatcttttgttctacatagtaaataataaaagctggttttcttaattccactttgagagttgtgtggtctatgttaggaggaaagctggctggagccaaccatggttaattcaatgccaggctgtatttcttagtctccctttcatttcactcttctgccatagtgggtccatcatactcccaggccagtgagaagtgccctctagtgattggatgggttcgcttggcgcccgcctccatgcagacagagcaatgcctgtgtgggtgcttcctgatcaagactgatgagtgggatgcaaatatcttctttttaatgcatgaccctggcatagccagagggaatatgagtgatggtgcctcaaagcagtaactttttgcttagagcttgagagtcaaagttaaggacccacatgtatacttcggctctagcgagtctaaggtgagtaaagccttcagattatcaataaagaaagattttaactattgggcatgtgaattcaaataacgatgcaatttcacaaagcaaagaagaacataagaaagtttgtttctctggcctactgctcaacattgctacttttcatgatcagacctgatattagactgagggttgaagtaactgtcttagtagaattagaaaattaatgcatttatttttcagaaataccttaagttttaatgttttacatgattttgggataaaaaggaagagtctttttactttgtaaatgtactcattttttcagttcttttaaatctcttttgatagcatctgttagtgcaccctcatacattttcctcattttatcttatcttaggcatttactttgattttaaattctcatagatattgaaaattatacctgtgtaatttatgttaaagatctggccatgatcaggggctgcaggtgttatttacaataatgtcagtgtctcatagtggtttgggtaatttggtcaaattacaggccgttacttcataaattgtgagctgtctggagttaaattttctgaagttttattatatccaattcaattcaaccaacacatatagaatgtttaaaaagtaaggagcattttgataaggtggtctggagaatggggcaaagatgatgaatttattatccacagtgggaggagtcaaaagtataaagtgctttttaaaaatcaacatatttataaaacccaaagcaaaggcagcagaaaaactgtagctattgtgtaatttattctataatcctacatcagtctcatttattaaaatcagcatttatattatcccttaataggaaatcgttgaggaaaagatatgaaggttaaagagaacttacctagatgctgcaaatactcattttaattatttattttgtttaggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatggtgagacatcatgtgttccattatttttatactatttattatttttcctaagtctccacaaagtacttgatcataatgaaagaatatcaggtttcttaacttacacwgtgaagatcctcttctatccacttatcacatgaccttttcttaatgaaagtataatgaattcaagataaaggattttaaaacattagttaactttactaaggcaaattataactttagaacagtggttctcaactgagggcatttttgctccccaggtgacattgggaaaagactggagatrttttgggttgttccaactgggggataggaacagtaagtgttaaagacatctagtgagtagaggccaagaatgcagctaaccatcctgcagtgcacaggacagtcctcacaacaaagaattacccagccttaaatggcaatagtgccttaaaacaatgctagaaataagactattcctgtacagttgagaattctactatagtaaaaacactgaaatactgtcataagactgagccaaaatgaagatgctttgcagaagttaaatcttgattttcctgagtatattaaccacatggtaggtgatttgaaacacatttcaagataatcaaacaagattattaaccactggaatatatgtgtttgtgtccagactcaaggaatagattatgttgtcattggattttgactattacggggtaataggaagtgactctccattgcccaccccccaccccaatctccctctcaggcataacttgggctttatgcctttccttgtgcaccatgatgtattgcaggaagtatcttacattttgttttttaattcagaaaaggggcagcagaaaaggatccattgaaattaagaaaatcagatgtgtggagaaagtaaatctcgaggagcagacgcctgtagagagacagtacccatttcaggtaaagggaagaacgacattgcattgggtggatagttcttccttcaatttttctatcgtgaactcaatatatctaggaaaaataatgatatttcaaaataatctaaacaaggcttggaatattcccacatgggagttgggcattttgctaaaattctgtccaccaatctgccttccctggagggaagggaagggaagcaagacaggagcgtaagtcgcagtgacctgacctgcctcaggtctgatcatctcttttaacaaacattgctgagtatctccgatgtggtacacagtagtaggcatactatggggaacaaaacactgcccctaccccaaggcatttacagggaagtggcaaaatagactaatacacagaccattacaaagcagtgagggtgagagttaaggtggaggtcagcagaatgcatccatggagtcccaggatgtggaagtttcattcctcactccaagaggctagaragatattctattggaggtgacactcaagttgagaaggacaagtaaaatttaacccagcaaatatgagaaggacagtggtacaaaggaagcagcaggtgtcaaggcactgatgagtgaaacagtatgacacatttagagagcactaagtagtccctatgaataaagaagcccatgtgacagtgaaagagatagcctggagaggtgaccatgctaaggagttttcattttaccctgaagtattttaaacaatggtatggtatgtagtgtatgctggtagtaccttttggaagtggcctaatctaagtcatgccctacttttcttatagcataaaawcttacatttctgatccaaaggtagatggattgtctttcagatggcctgactacccagtgctagtattaggaacctgtggccaaaaatgaaatacaataatccagttgattaacaacccatacttcccatttggaaaaaatattaccaggccaggcacagtggttcatgactgtaatcccagcactttgggaggccaaggagggaggatcacttaaggctgggagttcaagactagcctgggcaacatagcgagacctcatctctacataaacattgttttcattaaaaaaattacccaattgggggaaaccaggggagggcatgctcatggaagatgctgcaaactcacctcatagaggcatagtgctcaaaagatcacaggctttggagcccccagagagttcctagttccaccacttatacttgtgcaactgtaaacacatactcaacttctatttctcacagagttgaaataagattaaaatactgaagtagctaggaaagagcccagcaactagtaagtgtttaacaaatgctgtgtatatttaccaacaagagttgaataaactagagaaggatctggagaagatattgtaatcttcaaacgtttaaacatttgtcttaagaaacagaaaagtatatattctggagattcctggggtgccacatgatgaaatagatgaaagtaacagggaaacatatttttactcaatgtaagtatgaactgtataatgatcagaatatatggatattggcagagatgacatagcagagtaaagaacattccatccctgaaggtatttttaaagatagagcagttaaacattttccagtgggctgtaaggaaatcatgcactgggtaggcaaatggaccagaacaatactaagacacgtgtaatgtctaacatattaatgtccatagtccagggtgtccctgatgagaactcagtgttcaccactactatgaggtacatcatcgctgtaattttccaaagtataggagtgtctgggataaaacaaattgataactggaggattttttaagaaaatttttttcatctaattccagagctgatgtatactgtataagcaaactcaaggtttcttttggatgacaaaaaatttgcaggtgcaccaaagtgaagtatggtgcaattatatataaacacaccaaatattttcctttccagattgtctataaagatgggcttctctatgtctatgcatcaaatgaagagagccgaagtcagtggttgaaagcattacaaaaaggtaattcaaaaaaagaaatgttgaaagagaaaggtcaaaaaaagycataaaagagagtcgttttttgaggcttggtggaggaaagacatggcagtaaaaagactcaatgccaagagacaatctactgattttcctaccaacctcagggaatgtgtcagactcatcctcatttttgctttctcattgttacatacaggaagcctgtggattggattccctggcccacacaaagccagtattgtgccttcccagcagcttaggggaagccaggccacctgctctccactcagtatgcttgcctttaccaggggaaagtctaggtcatcatggggctatgtcaagtcctgtagctaccacacttttgatgtttatagaaagttacatctaatacttatactgagcatttaccatttgccagctactttatcaaatgcttgtaaaacatttttttaggtaaccctcttgacaactctattgaaaggggtaatattattctccatttttcagacaagtaaagtttttaaaacatggccactgtcatagatacagtaacgagggactcagaactcaattacctaaacctgattttttaaccaatacattgtaaatgctaggcaaaactgaagatttaatgaagcttttattcagtgatgtttaggccgccctggtaacaacttttggtagaagggagagaatcattgttaatgatttggcactatagtatttccctctgtgatattttcaagatgggtaaaggtgtgaagacaatatttaactcaaatgaatggctccatttgtgaaatttcaggtattatgctcctagatggaggaagattttattttattttattttattttacttaagttttaggttatggttctttcttagtacacctcaaattacacacagttactccactttgatgcaaatacacccttctcacacatagggcttaatttttcctttgcataaaaaggtttagcaacccattctgcgggtagcaagtggtccactgggggacagaagcttccctctacccaccaccagctcattgaaatgagaaagacaacccctctagagttagacacacctgcagcaaagtgctgctttgctgtgtcacctaataaaatcatctaccatctctgggtttaagttaatcctgacctgtcaaataggagatcacatttcttttctcctagagcagtcacgagccacagatgagacactcataaatatattaaaatatcttatgcacaaacatgagtcactgtggttactgtagggcttctaggaggagctctaagattctgcttcccatttagtctcctttggtggaatttcctgagcggtaggtgctatgtcctatgtacagctcttggtcatgccctgctagatctcatgtgtctgagcagctcatgtgaagacatacgaaatgtaaaggaagagcagagaaagaagcaaaaacacatctcctagcccctcataaaactgcagagagtccccatcactacagctgccatatgcacaataagtggtttgtctctatgcacagtaagtggtttgtatcagttagtgatgttttgggctgcaggtaaaaagacatcaaacagttgctgaaacaaatccacttttgttcttctctcacagtaacaaatgcaaagataggcagtcagtcaagggctagtgcagcaactcagtgaagtcagtagggatgcaggctcctcctagctttctgctctgttatccttagaagctgcaggagagattccaagccttcccagaagcctccctgcaaacttgtgcttatgtcacatcatccagaactatatctgatggccattgatgtgtacaaaggaggcaagaagacagtatcttttttttccagtctctgtgctggaagatagtgagaaagaaggtgcatgggatttgctgtcaagttggccaaccaacctgctgcaggaaaacaaagaggttctcctgctcaaatattctcccctacaaagtttcattgtgctataatggctcctcctgccttttgtgtctattatttggctcaagcattataaactgaggtagacatttaagatagaattttccagatgttaacctacacttggaaggtttgggctgattcagtggtagcataggagtgtgtgtcaattatcatggttctgaattcagctaaccagatgtggaaaaaatgtgctcttccttccaaaaattaaaacagaagggggttttgcagaggagttggcacctgtacatcataatgtagtagaaaaagcctgaggctgagtctcaggtctgctatttattaagcttgtgaagttgagcaattgtactacctctctgcacttcagtttacctaactctgtgagaggtgtaataacaatagctacccctcaggttcttgaattgattaaattagaggacatatgtaaaggaaaatacataaatgtaaagtcctatggatatatgaatatatgagttcctcttattgtcgttattaggtggtgagactgttgcaatgtagacttttggatttggttggaaaaagaattagttacccaggaaaccaaatccatgtagtaaggaaataataggaatcccaacatgtggaggccagaagcttagagagcaggaaggcaagtaatgtgcccaagagattgcaatggccatttggaaccaaaatcagaaacttacgttttataattttaactctttttgccttttgtgatttctgtcataatttccctttaattctcattagtaaagttttttaatgccagcattttcagctaaactgagctaagttaaattaagggaatgatatcactaaagcccactgtttattgaacacctacttactctgggccaaacactgctgggtgctttacatacattatctaacagcctcccaatgacccagcaaagtaattattatctccatacgcttccttgagtcaggactgtaaggataagcataactctcctgggatcaacataaggaaatctcaagatgaacataaggtcaagagagaaagagttaaaggcacatatagaaccagcccttctcacctagatactcttcttaaaatatactaagatcttgtaggtttctctgttgtatttcaaaagaggctaatttgttatagattacagtttcatttatttgaattatacattgccctattcccgtggctttttaaaatatgcacatattcctaggaaagtagccccataaaccattcattccttagtataaacatgtcaaagtcacagaagtcaaggaagggatgagaagcagttctaaattaagggaaactaagtgccatgtttgattttgaattggatccttgatcagaaaaaaagtgagtgattataaaggccattattggaataattagaaaaattttaaagatgaaatatattttaaataataaatgcagccataaaaaagaatgagttcatgtcctttgcagggacatggatgaagctggaagccatcattctcagcaaactaacacaggaacagaaaaccaatcaccgcatgttctcactgataagtgacagttgaacaatgagaacacatggacacagggaggggaacatcacacaccagggcctgttgggggatgaggggcaaggggtgggagagcattaggacagatacctaatgcatggggggcttaaaacctagatgatgggttgatrggtgcagcaaaccaccatggcacatgtatccctatgtaacaaacctgcacattctgcacatgtatcccagaacttaaagtaaaataaaaattaaaaaattttaaaaattaataataataataatattgtatcagtgttaaatttcctgagtttgataatcgtattacagttatataagggaacatccttgttaatataagctatgtgctgaagcatttatggatgacattatttaggtcataccatctactacttcctcataaattattaagcacaatataataatgattttaaaatttaaagaataatacatatgtacagagagaaagagatacagcagatgtggcaatcagttaataattggtgaatctaggtaaaaggcatatggatgctcattgtattaatcttattcttgcaacttttctgtacatttgaaaattttcacaataaaaagtagatggaagtgtatgtttattcaggccttttttttagaaccttttgctaaaatttagccccacccttccccttctgccacaagaaaacaccatgtgttgtaacccactcactttctttacagatatatctctaaaatcctaacatcaagctgatctgtatatgcattttactagttattttttcttcaaaaatgatatgtaattgtgttgttctcaacatactcatggttagacttttcttttttctttttggcttattaactgttgagtgaaagacctatatccttccggaaccatttgctcttaccttggttgctggccaaatggggtttttattgttctgtgataacagcacttactgaatgtttctcctcttggatcaacgtttgctaacgtcttgttttcttcctgtctgctcctcagagataaggggtaacccccacctgctggtcaagtaccatagtgggttcttcgtggacgggaagttcctgtgttgccagcagagctgtaaagcagccccaggatgtaccctctgggaagcatgtaatgtgtgattcctctgttggactggacgttgggtggatagtgctccattaggctaaacctgccagaggccagaagagcttgccagaaaacaagatgtgccagattggttggcatcatgaaaattcagccttgcagatgctatgtgacaaatgaaatctcattctagggtcaattgagtcatggccattaagataataacaatattaacatctgccattctttcatttcatgagaaacattttaaaaatttgaatcattaatcaagcaatgagctgttatttcctcccataatttttcttggttcaagataaactccaaaaaggtagaatatgttagatatgtcatcatagttcaaacagctaggtttccagtttggtaagaaaaccagctcgctcttcgtataaataacgaaaatcacaaactgaaaaaacaacattattaaaaaaaaaaaagatataacttaagtaacacttttcatcaccatgtatactaaaatgatggtcaaattttaaaatatatatttaaagcagttcgccattctctatatgtgtgttaatttcttaatgacatgagagaaggggctgctttacgtgaaatcagattctatccagagttgtactcccagggaaacaagagggacttatatgtatttaaagtttataattatttaacataaagttgttgataaatacaaaataggataacttattttggtaacagttttaccagcctggacaaaatatgcctggattacaatggctttaaagaattgaatgagatcagctacaaaatagaacttcatgaamtggaaaagatacaggcacataaaatattttttaaattcacttcatgacagtattgatacccaacaatcatgttaatgttaatactggtcattttacccccaaaaaatcaattaataaatattcattgtgttttccatcttaattagactatacagtgaatatttattaatctcaactagatcacattgctctatatactcatgaattatagttatttaatgaactatacagattggttgcacatgggtcttcgctccactgtaagggactgaggagtaatgtctccttatggtattaatcattttccccagtggttttgtctatggtctatttggtctattatcattacctagcaggtcagattccagctttgacaatgccctaactttctggaaggagcaggaaaaaggccagagagagcactgccttgggattgccttcytaggctctgtctggatgacactcaccatgtgttctgggtgccacaggtgctgtgcctctgaggaaaactacagagtgtagaggtgttgcagctcctgagcagctgtaatactgtctatctgtccaagtataatttattcccttggcttcttctgctgagctactgggaagtccatgggcataacaactaaaagagaaaaagttaggtgtctttatttctttttgtccaagatgccttgatccatcctctttccaggatacatggcctacataggagttgggccttatataggaaagctacagaatcactccagatgttgtgtctggattcacttaatctggagtattgctcacacaagctggttcattcttttaattcataacattgagtgtttctctttgttttgtttaaagttccttctgatattactttgttttaatgttcagatgctaatctgcatactgcagtcaatgaagagaaacacagagttcccaccttcccagacagagtggtaagtcaacattttaaaaatgtttttcatggtcaggatatattaaataaaccaagagttgccagattcaagactagaaaatgtggaattcatttagacttctcagcaaagagagaaaaaccatgagctctagataatagctatgggtggtattgaatagcggattcaaatatagaaccattgtaatatctcatatttttgcatttcattgttgtgtcttttcctagccagtaagcccataaatagtcaccaaaaaaaaaaaaagaaaaaatgggtgcatgcgggagatgtccttaagatggcatcacacataacaggcagctgttattagctgtcattctttccttaccatcaacatggccaagactgctttgtggaagtatcctggtgttgaaatgaaactctataggacaaaagcagaaaacaacataattctttccctccattatcccttcaaagctattcagtgggctttcttccctgcttccaaataaagtctttgccaaattccatagttttgcagtcattctcaaatgataaaaatgtccccattacttgtaatcataagaacagcctctgaattgttccatccaatgttattatcacatgactgcaaacatcattccaagttaaacatctgtcacctagcttgggcctgcatcacctggcagcatgcttttggggagggattttgggggggctgagattcatggccctttcagagttagttccaaggaagatgaggtctaattaaaaaaagacacacatagctgtttctatcatgatttggtggtggtggtatcggagtgagttttccagcactgattctttatctcatgggagacttttaggaatttcctactgaagggcagatccatatgtagttttatgacaggggagagatcttgatcctcagttcttggattttcagccctcaatctttcaagatggctgtcagccaactttttcccaagagtggagttggcctataagaaaacaaacaaaaccttgattgctctggttaattaagctgtatgtagctctctctcgaagtacaggctactgctgtctttttgctctactctcttgggttcatagccacagccttctgtttttagggttcccaggcaggtgtgagcctcctcaaatgccaggatacacaaaaaatggcttcccattggttctctggaagttcacctgaaagcaaggggacatctccgcccatctattggatctatggtgtcttgggtacttattttcagctacacacattcgcacacacttctctctttctaagtaaaagccacataattttcrtgaatcaacatgaaagacaaaaataatccattattgtagtagactgaataatgtcccccaaatttcatatccatgtagaacctcagaatgtgaccttattggaactaggatctttgcagatgtaattagttaaagatcaagatgaaatcacacgaaagatgagagtgggccataaatccaatgactagtaagatgagaggacacagagagatacacagaggagaaggccatgtgaagacctaggaagagattggagttatgttaccacaggccaaggaacacctgtttcttagtccatttgtgctctactaaggaatacctgaggctgggtaattgataaagaaaagaggtttatttagctcaccrttctgcaggctgtacaagtagcatagcactggcatcggcatctgatgagggccttaggctgcttccactcatggcagaagggaaggggagctagtgtgtgcagaaattgtatggtgagagagaagaaacaagagagagggaagggagatagcaggctcttttcaacaaccagctctcatgggaaatcatagagtgagaactcattcactaccatgagaatggcactaggccattaatgagggattcgcccctatgacccaaatacctcccattaagctctacctccaacactggagatcacacatcaacataaaatttggaggggtcgaatatccaaaccatagcaacttggaaccaccagaagctggaagaggcaaggaaagattttatcctagaggcttcagaataagtatggcaatgctgaaatgttgattttgacttctagcctctagaactgtgaaacaataaatttttgtggttctaatccaccaaacttgtagcaatttgtcatggtagccctargaaacaattataatcgttaggagttttactttgttattagcaacattgctgtttgggtttgaaaatatgtttcagtcctgaagcttgaaaagtatggccctctaaaacacctaggagaaacgcccagattaggcaaatctatagaaacaaagggtgatcagtggttgcctgggaccagagtagggatgagaattgactgcaaataggtatgaaggatcttattggagtgatgggaagactgggctgtggtgatagttatacaagttgataaatttacaaaagtcactgaattctgcactttaaaaaggatgaactaccaataaagtttgttttgacaastctaagagcagaagataattaagagccagaaaccattgcatctagtctccagcagggaactttttggccaatatattgaaaattatcagctaggcaaatcagtggctaagggttcataagcctgttttgattataagcttcccaaatgaaccagggatcagagggtatcatgtaaagtatgtttttctttgttttgttttttatcagagtattcagtagagggcttattttctgaatggaggaaataaaaatcagctctctagttgttctgttcaaagagatttccttaaatgatttccatttaaggaacttcctagtgcatttttctttggacataacccacttcacagctcataaataacactgtcctgcataattaaaatttccagaatgtcaaagccttaactccaagtaaatgaaatttctgaaaaactaaaatatagcatgaaaaaaatattaaatgcatctctttctgtcacacacgcacacacagacacacacacacatattgtgaatttttaactgaaatataacattaacatagaaaagcacacaaatcctaagtgttcagcttgatgaattttcacaaactgaacaattctgtataatccaccctcagataaagaaacacaacatcacagaaccccagggacaccctgatgttccctttcagtcactactaccctccaaaagtagttgctaacctgatttataacatcatagattgtttgcctgattttgacttttatatgactggaattataaagtgtgtagtcatttattgtgtgtcttcttttcttcaatttgtgagattcgcttatttttttagtatgtgattatatttaccgtcatcattgtatagaattcagttgtgtgaatatacaactgttttggtttcttattactgttctaacaaattactacacaaatttagtggcttaaagcaacatacatttattctcttatagtttggaagatcatatgtctaaaatgggtctgcacagctgtgtttcctctggaagctttagggaagattctgtttccttgcattttccagttcctaaggggtacttacatttattggttcctggctccttcccctgtctgcagaaccagaaggttgcaggacctctactctctaacctctgcttccatcctcacagctctctaatctctgaccaccttatctcccttttataaaggccattttgattacatcaggcccacccccacaaaatccagaatagttgccccatctcgaaatccttaattacaatctgcaaagtctcttttaccacgtaaggtattcacaggttctgggaattaggacatgaacatattcgggagaccatttttcagccttcaacaaccacaacatgtttattattttatcctcttgatgggcatgtaggcagtttctagtttttatctaattaaaataattctgctatgaacattcttttacaggtcttttggtttccctgttgtgtatatatacgtaaaatttatgagtcatagggtatgaccagatgcacatccagatttactagattctgcaaacaaatttccaatgttgttgtaccacttcatactccaaccagcaaaatatgagttccagttgctccatatccttgctcayacctttcttctttccttgcctctttccttcctcccttcctccctcccttcctccctcccttctctccttcctttctctctctttcaagagctgatatacttaattgtcagttcccggtacctgaatctgtgcctcactgtgatgtattaaaatttcttcccctccaaagctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaaggtaatccccagctttcagacgggctgcccagcatgtagagtaaacactaccccggctgccctggacctcagcctcaaagctgttgatccaggtcttaggctgtcctctcagaaaatgttcagtgcttgagccagaagtctggggaagcagtggccccactggggctgagaagcatagattttccatttagattatccaatctaatgatctcagtaatgcctgatcattgtattcccttccctttctcctccttctccccccaaatatctccacattccagaatacagaatctttaaaaatctatcctttatatgaaagagcttaggatgggcttacttttgtaatgtgcttcagtatcactagccaaatggcaaatagcatttcaagcaaggccatggcttgccttcttggaatgtacaacctcacctctcctgacctgattagtcttctcacagtttttagcctaaagattctatctaaagccagaattgaaaattccttgaaggcaacatgtaaattgtgtatgtatgtatctcttggtatggcactgaatttgccctacacttgatgcccaataaatgttgaattgaattgcaagatgaccatatggaaagggtcaagtgactccccttccttatttcctgtctcagacctccttcctatcatgttgtctactctctgccatcttctcactcagttatcagcatccctgcagggaagtcatgtctgcctttccccacaatggatacagagcatctctctgactcaccatgtatctcttttcttagttatttttcccatgtccttttattcctttgttctttccatcttcatcatttttgcctaaagccaattactgaaagtttcaataatacagggccatatggaatttgaaataatgtaagtgtgttcttcttgattttttttcagtataataagccatggtccctttcattccaaagtggagctagaatcctagtgtattaatctatacctggtgcccaaggtatggggttacatttgtgcgcctgcagcccaccattcttgtggaaggagaggatcagtaaacccagttgcaaggagagtgaaagtcatgttaattgtgttccaggtccccttcctgacagaaactccagtgattcattgagagaggtgtgaggtgaagctgactgccctgttttcaaataaccaggaggaactgtcgattcacatggggttgctgccattattgagtttttgacactcctttagatttgcacctccttaggtttagtcccaactgtggattttccctagaacttcaggaagctagttattttaacaaaggattgattgatcacctcttagcatgagcagcattgcatctgcaagtaaattataataattgctaaaaggtcttcatggagcttgactttttaaagtgcagccatgattcttatctcatatatgggataatactttttatcaactttctgtcattcttacaatcttccctgagcttctttttaatctactttctgtttagtaagataatctatgcccccattaaatcattcaaatattacagaatattccatttacattcccctaaaatgttttctatgcacatgtggccatgtgcatacaaaagcaagtaagttctcacgatacagtctttgtcatttgttcttttcacttgacatcttcagcatttttcctatttgaatacatgaggatacacctgacttttaaaatttcattttcatttaattttggtgaaatatacataacataaagtttaccatcttaattatttttgagcatacagttcagtagtgttaagtacrtttacattgttgtgcaaattgcctgattatttttaatgtctgtaagtaccagttgtatagatactaggtaaacctaagtgatgcactattgatggacattctctaagtgtttttagaaacaacaaggctaaataaaagctattctagtgggcaaggctctttgggaaggtggagagagaggcattttagagtttaagggctttatctaggcattccttgaaatagagccaggggagcatttccttgctaaggaaacttgtttctatgaactgtggttttgaaaaaagtctggactatgaaggcaaacaggaaataggttccacattccagataaaacagcctttagactttgagaggtaggcacttcttcatgctctgcttaataccccaaataaaagagataaaatgatctatggcagaggatgatgaaaatcctccttatccatctgtgtccagaaggagtaaaaagatcagcattttcaagaattttaattgtagtcacaatagctaagaggaaaataagttattttaaaatatataagtgacagaatgcttgcatatatataagaaaatcagggcaaatccagtcaagatgatttattaatctagattttccattgtttrrgataattatgagccattattaacaattttcttttgtttagaagtgttgccagactactgcttttattggaatgcctgaaagaaccaaaatgtgaaagtaactcattagcttaaatttcccaaacaagtgaaatgtgtgggtcaaaatgtcaaataaagctaaaacatatctgaacaaaattacttttgtcatttaaaatttataagtagacatatgtttataaacttataaaatgtctcttttttgcagtagcagcagcagtgaagatgttgcaagcagtaaccaaaaagaaagaaatgtgaatcacaccacctcaaagatttcatggtaaatcaaattcagatatctcctacatccagaatatgcttccattttcaggaaaactaaccaaacttgcaataattttgcagctaggctttctacttaaggtaaatataaaccaaaaaagtctatgtagtttgcctctctgaaccctgaatggatggcttttgggttctagtttttcttgaactgactattcctagccagcatccatgacatacaccagtagtagcaccaacattagtatacytgacccaggcatctctagcaggaagaaaagcaacctagagttgaataactcttccataagaatagctatatacacaacccaatttttttttaacttgatactacagccatctctgaaggagtcttcatctatttcgtgagcccactctttggaaaaagtcaaagaaatataagttcttctgggggcctcctggggatctcctgtatcaaagaaccattctttcattaaaacttggcataagcccaacttttgagtgactctctctttactgttgctgtgttgatactttgccaggtgcagaaggagaaacctaacaatctaaatgttatttaggtggataaaatcagggtgggatttgatattgcatggctacgcacttggattatttcttggtgcttttytgcactcacgtttttctcaactcttcttaagggaattccctgagtcaagttcatctgaagaagaggaaaacctggatgattatgagtgagtattgaaagtcttctgggttcttctaaaattagacatagatacttctactctcttcctcaaagacattaaaacagatggctgagaccgtctcaggaggctgtatttacatgggtaaactcacgtaatgttctgggtcatttatctagatgacaggtgacaatgagctgggttgttaccaacgaaaatattttccccaaaactggattatctaaattggatgcaaatacttattggatttatcgtatgtccagcgtcaccttcatttcactttacctttgtagatgtagcatataatgtttctgctcattatttctttcctggagacctctaattaaggtgatgtttgaaagctcttattaacattgagtaatatttttggagaagttattaatgatgcagtaattttacagggtagcacaaatgagaccttgaacatggcaatatttatgtcgacagatctctattcttaggatgaccttgtcattttttttttttttttttgagacagagttttgctcttgttgcccaggctggagtgcagtggcatgatctcggctcattgcaacctccacctcctaggttcaagcaattctcctacctcagcctcccgagtagctaagattacaggcgcctgccaccatgcccagctaatttttgtatttttagtagagacagggtttcgccatgtttgccaggctggtcttgaactcctgacctcaggtgatccacccgcctcggcctcccaaagtgctgggattacaggcgtgagccacctcacccagccaaccttttcatttaacatcaaaattgggatactttagaaagagaaaaagtgcactattaaaaattatacccgttaataataacttaattatacattttaaaataacttaaagagtataattaattgtttgtaactcaaaggataaatgcttgaagggatggataccccataatccatgatgtgattattatgcattgcatgtctgtatcaaaatatttcatgtaccccataaatatatatacctgctatggtgagccgagatggcgccactgcactccagcctgggcgacagagcaagactctgtctcaaaaaaaaaaaaaaaaaaaaaaaacaacacaaacacacacacacacacacacaaatatatatatatatatatatatatatatatatatatatatayacacacacacacacacacacatatatatatacctgctatgtactcacaaaaattaaaataaaaattacacctggacatttgacataaactggacttctgggcaaataagaacgtgtggtcaccccaactatactgagaaggttggcctaagtggctattaaggttctttccaaaatctaagggtctatcattctacaaatagggacaaataattgtctcctagatgtaaagattagtgttaagaagaggtgggaataatagagcatattgcatttctcagacacttgataccaaatggcacagaattcacttgaacactaggattatgcatatttccagttctgtttttgtacaagtgttgtattattgatttattgattacatgtgaaacgagagcttttacaaagtacatgctactgttttcactcctcctctcatctctaacccagcctggtcctagccatacctgttgcattggggaagatgtgctgtaccctccacatctttgtggcatggtctctttatcaccttctagctctctttcggctttactttcttccctaacatctattctcaggaaagcattgatggaataattcatactaagacataaaagactgagaatgaccaacgcatggtcatttccaaagataattgcactttaatgaaacacaaagacttaaaccaatgggagtgaacctctaattgtggattgtactctttagcatttaaataaattagaagtctttccctgattgggtaagcccagatatgaccatttaaacagtctctattcccatcttttctgaatgcaagtggtgtgtgagagacagacattgaggaaattatcagggaagacttgtcctcttcaaaatcaaaaagataccaaaaggagctcgggattatagggctataggatctgggactcagtcacctcacattgtgcttaatgctcccagcttcctattctatcagtgtcatgggagtttttgttttatggccataacttcatgagcaattccagtcaattccattaaagacagaagcactaagccctgagatttagatagaaaatcgtgtgttaagactaggcctggccaggtacagtggcacatgcctataatcccagcactttcagaggctgagctaggcagatctcttgagctcagaagtttgagaccagccggggcaacatgacaaaacctcatctctacaaaaatacaaaaattagccaggtgtggttgcccattcctgtagtcccaactacttgggaggctgaggtgggaggatcacttgagcccgggaggtcgaggctgtagtgagccgagatcataccactgcactccagcctatgtgacagagtgagaccctgtcaaaaaacaaaacaaacaaaaaaaaaccttaggcctaggactctgctgctctgtcattgaatactgaaatattatttaaaacaataagaggcaggcctcagcaaaattatgacacaggcaacgtttgtatgtgtgtgggaggtataatgtatagggtacataggttatatcaccttgcctctccaggcctctctcctgattcttgattttcttccttctattcccctgtaggtatatatcctgtatcacagcccctgaagggccttttgattagctagtattaccttaaaatgttgactaataagaaaaacgatcagttaaaatttcaagtgttagttatacagtatccataatggtagagttaaaagagactttcaaacttatcaagatcaaccctctccctagttttacaggtagggaagtccaaggtcaaacaaggccaagtggcttgttcaaagtcatacaattacacatagggaagttatgcctagaacccagacctccaagctgggtgacctaaggctctttctattttattgagctgtccaccagctgacatcccttcccaaaactcatacagagattatacaaagaatcacttcccatccattcctgccaagttctgagataccttctacattgaatttctcctataactcctcccttctaccctcacccccctcttgtacttatttcctctgcagatgttatcttctagccagtgggtcctcccactcacccaaacccatgctacatcccacctcatgccctgcttttactcatttcctaagtaggacattctgtctaaagcccaaaggccacagacattattgccctcacatgagaaacagctcttggcctgttgagctccacatataaagtaaaagcatttgatgtgaaaatagatgttataatcagattattacaaggaaattatatgattggaagacaagagctttcatccttggcagccctgactttcctcttggaatattcttcataggtctaatctctagcccttactcaaaatggtaaaatgtaggaaaacttagaagtcacctagaagaaaaccaaagattcctaaatgccagcccatttaaaaattagatgtgcagactccaccccaacatcagaatttagtagtggggacttaagcatttgtatttctgaaaagctcctcaaatcattctctggagcagttaggcttggaaacccctgaggtaagccaatgcctcattttacagattagaaagttgagtgtcaagctatacaatctaaaacttattgattctcacatataatttttttccttttgcagctggtttgctggtaacatctccagatcacaatctgaacagttactcagacaaaaggtaaatagtcttgtctttaaaacagcctcacagaatctctttgcattttggggtccagaggttgatgcatttctcatagaaaccttcctgctaattatatagtcaagtcattgtagtgttgcttgtccagtctgtgggttgcccgactcttcatgtctagccactrcttctgtgtccattatgtattgctgcataataaaccactcctaaattgggtggcttgaaacagtgggatttatgatatctcatgattctgtgagtcagctgggccagcagttcttaggcaagttttgcttaggggcactcctgtggctgcatttgggtcgtggattgactgggggcttgggtttagctgaggcagtcaactggagttccacagttcttccccaagcagtctctccatgtgcctcacttgggcctcctcacagcatggtgatctcaaggcagtagttgaagaggacgagccccacagtgcaagcacttttcgagtctctgcttttgttgtgtttgctaaggtcctattggtcatagcaagtcacatggctcagcccagagtcagtatgggaggggactgctcacagcatgaataagagagatgatttatcggaggccgtcaatgtagccattaacctcagctctgtcactgctcgttagcacctagaccagagtatagcagatgtgatacagaacatgwttatctgactttattactaaytgatatggaatgccagtagcaaactcttttgatttctaaaaatgacactttgatatagtttaacctgataaaaacactaaacattacacttatttctttgaggggtgctagtgagaatgtaatgacttcatttggcgttttgtcacattcatagtttataatctgctctttctgaactttgatctgcttagaattagcacaaatcattgagaaagacaacttgagtatagaactttatcaactgatttattcttgatctttggttttctaaaaccttccaaaggcatgatacggtgatacacggttctaaattgtatttcttaaagatgaaaacattaggcttgcataagcacaacaccgagaaaagtaagtgatagggttaaatattaattggagaggaagagttcatacacatacacatacacatagagcagatctataaagagattgagtgagaaacctgtgccttttgtgatatataaagtcaatctaaaagatttgttttccaactacctaccatgcaaaatcattttcaagaatgatgaaaatattttctattccttctatattttccttccttttcagggaaaagaaggagcatttatggttagaaattcgagccaagtgggaatgtacacagtgtccttatttagtaaggctgtgaagtaagtatgatacggattaatttcttttctctttctgcgtatattctttgaatatgctggtcacaatcacattttgggataagacatcatctttaaactctggaattttaaatcaaagtatttctattgaatgtgaccatttgtagttgcctccaccactctcaccccactgccccaccatccttgccccactactttcaagaggccattctctggctaatcctctcctgccccactccaggcagtaacagagtgcccagagcacagcatgcctcagtaaatgtttattaagagactctcgggtgattccctttcattcaggtctaagcctggaaagaaaaaaaatagcaatggagcgtctatactctcagccctagccacctgctgagcaaagatgcctactccagtgtccagttcttagtaagcccttccactgggtgcagagttagcagaaggttgactcagtgctgctgtgttctctacacagcttccttccagggctctgtcctctttgtgtgactaaaagttcttgtttgaagccaaacttctagatccaaatcctggctctactatttcaatagggctttgtgacattgagcaagtttctcagcctctgtgcctcaacttcttcatttgaaaggggaacataatgattgttacgttctatgagtggggtgagttaattaatatattatatccagaacagtgcctgacacatagtaagcacttaataaactaatagtacttactattattgttgttgttgttgctggggaagggtagttctacctgctccactccctgtaccctaacacttgggcataaaagacaccccacagtcatctcatgcaaatcatcatcaaaatccttctccagagttttacaagccactttcttattggtagttagcyctttttttttccttctaatcgtcctccaaagcaaatgggaaagctgtttttatttataccatattgcagatgagaggattgagkttcaaaaagagcttataaagacctacctggagctactaagtgactaatttgaagctgggcttccaatagccaagtcatgtttctttatctacacctctgtgtttacactgaacccccagtgttttggaatgagaatctgstcaaatattgattcggatcttcttttaaatttctatgtgtgcaactcttttttagcagctagattgaatgatcgtctgccttggtgccttccccatgtgccctaccccacagtgcatatatgtatatttataataattaagtaataaaaacgttattttattttgaaattttttacagagtgcctacctacacttgagataataggatgtacctgaattgtcccacagcactttccaatgccagaatccatgtccccagtgtatctcatatatkattttgcacatggtaacacctggatgctggctaaagccaacccagtaagaatcaggagaagactttgttgactatcaaaagttttgtggccttctggccctgcagtttcagccaaacctggtatcagatgtccttgtagttgagtttcttgactacagattcattttttaaggtagccaggtagataaatcagcaaatagataaagaatcaaatgaatacagaagccctcttttatgaaacctcatcaatggccttgagtgaattgtatgctgacaccaaaagctgattaaacatttgcagcaaagagaagaaccatttctccttttgtacttgcaatttttactcrgttgatgttacagcaacaattttttaattttttagcttttattttaagttgattggtacatgtgacaggtttgttatataggtaaactcttgtcatgtggctttcttgtagagattatttcatcacccaactactaagcctagtgttcaatagttattttttctgctcttctccctcctcccaccctccaccctcaagtaagcctcagtgtctactattttcctctatgtgtccatgtgttgtcatcatttatctcccacttacaagtaaaaatatgtrgtatctggttttctgttcctgtgttagtttgctatacagcaacaatttattaactgtttcttatatgccaggcataaccatataggtagctagcaagtgatagaactaaactcaaagcctggttcttgaccactatgtcattgtctacaatctaagacaggtgtattattcctgattagcttaaatcaacgtgcatcaattcagcattattgtataaaagcagaggaaaagaaaaaagtgttttatgtggagaaggtacaagttcacatgaggaattaaaggacatcctcacctacttcattctgcatgccccaaaagagcctcctcccatgttttggggtgaggatacccaacagcctaatcacctttacctctctcatttccacctccattattatcctataagataatttatgttcagaataatgatcytgaagaactacaagcctctctcgatcatcaaagaaagattccagttttatacacttactaagggaggagaagcctggaaagttggaattttactgtacatgaaatctatatgtgcaccaaaagatacattgagttcagagaagaactctcttccataattacttttatagttacaccagatktcaagactgagaaaaacaccagatgccaagcctgagaaaacctccctgacttccctctccaaaatttgcaaatgcacctaaaataattatttaacccttgcttaatcaagctttattgtttattttaaatgttctaacattctttctgttactagtgataaaaaaggaactgtcaaacattaccacgtgcatacaaatgctgagaacaaattatacctggcagaaaactactgttttgattccattccaaagcttattcattatcatcaacacaattcagcaggtaacttattttagtttttcttttatgggcccttgttgtaaaacagcaattttcctggatactactgatcctcctaatattcttaattatatagggaaccaygaaagtaggaaaaaatcctctcaagtcttttgcctatcataatttttagcttacattcccaggaatataacatgattctctccttaatgccagaaagaatgaaattgagtaaactgggtgacttagaaagagaaattytctttataaaaatattcgtagggtttttctgtgtatagaagcaagaggattatraatttaaaatattatagaaatatatacatatcgttggatcatggaccagttgtctattatgacagggttttttgcatgctgccactagcacttactaatcattacatatataaatagaaattatatattatgtatatacattacatttttacagagatgagatcattctacacatattgctcagcttgctttctttactcaacatgtcttagaagtctttccacgcaaacacaaagagcttactttggtctatttaacagctgtgtagaattctatcatagttaccccataatttattcacctagccctctgttgattagcagttggatcatgtccagtattttcacattataatggatgtttcagtgcacaattctgcatgcatagctctgtccatctatatgaggggttctatagccaaatccctagaaatggaatttctgagacaaaggctaagaatacttaaaatgtacagattgccaactgcttttcagaaatgtacaatcctactaacaacattttctttcatcctcaccaacactgggtgctattagtcttctaaatttttgcctaatcaactggtggaaatacatctagaaataccctctgttttctagaatagtgcsacttaagagcagtggctggatgaatttccaacagtgagtaaaaataagccataagctcagcacttaatttgtgttactttatatgacttgattgcatgcatgtaggtgaattgrcctcacttctggctttcattttggctcttactgatgtttttcctttgccccaatttcctcaattgtttattttaacctgtagtacctcagaagtaccttttgtaaaaggtattgcacaaagagatgcacaggaaacttcacaggatatcagaaggaaatattaagatgtttatttatatttggatttttatctcattctcttacattttctgtttgtgagtttatttttataattcacaccaaatatatattttatagaaatgtactaatttttacattttaattaattaatttagttgattaaaggtaaaggattttaaaagtttggagaccactcatataaaaaccagacaaatatatagaaaaaggaaggaggggaaaagtacatgtgtgatagataggtcccttgacttggagagcattccacatttaaagcaaaaaacatatatacatatattttaatgggttctttcaagccactattaaattttataattactttaacccagttttaccataactaaatataaacaattaaaatggcttgaccacttaatgaaacttagtaataggttcagtttttaaaaattcagatggcttattatttttacccttctgtattgtttgaattttttgtcaaatgtatgtgctgtgtgtatacatattttaagcataagattgtaaagagatagcaaaaaagaagggggagaattttaaaagattacatcatgcaattaatttctatgggatttttaaaaatcacatacagtgttttattcatttaattttcgctttgcattaagctaattagtcaagttaagcacaactacaactgaatggattctctctctgcattacaacattctgaactctttgctttttcagccactttggagagagactagttgtgaaccaatgttacataatgtgatgggatatgatataatgatgtgatgatatgatgctgattccattgcaggcatgatcacacggctccgccaccctgtgtcaacaaaggccaacaaggtccccgactctgtgtccctgggaaatggtatggatacatacttgggttcttaaactccattttccatcattttttatttaaatatatggttaatttactggcaaaaaaaaaaaaaaaggaggaaagacaggaaggaggcctctgttcagattgtatcaggaaggattttctttaaaaaaaaaaaaaatctgtcctctcaacctaaatctgtaagcttctagaatcaccaagaagatcatcaatttgttttcttatcagaccccattattagcctccagcacaccattgtctgtcctatctttttcctggattttgtgcccactgagcagagccagtattcaaccttgtgtgttaggacgatcacatccactgcgatcacagtttaatttttttattaaaaaaatctgacaatgttttaccaatctaaggacatcgagtacattttgatgctaagcctctccaagatgcctctgattggcaaattgtttttactctgagccttcttgttaaataactgtagctacttcaagaatagtgttaccctggtgccattatcacgtagccacaagaccacatcactaagggtttttttttttaacttatcaacttaaaataaaaagtcttgtttatattgtcactgtgaaactcccattggagaagaaatcacttgggaagctgttagccccaaagctttctatgctcgtcctaaagaatgtccgtcttgccttgttaggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgtaagtttttcccaaggaatggctgtttagccctcatcatgggagggcattagcactaataggcctgctgttaactttgcaaggcctagagcaaaagtccacatactgtatcatagacataaatatttagaagttataaattgaactaacagactattaaatcaaatcagtcttatgctcctactttgacaaatataccttcataacaacctgaaaggccatattcaaattgagaattcccaagactctacaaagaaaccagcctctggcctgtggtcttccaaactccacccctcctgcttctcccctcatacccaactccgtcctgcactataaggggcctcagtagttatgtacagacacagcattcagtacacacaagctccctctttgtctcccgcaaacaattatctagtggctaatgatcttggctaggggtagtgtgctttacccttaagcggacagactccttaaggaagagtcagcacaggtcctgaaagaggcctcaggactatatggttgggtgatttcagagtcctggtgctctaagggtggcagagaaagggacatatagggtcggagtaggcatgtctccttggccctgtggcctccttgccctgtggggaggtgcatggtgggatgaagaacagagtggggctaccacccagaactaatgcagtactgaaaattaatgctctaccaacaatatccttttccttcttggtaccttcaatacagtctaatactcttcctaatgtgtctcagctcccagcacaacagccttcaattattggcaatacatatgtgttctctttccctctgtgtcttctctctctctctctcttccccctctctctctttctctctccctctctctccctcttcctctctctccttctctctctctctccctctctctccctctctcagttgtatataattctccctcttcttgtcaacatagtaaatcagactttgtagagtgaccaccattcaggtttgctgaggtctgggaggttttagcactgaaagtcctgtgtcctaggaaacctcccagccccaggcaaaccaggacagttggtcactctacttttagagaatcaatcagtatggtatgaaaaatgatgttatagtaggtctctggtcaaaaatagttgaaataaaaaaattcctagcctgctagagattgagagcactttttaaatttttacttaaacagttatactgtacagtgtttacaggcatttctctaagcactttacaaatattaactcacttaatccccataagaaacctatgagggttgtaccatcgttatcttagatttacaggaaaccgaagcacagaaatgttgaataacttgtccagagtcggcaagctagtaaaagtcgaaaagcagagatacaaacccaggcagacattctagggtccatttctttagttattcttttatgaagaccaaaggaattaggaaagtcagaacaatcacttttaccataattgcaaaattatttggaagcagagatgctatgtgaatataggcctttggccctagctggcttcatgggcatatgagatctgcacagttgcaagggcctagaagtacctagtacctagaaggtacctagaagggcacagtacctagaagggccctgtgcttggtttaatgctctgctgttgtcatcttgaagtaatacttcgtgatttttaaacaaggattcctgcattttcattttgcattggtgcctgcaattatgtaactggttctgccttcagtgattggactgtcataaaactgggaagggggcccctgatattctcctcttgtaggacaggaaaatctggcagaaactttctgccagatttttctcatggttacaggctcatgatgtaacctctgtgtcttggtgtaactttaaaacatatttttgccattaccaagctggtatccataaaaaaatcacaagaagtcatttaaaaacatcacctaatcataaagaaaaacgtcaaactgtgccacaatgggaaaaagtctaatcccaaatgtaggggtcaagctgaagcctatcatgtggggaatatcagttaatatggcgccctcaccttgagccacctgggcagtgactgaatttgttcaaagaatatttctttattgggtgatggacctttgtgccatcacaagccttccctctgaagggagcagtgttgagtaccatgcaggtctccaaaactgctaaaagatgaatactcccaagctcatcaacttgagtgacatgataagcattgtccctatagttaaactaagaaggaagaaaataactaaaaatttaataaattcttattaaaatatttaaaacttcacatgttaaatttagatttctttacacatttgaacattacagaataatcctgtaaattgttaaaattagattaatcatataagaacaagttaatgagcttgtaaaaactgagtgtcccttctcaaaagaagacatttatgcggacaacaaacatatgaaaaaaagctcatcatcacttgtcattagagaaatgcaaatcaaaacgacagtgagataccatttcacgccatttagaatggcaatcattaaaaagccaggaaacaacagatgctggagaggatgtggagagaaataggaacgcttttacactgttggtgggagtgtaaattatttcaaccactgtggaagacagtgtggtgattcctcaaggatctagaaccagaaatatcatttgacccagcaatcccagtactgggtatatattcaaaggattataaatcattctactataaagacacatgcacacatatgtgtattgcagcactattcacaatagcaaagacttggaaccaactcaaatgcccatcaatgttagactggataaagaaaatgtggcacatatacaccatggaatactatgcagccataaaaaagaatgagttcatgtcctttgcaaggacatggatgaagctggaaaccatcattctcagcaaactaacacaggaacagaaaaccgaacaccgcatgttctcactcataagtggaagttgaacaatgagaacacatggacacagggaggggaacatcacacactggggcttgttggggggtgggggataggggaaagatagcattaggagaaatacctaatgaagatgacgggtgcagcaaaccaccatggcacatgtatatatatgtaacaaacctgcacgttctgcacatgtatcccagaactcaaagtataataaaaaaaaaaataaaatttaaaaatcaacttctgcgtggcaacaaaacaaaataaaaaccctatgcaaactaaaagacaaatgataaactgagcaaaattatttgtaattcatattatggacaaaagactaatctccccaaaaaggctaatacctccaaactcattaacaactacactactgcactgtttgtttgtacaatggatcactcagagtcagctcagaatctaagagtaaagtacatgtcaatccaaaaatgtgtccaaattcactgaaatacaatgtagaacagaaaagaaagagtaattggagttgctaagtactttcaaaaggctttatgcttaaccgtgaagacagtaaagagagtaaagcagcagttcgggagcctgtctggagaagtaaaggtgatatggcagcacactgctagagactccgctagacatttagcttaacctatgcatctcacaaatggaaaaaaaaaaaaaaagataggtgagaaaagatatcatgagaaaggtaattaaggtagaagaatcacactttacaagaaggtttgcttgatttcttttaagctctaggctagtacaaaatttaagattgatattacttaaattaataagaaacactaaaggactcttcaattcgcaagattaaacacttccatctggaacatctgattactaaataatagcccatagctacattacgctccattttcttctacttaactttatcattttaaaaagggtgctgggaagaggtacggtaaaaccatctgccataataaaatgaaaattatctcattaaaaaaaaatctgagtgtccatgccatcatgacctaccagaagtgctacatcatatggttagtattttataaatttgttattcaaaaataatgaaaacaataatgtaaaataattttttaaaaaagaaaaaaaatcaaacctcatctgacttcatttagcctacattcttcgtattctaatatacttttttagaatgaaatatttagatgtgaaagttaataaaagagaaatgattgttcttagggtgtggcttcctctaaataagtcatggacgttcccaggatgccatgagactcaacagggtttccagtgcaacagaccattgctaccctgattctctgtaggaaagttgaatacagcattcacaaactgctaaattgctgctgaagtcaccaatgtctgatatgaggcagaaattttttttgcctccaaagataattgtgcttgaaatataagatcctaaacttttccctctctttctctgttcaagtgaaagagggtgggggtgggaattaaaacaaacagaaatctgagagcaactctttttcagtacatgtagaaaayggagtgtggagcattgaactttgaaaatctgttatttccaggaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggtaagcaaagccattggaatttcaaagaaaagaaagcagtccacggctcccacttctggagatggggtcactggtakggaaggcaagaagggcaccatcacttctactttgctcacttgtgacttgtttaagcaaatgacatttttacaaaaatcaatgtaaaaatatttgaagtatggaaagaacagtgagaataaaataagctgttaaggtctacatagctgtgttgtggcaagaaggagaacagatggaaaggaaagacttctgccaatttagtgtctctcaaaaccattaaacccaaattgaccttcatttcaggaagggcttagtgctaaagcagccatttgatacaataactgaacatgaaaaaaaaaaaaggaaatagaatttgtgtgtctttggatcagaatgagagtggggaatgctgtgtttggtattcactgggatttatctttagagattttcttgcgctcaacagtagacctgcattcacactaggccagtgtgttccctaagtcacaggtgcagcgtttatgccttcaaagcatctgtgaatgcacggtatctggtggtggaaagggagattctagaaatttctcatctttccttgataagctaaggttctgtgtttaaagtgtaataccttttcatgttgtttgacaaggatggatgcttggttgaaagtactcatgggagaacatttttattttgaaaaattgaaaattgcaaaggaaaaaaaagacaactttagagcacttgggggttgtgctaggtaatcttagattttgctgagaattctactcaaaaggaggaaaatgtcaggagattcttggtcactttcactacttggtgattttgtttttcctttaaaggctgctcgtaactgcttggtggacagagatctctgtgtgaaagtatctgactttggaatgacaaggtaagccaattccgaaagggcaaccagtgaaagggggatttccattcacatttgaacaccatcataattgaagsctttgtggggatatagaaggtgctctgaattgggggcttagaaacctaagtccctcccatgggattgttcttcagaaattatctgacgtcacttttagttctttcaacaatctgatactttctaaacttctaaataaattccatgaaagatcctaaatttaaatacaayatgttacagccacattattggattgttttactttcttttaaatttttttatttttaatttttgtgggtacatagtaggtatacatatttatggggtacatgtgatgttttgatacaggcatgcaatgtgaaataatcgcatcatggagaatggggtatccatcccctcaagcattttggagtactactcagccatttaaaaagaatggataaatatttataattttttaactcaatcaaggatctgctagctctttttgtctgtcattaaaaaaaaaacctgatgttcaaatgggtagagcattcacactaggaaaatttttgttgtcacatcattagattttctgcatcacaaagtaaggcataaaactagactctgagattctcttgatgggcattctaccaccacttaatgatgtggaacaattattttgattacgatcgtttttttaaagtcttcttttaccttaatcctgtatcctaatactatttaagcctcagagcaaattttcatagttttgcaaagaaaacgaagacatacacattaacctttctattcaacatttattgagtgcctactgaatacctcagtcctgcaggagatactgatatgaataggatagtccctgctctcaaaatgaccacagtttagtctagagggyaagtagatatccctgacattgagacaaaatataactataaagttgtgctgactcaatatgtaattctgaaggtgaataatgcagtttaaaagagatctgaagagttgaccaaggccaggttaatatttagcaaacattgccctaaaatgccataggaggatctgtttttttaatgtcttctccaaaattcagtgttaggggatgctttttgacccttgtggcacataccgtggaagctatggtaattcctctgggagccctaaatattggcaagatgtccttttagctgtgtactagctaccgtcactccaaccaccatacactgagtcccctacactgaccctccaaacatgtagctttctcaagagcaagaaaaaaaaaatctgctgacaggttcttaaagcagggagaagctcccaggtcaagggaactgatccccacctttactctaaaagcaagaatattggctgttatgccagcatccagggaacatgctttcacgttctctgtagctttggaaaagggagacttttccaaaaaaagatccaaagaaaaaagagatcttgctctgagtaagagatcctggaagccatgtaccagccctgttggttatgaagctctgtggccacatcaattagatgcctgtgacttcatttgctcctactagcttgaaggaaggtttaagccatgagcatccccaaaccaggagtgccagggtagtgtctgggtatctggtagtgtctggggagctgaggggttctggggagaaaagtatggaatgtactgtatgtaatcctatgaaagtgtagtttattaatattattgttaatatttagaaggatgatcttcccagccagctattttaaattacagtgagatctctaaaacatttggtgtgtaaattatatccaaaattccaattgccataactcctgttgttctattttctctaattaagagtcattatgtgtttgtttttgttgtggtttttgtgggcaaatatatgatgttctcttttattaatactataaataatatgtacttattataagaaaaatagcattagtgtagaaagtaaaaagtagaattgttagcagcagtgaatccgtaaaggtctgcagcaactcaattcttgcctcctcaaaggaaaggattcatctgaggggcataaggcagagagagagactgaggcaagtttttgagcaggagtgagagtttattaaaaagttttagagcaggaaggaaaggaagtaaagcacacttggaagagggccaagagggcaacttgagagatccaactgccctacttggcccttgacttagggtttcatacattggcataattccaaagtttgcatcttttctcccctgattcttcccttggggtgggctgtctgcatgagcagtagcctgccagcacttgggaggggccgcacgcacagtgtgtttacttaggttgtgcgcatgctcatttgaggcatttttcttttaccagtcgagtattcttagaggaaggtcatataccagttaaactccattattttgcctcttattgcgcatgtttgaccccagttgcccaactcctgagatcatatcaggaagctgttgatcatcagcttcaagtattttctatctattgggagactgccgttccctggcaccagctgcgaccaattattattttagagagacggttaacaactgcctgactattacctgacggtcacctaatattcctgggttgggggtgggggatctctcctgccctgctcatgtctgcctagctacctattctgacagaatctgtccctcattttcagtgctaggagtaaccactgctcagatgtttggtgggtatcctttcagacctcattcttaagtgtatccaatcatatacacaaatatgcacatttactacttgttcccacacacaaaaaatggaatcacattatacacactttcttttgcacataaccatataccatgagcacctttttattttggtgaagagttatctcatttttgaatggctatgtgctattctattgtgtgagtgtgccataatatatttaattactcctcaacattgggaacattgaggttgctttcattttatcattattacaaacaaagagtttagtgaacattcttcaacatgtattttggtcttgatatctccataggatatttttgttcatcattattcataacagcagaagattagtagcaatttacctggttaaataaattatgtttaattccttccataagaagaaataataagagggaatggtattcagccaytaaacatgatgctgcagtagaaatgtaaccgtatggggaaatgctcatgatataccattaaaggaaaaataaaagcaaatctcaatataacagaaaccctattttgttcaacttatatatgtgggaaataagatcagaaagtacaaagaaaaatgtattttgagtgatagaattacaggttatctttagggtgggtttctgagtaattttatctttacttttttgtgtttttctatatttaccaaacattttgcattgaggttttgctgtattcagttagatattatyttttaaatgcttacaaaccataagcagcctccagctaagcccacacattgaaaggaaacaaaagttccagaaaactgaggcaatcgactgagactctgggtggcttccgtgtccttcatcagcctgtaccaccacggcttaaggtctgtgttgatgtgttttccctggcaggtatgttcttgatgaccagtatgtcagttcagtcggaacaaagtttccagtcaagtggtcagctccagaggtgtttcattacttcaaatacagcagcaagtcagacgtatgggcatttggtaaggatgtggccacatacgacctggccctgtttcataagcttacttccacaacaggaaaccacaagagtagcaatgtccattttaaaagggcccttgaacacttacgaagttacacatatagcctgagagaagcaagctgttgaagaaggtgatttattttcttgggtttggtattaggatgtcttctacacatcttgtaatttacatcctgctagcactttctcataaaatcaaaagggataaatctactcagaggttgaggtggaaggattgtttgagcccaggagttcaagtccagctggggcaacacagttaagaccctgtctttagaaacatcaaaggggatgaaagtttttccagtgaagatttcaaataattttttaaaaggagtcattgaaagctgaatctgagtttttgctgagccccaaacgttgaaaagacatcaattttctgcatgaaaataatgggatagccattcccttctgcgctgaccaattcttagtgtaaacaccacacatgacttggtactttctttgactcgtgcctagtttcaagtagtctcctctctgttaaaatttatattttagattgggattggcaaaccacagcccaggaccaggtcagttggtttttgtaaataaagttttattggaacacagtcatgcccattcatttatgtattatctatggctcattttgtgctacaacagcagagtagagtagttgccacagatactgcatgtcccaaaaagtctaaaatgctatgtggccctttataggataagtttgctgactcttattttactaaaatatctatattaaaatttagtaaaggtcattagaaaagggaaacaattcttaaattgtgactacattttatgatattttttctatgttgtgagaatatcaaggctattttcaatcactgtcggatggacccaggataagtaatccaaatgtgactgagacctatttcatgccttagttcataagtgtaatttgatttactgcttgtcacctacaagactgcctttgaaaaggggaaaatttagttatttatttctctatgtgacacaatttttaaaactaactattccctttgtaaaagtggcattgttcgttgttaaaaaaaaagataatcaaatacacacagaaaaagaaaaaaaatcacaaagatagcattttggtgaatacttgatgccatgttgtactgattaacttttgtaccttgttgtcaaaattagttttgaggctgagtgcggtggctcatgcctgtaatcccagcacttcgagaggctgaggcgggcagatcacttgaggccaggagttcaagaccagcccagccaacatggcaaaaactcgtctctactaaaaacacaaaaattagccaggcatggtggtgcgcgcctgtaaccccagctactcgagaggctgaggcacgagaatcgcttaaacctgggaggcagagtttacagtgagctgagattgtgccactgcactccagccttggcgacacagcaagaggctgtcttaaaaaaaaaaaattagttttgataatcaygcatcaattataagtgatagcaaaaaatcaatgccctaatttaataattacagcttgtttttgaccaaaaaatagtattacccagcttgattatttaccgtatgccatagaagttggccccagatattttccagctgtttataaacactaaattcattcttaaacaatatatcccagtgaggatacccaaaatgaatcagggcctctgatagcaattcccaaagaagaaccccacagatattttgaaataagtgtgtagccttccaaagagaaagttatgaggaaactgcattcttttggattgttgttttagactgtgtgatttaaaagaaaaaagcagccataaaatttataaggttgctttattataaatatttgaaactggctgactgttgaaattttctgaccttggccagcacagcacaactgccaccatttagagagcacttgaaacatctcagtgctcttttaagtgctttacgtgttttatcctatttaatcctcacagcaagtccatgaggtgcaaataccccattttatagacggagaacctgaggctgagaggggttgagaaacttatcccacctgtaagtgacagaagtcaacttcaaaggccatgtctaactgatcccaaatgccatcctcctgaccaccatgaccagaaccgagatttcttaacctggggactgcaatttcctggatgagttttgggggactgtgaacatcctgaaactgaacacaaaaatgctgtgtattcactttcccaaaggcggccagtggctttcatcagattcccaaaagggtgcctggcccatatgagattaggaaccactgcagcaatagaaaggagaatgttgtcaatgattttatcttgaaatttccactgaagtgtaatctgattgtgcaatgaaattgttgcatgcagctgccaaagccgagagacggaatgggtgaggacatcaaccactcattcataagggttggggcaggggctcactacacaggtagttgtcactgtgaggctgacaactcacacttcacaggactagcgcaagaattgtgtcttggccccaagaggttcctctgtggctgcccttgccattcacccactttccagcaagcacagatgtacaggtatcagggaacatggggaagaaaccccaggctccagaagcaatggcacaggctcaccttccaagctctgctcatttcgctgggactcatttcccagggatccctcactctgacccatagccttcctgacctgttgtgtgaaactcactccacaaaccctgtactttctgataacagctctcttccttttttatctgggccacctcttggtgtggtgcagggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgaggcaagtgtattctctgggtgggctggaaggggtctcaggcacatccggggtgattactgcatcaccactgggacaaagcttttttgagggaaagcaaytggtacagagcaggagagaatggtcctcagcccctgccctaaaatgtttgtaatctaaaacatgcgggtgccaaacaatttactgaacaacttacatacagcagtgttctaagaacactataaatattaacttacttatgcatcaggaaacacactgaggtaagtactatcattgctgaaactaacagaagagtaaacaaggactcagaaaggttaagtgacttgtccaaggtcmcatagctagtaagaagtagactagctagtgccagcgtccctgttcttaactgcaacactatggagctcctcgagtagaaaataagtagcagaaaacatctaaccacacgtagagaacacataatggacactatcccatcttctctccccctgcctcccaaacactgaataaaagcattccatgcaggtagaagataagggtatcttatggggaagacatggagctgaagcttcaggggattaatttgcaaagcatccactaagttcatagaactaatggaggttgttaaggaagtatgaggctccatttgtgccctcactgaactcaaagtctttacacacacacacacacacacacacacacacacacacacacacacacaaataggactgaaaacaccaagcagtttataattatgtgcccaaattagaaagacaaggtttttgccataactttcaatggcaaaaaacgtgattacttttgcaccaacctaatacaagaagcgctcagaggaaagagaaaccagcttcctgagagaaagcagcttcttgaatgcattggtacctgagctgaagcaggaaatctctacaaaatttcctaagtatgtgagtggagacattgtaaaagggtgtccaggtgagaacagcacaagcaaaggtgtggaggcaggaacgagcatggcacgctaggctggtgctatcgttggaagggctggagataagtttggaagagtaggtctggttcaggttctgcaaagtgaataacaaggagacaagtgagagttttggtttttgtaggcgatgaggagccactgaagacttttgagcagtaacatgataaaaggaggcttttgagaacattattctaagagcccatgttcataatcattatatggtacttcctcaatggcaaagggcctaatgctgcattcatttattcactagtaaaaggcaaattggtgtaatggttaagcctgtgggttctggcatcagaatacctgggttgaatcctgtcgtgatcacttactagttatatgaccttgtacaaacctcctattattatctctgtgcttcactgtaatgtaatgcttacctcatagaatttttgggtggattgaatgaattagcattataaaggccttaggacaatgcctggtacacagtgctgtttttctgttattaatattgtgtgtgtgtgtgtatatatatatatwtttttttttttttacaaagcatctatgcaccaggcagtacgcttggtgctaagaataaattgacgcacacaacttaaatagtttctaaactcttgtaccggagcctagagtcccactttggaagagttgctgattgcatcacataacaatatttttcgtttagccttaaattatcacctggaatatgagcactctgtaatttcccaccctatggcatttggaacagtatataaggtttccacacctttttctaccccaaatgttgactatgggaactatggatatggacagagatatgcagactacagtggccaacagagcacttatggcaaggcatctcgagggggtggcaatcaccaaaacaattaccagccatactaaaggagaacattggagaaaacaggatgagatgttaaagtaacccatcttgcaggatgacatagaagattggtcttctgttgatctaagatgattattttgtaaaagactttctagtgtacaagacacagtgtccaactgtatatggctgccaattagttttctttgtttttactttgtcctttgctatctgtgttatgactcaatatggatttgtttatacacattttatttgtatgatttcatgttaaacttcaaataaatgcttccttatgtgattgcttttctgtatcaggtactacatagctctgtaaaaatttaaagtaagcaataattaaggcacagttgattttgtagagagtattggtccatagggagaaactgtggtcctttataaatagccagccagggtcaccctcttccccgatttgtagatgtattctatgctcttaaggtttcatcttctccctgttaactgaggtttctaccacacttttgaataatgttctttcccctctggttatctgaagattgtcctgagaggaagacataagtgttgtgattagtagaaactttctagtagaccatgtttcttctggattgtaataaaattgttagtagctccttttgctttgttcctgtctctagaaagccatctttgaatcgttaattactttggctttaatcagtggtcacctagaaaaagctttgtaatcataacaccatgactttaattcttgataaaaattcagatgcacacaggaaggagcactgtaaaactggtaggagctatggtttaagagcattgaaagtagttataactcaaggattttggcagaaaggtatgagtttggtcaaaagttagattaaaatttgaaatagcggcaaaataagatttagttgtattttgttttctcacagccaccacaagactgaacaaaatattttctgtttgggcattctgaggaagctgtattacagttaactgttaatgctgtgtgagtttagaaaaagtcttgatagtaaatctaacttttaacacagttagtgcatgaactgagtagttaaacatttccgtattcagacaggaatagtggaaaaggtatcttaggtgcgttactcaatccaaatgtgactgaatcattacagtggaccctcatggtgcattgaaaagaaactgttttatatccaggtttcagaggacctggataaataaaagctttggattttgcattcagtgtagttagttggattttgggacctttgcctcaatgttagctactgggattggcatatgtgttcacaggcagagtagttgatctcacacaacgagtgctctcacaaaactggtgtaagtttcttatgctgatgagcccccgcttttttttaatttggtgcctacaactttgttacaatgattgtacttgctgggctatcaagttacaatgctcttggtcttttttgctgctgtttcgctatttgtccttacacctaggccaagtaccaatgttagctgttggaagggattctgtttattcattcaacatgcaactatctaactttagggaatggaaggaagttcatttttaagttgtgtgttgtcagtaggtgcagtgtctagggtagcgaatcctgtaagttcaaatttatgattaggtgacaaattgacattgagattgtccttttccctgattaaaaaatgaataaaggctttttaaagaaacaaacaaacaaaaatattgtgtctaagattatcaggcagcactagagggtcagactgggtctgggtagagttggtcacagccaggctgacttactgctgtcacctgtcagatgaagaagagcagacaagggtttttcagttgaagcccagaacctccctggccctccctactctagctcctgggaatatgactgcaccataggatggacaggggccctgagtcgggaggaactgccttcttctcatggttggttcataaaagcatgtgaattgtggcagaatctgtgaagaggggtttgcactgagacgacaatatccagttaaaacattgcacctaatgagcagagcttatagatttgggttttccctccttttttagattttattttgtgactttctcaattcataaagagattgaaagaacattcacaattttcattagattttgattcatccttctggtatttctgtatgcaaaaacaagcatatgtatagatgtgtgttttcttgcttccctttctctcttacaaagaaaaagtagcatatgaacttctcctctccataggcgttgcctcactagcaatgtaagagggtacctattttcttataacctcaccaatggagtgcattgtcaagcttttgaagaattcttgccaatctgataagtgaaagcttgatggcatcttagtgcagctttaatatatatatctttcattatgaggttgagcctcttttcacgtttttaagggtcattttgtgtctttctgaactgtcatgtcttttttcttttttctgtcaggttttaaagatctctttacaaattagggagagtaatactttaagttatcagctttatttgattgagggtgggtgggtttttttttctttttttgaccatgcagaaattyttcttaatatagctgaatatatcaatatttgttttcattgcttctggaaattgtcatagataggctttctcatgcccaaattataatgacttttgccaggattttcctctagtacttttaagattgcattattttccatttatgtttctgatatagtttgtgtttgttatggtatatggtattaaatatggctccaaatatataattttatgtgactattctgttgttggcagccctatttattaaaagaccatcttatcatcaggaatgagataccaccttaatggtggtgaaatgccaccctaatattatactaaatttccatatgtacttgaatctatttggagacttcctcttctgttctttggtctctttgttcatgtgctagcaccacactgctctgattctgtagagactttatgatatgtttgaatactaggtaggctagcacccctcattgctcaccttactgtataatttcttagccatttttacatattttttaattctataaaccaaagaatcaatttgtttagcttgaaacaaactcattcatatttttgaggagattgtatttagtttgtattttaagttgggaaatttgacatctttatgatactgacttgtcctagtctagaacgagggaagcttttttttttttttttttttttttttaagacagagtcttgctctatcactcaggctggaatgcagtggtatgatctaggcctactgcaacctccaccttccaggcttaagtgattttcatgtcccaccctcccgagtagcttggactacagttgtgcacaaccacagctggctaatttttgtatttttagtagagacagggtttcgccatgttgttcaggatggtctcgaactcctggcctcaagtgatccactcacctcagcctcccagagtgctgggattacaggcgtgagccactgcgcctggccagggatgcttttttatatagtcaagtctacatttgcatttttcagcagtgttttaaagtcgtccccattttagaggggcacacttttttagtgttttattttggtggcgttgctattataaatggggttttctcttmcatgataacttctaagtggttactgtaggtatatgtgaaggctattgattttgtatgttaattttatatcctgctctcctagtgaattcctttattctttaagtctgttctaacattgatactctcagattttccaggtatacactaaaatgcttgcaaataaagagactttttcttttccagttattggggmtctaattgttcttgctttccaattgcattggttaacaccttcaacataatgttaagagtgattattatagtgagcgtccttgccttatttctgacctcaattgaaatgtctgttgtgtttccacattttaaaagttgctagctttaggacttagatgtaaatattttatatattttatcattgatcataactctcatcatctaaaacattgggtttcttgttgtttttgtttagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtggacatttgtcttaatatttcaatgttttcaaacttcagtaggcatgataatcaaatgcagagtttatgaaaagattcctagaaactacctccataaaacctggcggaggaggtctgagtgcagcctgtgaatttgtatttttagcaaactcccagatgttactgaagcagttgttctgaactgccctaggggacctcattatatggtggggtatcattaggtggtccattacccaatccaaatggcacaattctcgtctaatatccagattagtacaatgactctttatgtcatgtataaaactaaagttaaataatattaaataatacattaaatatgttcacataaagcaaattttttaagatgctgaggtacaatttctagaattaattacattgttgctttctaatcatcttttttttttatataagtagacagtttatttgggtcaagtttaaggattataacctgggagcaaagactcaagttgcctggaatctacactttgattagcagcagttgcaagaggagttgtaaagacaaaaacaaagggacagagagtgggctgatacagagttgtttgtcagaaatttttatttatttaaagaaataacattggttattgattagatatatatcattatggtttagggtatgagatatagtgtccaatgtggtattattagtttaatatatatctacttgtggcaatagtgaacagtttcaagagatgaatacataatttaaagggggagaacgacataactgcacgttcatttcaatgtctgagtttgataaccaaaagtactttcattttttagataaaaattttctatttcccaaatctcaagacctggatacaaaatgtagagctgcagatttaaggcctgaatggctggagtagcaggtgttacctgaacatttgtgaacattttaccaagagaaaaaaggggaaagtggagattctcatgtctacatgtgtactcaatgaacacatgttactctgattaggtttgtgggccccatggtctccgaatcagtttcaggtctgaagataacaagagtcattgagggaaataaaacgattgattgttgcccagtgaagttggtagaaattaggatgaactatgtatgacatggtgctgtaaattcttctacttgtggactaattttggtgaccatctgtctaatcatcttaaatccttgagtttggggatctggggcttctggctagtttgataactgaagtttctatttcagtctgctatcttaacacaaaaatacagaagtactattttagcttctcatgcctattactaaatagtatttcacctttaaaacagtacctgcggatgcccttcttcacggcctgctaccgaacccacaggttttaacctctttctgagtattccattgtcttttctataatgtcaagaagggagagacagattctgtagagggcaccattacaatgaagagacaccccaattaaaccctgctgctattttccagagatcagtcaataatctctcagagacacttatatcctctctcatcccactctgtccttcagccaccagctagtttcaatgctccctcttgcttatttgtttcttgacatttcattaataattccttcatttcaacacagaattgacactcgttaacagtcttctattttttacagaggtacacaaatctcaatttataattaaatgtaactcaaaataatcactagggcatttgtatattttatttttgtgggttttttttgtagtgttgactgtatgctaggttctttcctacccaagagaaaagaaagaacaggtgacccaaaccctctttctcaatggacccacagtccgatgggggtgccagcctttcctgcaccaaagactgtttccccactcagaggatgagctcatgcacaagctgggtctttctggtctccctcttgaagatttttttcctttcttcttcttatttttgtatatttaccttttaaaaataatcctctttataacaaaatacacgcttgttgcaaaaattgtttactatgaaaagaggccaaagccctgcttagaagcctagctgcaaaaatcaagtcaggcagcaatttaaggtaccactagaggtttatcagaaaacaagtccagtgatgctaggaggagccaagtaaaagaacactattcatagtatttcaaacgtgcacaatgattttttaatgctgtataactgtgtttagtggtgatatgcagaatttattgttgttatcttaaaccaagtgtctgcctacactcttttggcagtgaagaaaaaggaagactatgtggtaagaaactttcccaaagggcaggctgcagagcaagttcagataaatcacttgctaggtaaaatccaacagatgctccctcgtcttgctgagcattttctgacctaccagaagtcaaacacaaagtcaagagggtctggcaaaactcacctcatatctacttgagtttattaagattccaacacagtagatttagcaagttgagtttctcagtttttattctatcttgagagtgggtttatgaggaggagagattggacctaaggccccatctttacctaaatgtggagggaggaggctctcaaattaggaagaatagttcattgagagacaccagagaagaggaagctagcacctgccatttctggcctgatcactatgtttctctggtctgtgagctccacaatggaccttttgcatttgcagtttcatttaatccttgcttccgtatagcccagggtttggcaaagtttgtctgtaaatggctttgtgggccatgccgtctctacttcaactactcagctctgctctgtagcatgaaagcagccctagacaatatgaaaatgaatgggtgtggctgggttccaataaaactttattatggacactgaaatttgaatttcatatcattttcatttatcatgaaatcttattctaatttttttcaaccacttaaaaatgtaaaaatcactcttagttcacaggccagacaaaaacaggtggtggggtggccgggcacaatgactcaggcctgtaatcccagcactttgggaggccgagtcaggcagatcacctgaggtcaggagtttgagaccagcctggccaaatggtgaaactgcatctctactaaaaaatacaaaaaattagctgggtgtggtggctcacacttgtagtcccagctactcgggaggctgaggcaggataatcacttgaacccagggtgcagaggttgcagtgagccaagatcgcgccactgcactccagcctgggcgaccgagcaagactccgtctcaaaacagaacagaataaaacaaaacaaaacaaaacaaaaaaatgtggtgggcaggatttggcccatgggccattgtttgccagcttccatcctaggcccaggcaccggtccctctttgtagagtctccatcctttcagaggatgctgctacacaggagaaggaccacaagcgttacctggtgggcacagtgaggactgttctggagaaaaccccaaaattaagttacggaaataagcaggtttttctttctgtgttacagttggacactatgtcacatgcacatgggtcctttgccatgtctggggaggctcttttgaaggtgttagatgatgaaattggttcctgcagaaattattcttgcactgtgctgaaccaagtttatgaacttcataaagatcttgtggcaactacaaaggatgtttagatagcagtagcttgacagaagattttcatgatatattagagaagatgggacatatgcaagataaaagaaaaaactgtctatgaaatggttgcttagccaaggagtaaattatattgtatgttgccccaagctgtgggcccagtgaatggcaggatggtgcagatggtgatgcgaaatgttgattgtatctcgtaaaataacaaagaactctatctctgctacctgggtatcagataattaagacatcaaagagcctcaaatgacccttattttgaggttattttacagattatgaaagtcatcttcccttcacttggctaactgatccacaattaccatagagaatttatgaagtacaaagtcattgtaacattatgctggtcaccacatagaatgagttaatgcatagagtttagatatgttaatctatttaatctagttttaaccagtcttcaggtatctaagaaatgctgtgctcacactggggtagtgactgtgagaaatataaaagcagcatcaggtttggttcctaacctgatggtgtatacactctgtacacaacttttttgggactagttttacaattactttgtacaataaagcaatctgagaatttgcaatacatcacgagacatttggaaggccaggagccccagacactcagatgataactttgttcatagaactgaaaagcagacaaaacgtaaagaagccccagcacataagtaagcacaaggagtgtgtaaatctagcatttattgagtgtctgctttgtgctcagcactgctcaaacactgtgagcaaatacaaaagatttaagagactgggtacccacttcagagggtgaacatacagttggaatttccattcactccacagttagagaacagtagaaatgagtttctatcaggcatgctctgggagttcacggaggcccctggctctagttttgtgttgtcagggagatgttgatcaagcaccttggaagtgaaaaagcaatgtcctctacctgttccctggattcttctctctttagacctgtcaccttgaagaaagcatgatcgattccaaacatcactgtaggcaaatcaccatagtacttgaactgagttactgtgaagaaagcatgtcatccttgacaatggattaaatgaaagtgagctaatgcatgccattctcaatccttgcagctacaccagttcccaggcactgtccttacaagtgatccatccatattccatacaagatccaacacttgctccaatgatatatccttgttttcaacttcagaaattcaacagacatttacatttagattatccctgaacagcctgtgagaccaaatacacactttccctaatatactctaatacaaaatccttattaagaaacagaacagaagtcaaatccagagacagaaataaatactgaaagcaatgtcaatgaagatgctctctccttggccatgttgtctttggacaattttttttctgaacagagtcatagttttgacatttaatgatatctttatcatcttatattttctataccatgaaattaacatttacatacaacaaaatcacctcaagaggaaaaacatagatttttctaaaaggaggtctgaacatcatcagtgttttggaatcctggattattttctcctttgctaatatcgatggaggcataaggattttctccacttcttgctttatttttcctgttaaatagagcaaggttgccttaatatacttatgttaaaatcaatcggactgatgaaaatcaaaaagtttcaggggaatctgtgttaaggaggctgggagggaggaacaggaagtttcataaactgttgatgtgagtataaattggtacagccgctattgagggcaatttggcaatatttatcaaaattagcaattgcacgtatgctttcacccagctttcccactgctaggattcatcttaagggtatattggcatactcaggaaattacctatattaagccatcactttttttaagtaaacacaaatgtttggaaacaacataaaagttcatcaatagatgactgtttatcaaaattacaatccattcgtgaaatgggaaattatactgccagaaaaaaggagaagttttttgtgcaactaatgtgtaatgatctctaaaacacattaagtgggctgggtgtggtggatcacacctatataaataaaaatttaaaaaaaccattaagtggaa

SEQ ID NO: 12431 - DNA, 50874 bp, Homo sapiens
ttggacttattcttgagttctacttgctactaaacaacgtaagaaataaacatgtctatattgagtgttgcacagaaaatatttttgaaaattatattcagaattaggaacatcgcctatttggctagcatgtcaatttcaaattgttcacaatttgatcttcaaaaataagcctgcttattgtttgatgttttctttgttaactttaggatcccaagagaagccactttgtcttaattgctggggagccattaagagaaccagttatccaacatggtaagaccaaaatgacaatgattttcttggttgattttccttttctttgaaaacagtatacatgtatactattgttgggaagaatagctggttttttttgtcctgtctctccatctataaatctgaggattgtttaatttttctgtcatcagagggaaatatatatgtgatgtttattcatctctttttttttaaagaaacatttcttagatacctattatgtataggatattgagtttggaactgtgggaagaacaaaaatagtatttttgtattatgtcatagggaattttaacttgaaaaaagagtctacagtctactgggaactttaacatcctttttatctttatcaaaaataaaggtgatttcaatactgtcctgtagtctattgcatttttagtaaaaaatatgaaactcttaggaatagtatttttaagaaaatagttgttattttttgtttatttaaaaaaatgagtagaggtaactgatatagccgaaatagtactatacttagaggcagaaaatcctggcttaagtacccataacgattacttcaactctttgggttttgacttcttcatatcattgttgtttgattaaatgaggaacatctaaaagcaattaaaacccattttattatttagataaatgcttacaaaacatatgtccacttcaccaattattaaattcaacgtgcattaaaatcccattgcatttccctgccttgcatgaattcccaggtacacacaatgattgcagataaaccccagctgctcatgaatttaaagaacacggattgctttaaaaatattcttttttgttctactaactacttcagggggaacattaaattgtaccctgccttgcctgtagcatttgacaaccattttgtacgcatccgatttccattccaaaggtttgtggttcttgtttccttttctctcaactgaaaagcactgcaatattatagtttgtttttctggaaaaagccttcagacaaactgagtagggtcataatctttattcctagtaactaacatttaggtgggaaaaacatgtgtgagatggaagtcttattttaggcaatctcctctgtaccaataatgaaaagcaagagtctaactgaattaggtgacagatcaaaggagtgggactgctcaaagccaccctacactggggtcatgtggatcctctcccagtggcttggaacagagggacactaggtatgcctgcacatacaaactcggagtaatcagacaaaataaatatgtcccttgaaagttcagttactgagaagcaaagcattttgtttttattttttaacttttaaaaactcagacatttaagtttttcttttacttatgtgtgtttaaaggcagccacaaccatctcttgattgggaacttgcacagatctcatgaattacctaagaccctttctcctcttatcatcgtgtgtccttaattattcatccacagattaagcacaggaaatcatagaatgttaggatagaaaataaccttagccatgatgtagtcatgcctcttttatagatgaggaaaataaaatccagatattttatttatttacttaatggatgcttgcatagaatttactatttcctagacattggttaaagcactttcctaatgttaatccgtctaaccttcaaaacaaccctatgaggttggtactctcatgcccattttacagatgaagaagcagaaggtcaaaggttcattggcttactcaaggtcacatagctggattcacactcaggctgtctgttttccaaacaccctgcccttctgcctcttaccatgctggtcgtccattgctctgccctgtagcttctctaatggaaagcgattgttagcagtggagctgggactcgaaccctagtctcctgaccccatgtcttatgttcgctccactataccaaagttctacataacaagaggttagacacaccattttatacaagaggggggcttcagaggcttaattagagaagtgatgaaagctataatttgaaagagaattataggtaactatcaaataattttcttgttcacaacccttgtagttgatcaatttaaaaacatgctttctggattcagttttctccttgaagatttgaggagataagcttcatcagttagctttaggggactctaagcttccaatgcttccctgtataacagaggttatacttgtttcctaaagtgtggtccatggaccagcagtatcagcatcacttgggagatagttagaaatgcagaatctcaggcctcactccagacctcctgaatcagaatctgcattttaataagattcccagctgattcatgtgcacgttataaattgagaaacatggcagactaccccagaaagtgtcaaaatggaagcctagaagcacaccattcttacagaaaacagttgggggatgggagtactgctccacaagtcccaaccatagcaaaattatgaggcacaagaatttggtccttgactcagtacctgctcccatcttccaagttgcatttccctttcccctgcgtgtcctttaaaaagttgtcttccccagggtaccctcttgggtttattgtttattctgcatatgttaactctctttttctttcctacctgatatagtccaaacctccatttccagatgaaatttctctcatgagctccagatccatagtttcaacaatgtaccaaaaacctctgcttgggaaaccactttattgtctctagtacttctatgttaaaatactcagaactgggccgggcgcggtggctcatgcctgtaatcccagcactttgggaggtcgaggctggcagatcacttgaggtcaggagtttgagaccagcctggccaacatggtgaaacccaatctctactaaaaatacaaaaatttagccgggcatggtggcacgtgcctgtaatcccagctactggggaggctgaggtgtgagaattacttgaacccgggaggcggaggttgcagtgagccaagatcgcaccactcaccactgcactccagcctgggcgacagagcaagactcggtctcaaaaaaaaaaaaaaaaaaaaaaaaaaaaagaaaagaaaagaaaaacaaaacaaaaaatatccagaactgaacaccttgctccatccaaagcctcccacgtcctgtatctcaaatacccttaacaattccaccattgactcagcctcccaaattagacacctgctcttctaccttgatgccaaagtcttctttaaaaattataaatcatattatattactccctacttaaccttacagtgattcataatcacctgcaaaagtaggtccaaacttcttcctgtagattgcatccaaagcccagaagggtctggtttcttcctatatttcagatcgccattttttccgcctttgatccctccttccaccactgtacccctatcccctccagtattcctccagcatactaagcctgaacatgcctttcctccgtgtgtgactgctcaaacatcactccctctgtgaatcctttcctggatttctcctcctccccctttctgtgttgattttatagtttttacacttttatccttccatatttcaaacagttttgtaatgatttcttttcatatctgtgtgatagatttgaatccttgaggagagggagtctgccatttatttgtctttcatctttatgtctctagcttctagcacaatgtctgtcatttaatgggcattcagtacataatagataggtaattgaatgaatggatttagatgcctgggtgttttctttctacttgtattctattccccacatcctctccaaagatttcagcatcatcaagacatattatcctgtgtcttccttctgaagatttaaattatagtgatcaccaaatccatgttgatatgataacaatggttaagaagtttgaatatgttattttctctaagcaatacagttgtatattaatcagaatctcccagagaaagccccttagagcaggcagttccataaaaggaatgtcaggaacttctgcaggctggatgaggacatacactgagtgaacaagtctgtcaactgctctaaagacactgtcaatgccatataaaagctggccttgttcatctagcagatcatgggggtgagacagtccagtgcctctctgcccctacaatatatgaagaaaggggaagaaacacacattgcctcctggtagattaggggaggacttcttgtacatttttagcaaaatccgagttcagacccagcaattagacaaaagggtcagcaaactatggtcgatgggctacatctgcccactgcatgtttttgtaaatgaagttttattgggacacagccatacctattcacttttgcattatctatggctgcttttgcactttgatgaaagagttgagtagttgagacagacactgtttgacccacaaaatctaaaatacatactatctagcccttcctagcaaacatttgccaacccctagaaaacttttaaaaaatgatgctcttcgacttgaaatttttataatcttctgtttattgtcaataggtgctgctgattttcaaaaaatgacttagaatcctcaaataagtatacagccttatatgctgcttagacaccaaagctatgataagatttgtcagttctttgtatcagatgggttcaattcttgacatcagctaatgttataaaaataactacaaaaatggttgtaatagaaccaaatctaagactctttttaataaaaaagatcaccattgctggtgagaaacctatactgaatgggtgagatgccattgcatttatctgaagtttcgtctttataatcaataatcatatacaatcctagtcaagaaactcatcttacagtccttggggattgaacactgtgaaaataaacttttactcttcggatgtgcttggattttgttttaaattaagaactacagaaatatatatcatttctagtggtagaggaaaatattgccacccagaactttctgaatgtctctttctgccctaggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaatcagtgtttttcatttgagatacctaagttactaagcttctgtttaaaaagtcgttttgtgtatgtttgcctttttttgcatgtatggatggatgtttttattatttttgtgcatgtgcaggttttaaaaatcatatttgattgctttctgtgtgtcattggcagcagatgcatgagcatctgaggtcccttcttaagcaatcccactgagatacaaaggtcaaagctatgtgctggggtttcatgttacaggttatctgctttaaaataacggcagccctgaacatttgagtcagttcttaaaactgccctgctattggtagggacgcaacaggattacagccaagacttctctgcattttctgccaaaatctgtgtcagatttaagacacatgcttctgcaagcttccatgaaggttgtgcaaaaaagtttcaatccagagttgggttccagctttctgtagctgtaagcattggtggccacaccacctccttacaaagcaamtagaacctgcggcatacrttggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaaggtaggtgagctcaatttttaatgtgatgaagttctttttattggctcatacagaggactttctttgccctcactatttttgaaacaatataaaaatgcagaaccatcctagtagtggactggacaggatatatcctgcatttcttggtgactgttctgtttcttagtcttattaaacttctggccatgagtatttgaaaatgctggggtgggggttggttgttttttgaagttatggtagaacatgagcagtctggaatctttttggatggagaagtttctcctcggttgcatatgcagatggcacagtggttttttaatgaaacattgatttgtttttatgactgataactttgtgggccatttattttcaggtctttgtgagcagcagaggttagtttattcgtttggtaaattgaaaattgcagtgctttctatgaacattttctatctgcttttgcaaattaccaattgctgccatccagaaaaatgttttctcagagagtgtttggttttttcgcttcttgaaaggtgtaaaattcaacactaatcaaatctttggttctgtgagcaagcatcaaatagagcttaacgaacagagagtaatgcaaaaaattaaccagaatgttgctgactgctggaacaatacttagcccaattttatgcatttcatggattatatatattttaagcttctattttgaaaatgattcggatgtaattgttttgactgaagtggtgctaaatcattattgatttaggaacttctggccttgaaaagacaattaaatgtgagtttgagtttttgtagctgttgtttaggacgtgcattttcaacaggggtgatatcgcccccagcaggggaaaattggttcgtggagggatgaaaaagttttacccttttgatacatcacgcacagacgtacatacagtacatatggtatgtagtttaaaatacgttatacattcaaattgcatagggggaaagtgtcttcaaaggctcctggctggtgttggtggcctggcgagggtgggggctgatatttaaaaatgttgaacactgagctggaggtgagtgggaagtcaccttgtctggcagccagcacttttctaacttctcaaattccaaatttacatgggagaaatcacagtgtttggctccattttactgccaccagccttgatattggatctcaaggccagattgtaggtaaatgggaatctgactgtaagcataggtaacaggagaaaacggtctgacttgtttgaagcaagtaagacttttccgactgtccagctttttcgtaagttcatraaacagaaatcctttagatgtgctgggctcctcgagttttaaaatatttccattttccttgtaaaacatcactttatctgatggtataataaaggagactgaattgttggacataagtcatattctttaggttgctcagctctttcaaagagcacaagcaccaagaatgtctcaggtgtcctgggcactgtgaagttttatttatttatttatttatttatttgagacggagtctcactctgtcacccaggctggagtgtagtgatgcaatctcagctcgctgcaacctctgcctcccgggttcaagtgattcccctgcctcagcctctcgagtagctggaattataggcacgtgccaccatgccgggctaattttttgtatttttagtagagacagggtttcacyrtgttagccaggatggtctcgatctcctgacctgatgatctgcccgccttggcctcccatagtgctgggattacaggcgtgagccaccgcgcccggctggcactgtgaagttttaaatgctttgaatgtactgttaatatataaatttgttgaatggagtaacgaaggaaagcagctgaatttgcatgtgacagaaaacaagttgttacacgtggaggatgcagcattatatrcttactaatacgattagcaattttttttcagaatatatcagaatttcctttaaaaagtgaagctacatatactgaacttatatccaccctacccctcgctcaattaaattatttctgatatgaaggaaaggattgcctatagctaaacagaagttttggcatagatatgactgagtggtaagggataatgagatatataatattggttatagttttcttttttccccaacttttaagaaaagaaaatctaagaggaaataatgtttctaaatgttaaagttcttcttgttaaaattaaaatgtagtgtgaaaacatattcatggtggtaatggtttagggtggtggtatttgaattttttgtttttttttttttactttttgaaataaaatgttttatttattataagaaattcatggtcttcctcggtacttggtccatatgtatttctttctcctcaccctcccctcttctaaccacctcttttccagaatggatggtgatgccaattttgctcctaggttgtcctccagccacccccagcccagttttcactttctagctttgaagattgtccagttttccagcttagactagcattgcctctacgatagttctaggtatctgtgaagatttttttttttcctgtagcaatcatgaaatagctactagtgctctggacgattgtgcttaatgccatttgggtgtaaggcctcctaatttcattagtcttaccacttgtgyttgcaaggatagctgtttggagtcagcagtgcatggaacatgtgaactgagacaaatctgtttgaaaatctcaacttaagatttcaaatccactgtgtatactatttagctgttaagtttctcagtctaagaagaacacgttttcctctagaaataagcttaacccagtacctatgcatcgttcattaatataatcagattacggcctagatgtggaatttatttctgtttctattttctccagctttttaatacagctcagacagtcatatacagttgtacacgatgtgcactgcacaactctagggtgctccatgcatatagacatatctgtatgtgacagccctaagtacaatgtggtagacactctggacatttggtaaataagtatctacatcctcactcttctctcattcacattggccttctggccagcactatttctggtttatttaataaacaattcttgtcccccagaaattctgtgagtcttctgaagatgctggggaaagccagccttcataaatcttttcaatgtcactaatgaagacatgtcactattgcaacaaaggaataccaggccatagtaggctttcacaacttttttctgacagaatttgtttctttctgctttatcttccctgtgtactgtctttttttatccaccctctttcttaattacactggtagaagaatattggtgggtgatggagtcattcacattctgtgtaagactagaatcagtccaagatccacaggaatgtgggatacttctttcatgagaagccacatggctcacaagacttctttacatttgtgttacttgccttctcctgaaattgtctctacagtgaatcaaataacaaggactgaggtgtattttccatatttaattccaggaagcagtcccactccttctccctgcccgatttccagttccaaagtcatgtacagggaagtccattgactttgatgttggtcaaatggcccagcaagcttttgtccacttttctgtcagacacagtccttggcacaaaagacatctgaaatacttcccattaatttcttctttatttatgaccttgtagttaagtgtgttgaattatatgcttctatacacatctgttttaatccagttactcacttataactggtgactgaaacttttatatcactatagcgtattattggtacccaggatacaatagaatcctcaatatcttacatcttcaatatagtacttccttgtatgacttatttcttaacataaaaatcctgttttagacctgtggataaacctttactataaatcccagagacaatttctggaatgagaatatagtatttgtccacacacatgattccatgtagaacttggggtaataagatctgggactcccagatacatttattattaccacaattggatagaggtgctacagaaataggcacacaaatgacagtaaaattgtttctgagaacatttctaggctcaacttttttctacaacttaggatgaacagagagagtggaaactgtatataattgggaatgtgactgagatgagacaaagatgacatggaagcatttcttcttcccttgcttttctggtggtaagttcactcttctgtcttccttgccactagttcttgcagtccctaccaagacactagggcattatacagcaaacacaccctgaggccccctgctactgcatcatgaaagccttagctggttgtgatgtcctagttcataaagaatctgcctagtctctcattagagctttccaatatttgacaattcattcatttatttttttcaacaggtatttattgggcaccaatatatctaggcattgatctaggggctgggaatgaagcaggaaataagtctaggggctgggaatgcagcaggaaataagacaatgtttcaattctcttggaatttgcattccaagtgtgatgggtagaggcagacaatatgcaaatgtgtaacatgtcaggtgtgataaatgctatgaagaaaatcaagtagggggagcggatacagtactgaataaatcagaggagacctttctgattcagttatgtctctacagagtcctgaaggtaataagagagacagaggcaaccatcagtgcagtggccatggtgggcgcascaagttggcttcgatgtctgggtattagccagggagccggtgcagctggaggtggggtgagtggaggccagaagtgcagttgttgaggttggagaagtagccagagaagatcatgtaaggtgtgactgtgctcccataaaactttatggacactaaaaattgaattttatgtaattttcctgcatcatgaaattaaaaaaaaaattgtttcaaccattggaaaatgtaaaaaattgttcttagctaacaggccatacaaaaacaggctgcaggttagatttggcccatgggtcatagtttggcaattgtgttatatataaattattacactgttttatcttcatcatggtacacatccatacctgacatgttttatttgcctgtgtatacatttattgctttgtcaccgtctactagaatacaagttttttgagaaaaggagctcttaattgtcttgtttactgcagcatcccaatcaccagtgaaaagcctgtatgtaatagagtagatactaaaaacagtatttgttgactgattgatggactagacctcaggatttttagatacccaggatcaggatatgaactactgcattaaatcatctccaacatctactctcatgatggcttgtctgacttcawgatttaaaaaaaattctaaagcatttttaaggcagtatattcaccctgtgctattttcctgtgggcataggatagggtttgtgtggatgtatcaaagacttctccactgtccttccaggcacaagccatcctataaggcgttcccttttaggagccagaggtatagaaggaagtcatctgagcccattattccagcctgttggtaacagaaagagagatgagcaaagtagcatttggctgcacaggggtctggacaaaacttcaacatcttgatgttttccttcatccctgagagccttagaaatgctacctatgctttcattttatgttaggttgtttgtaaaatcatggtaaattatggcaaaatactctggtcagatactttatcaggttaggccaggatatgctgtgaaaacaaacacccccgaaatcttggtggttcataaacaacagagacttatttattgcttataccacatgaccagcctggttcatctggggtcaaatccacatggggatgaagctggctgagtatccgatcttgaatgttaggaatcactatgacagagggagggagagcctgagagcgcctcaccctggcacttaaattctctggcccagaagtgacacatattacttctagttgcagccccttgacccactgccccatctagccacaaagggccaggaagtgcaatcccaccatgcgctcagaaggcagagagatggaaatatttgacaaaccgtattaatgactgtgacacatggtgagttcttcacattggtgacttctaagtgcttctgaacacacctttgactgtagaatgtcaaaaacattctcaattttacagcagtgctggaaaatgaattgtattgagacaacttgggaggagtagaaggagatggaataaaaaaaattcactgatttctgtcatgtgtcatgcctcctttaatgcacggaagaacgtatactttgcttaggaaatcacattaccacattcagaacaactttagtgaagatgggaaacaaccatggctggtcaatggggtaacgtgtgctgaaggaagacaggtttatttctcaggaggcatcttctccctgggaaaaggaaagacacatattcatctcagtaaatatttgtggaatgtctaccatgtgccaggcatatgagtggaaatgatgtttttataaaataaagatgtcttaagtatttgcatgtcttactaacagtcagggagttcaacttggccagtgggaaggataattttatgcctgaaactttagtaatgtaaatttttatgctgattctctttttgtcattcactgagtattcctaagtaactataacactcacatattggagataagtattggtttcctgaaatctaggtttggctaacattgcttctggaaagagaaaataacatgtgttgaatgtccctatggcaaattcttgctgttacttactgttccattatggagagtgttagaaagagtgtaattttgattgaatgaatatgctaaaaaaaacaccctaaataagaaactcacaaaaagaacagagtggaatgaaaaagtgaaaacaactttgcaatggtgtgcttcgtttataagtacattgtcacagcaagactagggatgattgggcatcttagagagtgcagaggatgttgataaggaagaggaagaggagataagtggattttgatatgggacactagatccttagggaagaaatgtgaaagagggtattctgggctgactgccgctggcatagcaaggctgctttgtagaagggacaataaagttttgcataaggatcctttttcccatccaatggattatgctatactttagctggaatagggctgtagcagttagctattgccacaataatgctgtgtaacaaagcagtccaaatttcagtggcttaaaacatcactaccttattctcacttatgtctccaagtcagctgggagtcagaggattaaggctcaaggcttaggtttggtgcaggtcagccccaggtgtctctcatcctcctttgatcagtgrgctagcaggagcatgtgcttgcaatgatggtggaaatagaaaaacgtgcaatcatatgtgagtttcaagcctctccttgcatcatgtcttgtaatgtcytattggtcagtagggctgggaaatatatccctccctcagagagtcaggagtggaaatgaaaatgtttttaacaatagcctaatcaccataaaggctttgggtggcacactgggcccttgatcttggagatcagtgatagactgtaacagacctcagaaaccccttggggttattcagagcatacttctagagggtctggggttgtcttgccattcaagcccatcccacacccatctgcccccacatatcctaagcacagttatgtcaagtgagaacagaggcatttgagtggagcacagatttcaaacacataaaggcagggcatggccatctcccgcagtgctagatgatctggctgggagaaaaccacaagcagtcttcatcaaattggaggatgtggaggtcccaggcatttagtcccctagtatgtccttaaaaaacccagacagccatgcacacacactcacacaaatgcacacgcacacacacatacattcacacacacactcttttcctgcatttgtagttcctttcctcagtctaagtttaattaaacaacttggatttcatatatattcatttaaatatagaattgcataaagaaaagagccaccagaaccaccaatggtagcatgaggcctctgaaatgaaagatgagcccaccccaaccttaaatggccaggtttctggatttcagagaagcaagatcagacccttggcaggttccatctgagcagccacagcagccatagctacarcaataattattagcaagtgtgcgttctccctgccctagttagtacaccctataccatcaggtgtcatctgttctagttaaagtcagaccgtaataacaaaacatcaaaatgtaaaawgtgggttgtttttttctttacacacttctaaagacatttaaagcctgagcagataccttaaaattcatcttctatctgaaaatacctcctagaaccattttaaaaaggagatggaggcaaggtggagagaaaaagtttgtctttggttgacactgggaaagttgtcttttaaaaaattttttaatgtttatttactatggagttgccgtgtcttgctcttttcaagctcacctgtccggcttctaaggaatatcaggggccctaaaacacagacttctaaaccccaacacataggacacacctaagtgtggaaagaaaggaaagaggcaggaaagaaaggaaagaggaaggaaagaaaggaatgcaacatttattgtgtgcctaccatatacctgaccctttcctacatatgaccacatatgatctcttcatgagctttatgaggtgacctattattaacaatgctgctttataaatgaggaaaccaagccttaaggaagtcaaataccatatcctcagtcaaatagctaaaaaaaaaaaaagaaaagaaaaagaaaaggtagtgcctggattcaaagacagcttatttttttaacttatagagtaaaatggattttttcccttttggtgtgtagttctatgaattctaacacatgtatagatttatataaccacaaccataattaggatacggaactattccatcaccccccaaaaattcacttacgttatccttttacagtcagaccttcctcccagcctcccaacctctggcaatcactgatctgttctccttcactgtcgttttgtatttttggttcgctgtcattttggttttttgggaatgtcatataaatggaatcatacagtatgtagcagtttgagattggcttctttcactcatactgcctttgagattctaccagtgtcccagtagttcattcctttttattgctgagtagtattacatcgattgctgaaccgttcacccattgaatgacacataagttgtttctagttttttggctattgtgaataaagctactacaaacattcatgtacatgtatttatgtgaacataaggcttcatttatcaagggtaaaatccccagaagtaggactgttgggtcatatggtgagcatatgtttataagaaactgcaaacacattttccagagtgttataccattcaaagccagttttgaacaattcaaatctatgctttttctttccagtaagctgtttctccagacgacagagtggtttactatattaggcaaagcttcatcttggggaatgttatttccaactgagagctatgggaggcaaagtcacaaaccttcagctcagactcaccaatctaacttgatctgggaagatacctcgacaggtgggggagggagaacatctgctgaggaaggccgggagtggagtgagacattgctacttggaccccaaaaccaggaaaaatttggtggttttggttgagcttgaaccatcaggttaaacaggaaatgcaaaatgctcttccagtgaaacagaagaagctgctaagaggtagagggaacatggaactatttgtattgcaaccgaatccacctccccaaacccactgcaaagggaaattgctgactgcaatgtccctgaactccagggtgagtaagaagagaaccacgccccccagggaacacttgtaaatttttaagcaaatctagggaaagttgtgtaaaatgtgtcccttccataactcaccctaaagcttctgggtattctaaatatacaaattctattcatcacaccgttttatcaccaagcttcctgaaggcatattgccaacacaatttgacaaagaaaatagcaccaacagctttttaaagccttggaaggatagtctcagacccatggctctctagaggtccagggatgaatctagcaaagctggcctccttttccatatatatagaacaagaggattgttaatagcatgggattggaatggctcaagaaaagctttttgaagctctttgagaaaagtagccagggtccccccttaaaccttctttgctgatggccttacagctcaaaaccagcattggaaccggctaggtactcccaaaccaaagcctcttccacttggcatgtatatttatattctcatatcttctttcaaatacctttcagtgttgccttttgaaaagattataatttgtacttttttgttgaattcagtaggttaaagcagtacctattatctttaattttattttgaaaaattggttggtttggcttttggggaatttgagaggcaatttagtctgtcatttaggatggcatcatataaggcagccaacttcatcatgctrtttagcctgaaaagcgatattgttgatcttcaaccttgaaaaagtcgtacaggttgggagctgacctgcaaatggtcaggtatcttgagataggaaaaggatttacaaatccaggtcagcaagatactcatacaaatattttgaacccaaggtatacatcaaatagatttaaagactaagactatttctgagcatgcatcgactgtttgaagactagtggacttgtatgaagttcaggagttaacctgggtcttgtaacttaaaaacagcatttctcatgccctaaattagtagtagagagacaatatagagagttcctatatagccctcacctatcttcctctaaggctaacacctgggaagttttttttwaaaaaatcctgatggcaaagctgcagcccagacccaaaaaatgagaatctgtgagatttaagattcgagcatcagtatttctttgaagcttattcccaggtagattcaagaagaagccaagattttgaatgcctgctttattatttttttttttgtgagagctttaatggcacaaaatgtttatagctacaagttatacatgtattgtaaattgtatataacgatacaaagtgctaactaaatagatggagaacgcataaccactttggctcagttaatccaataatttccacaatgggttcatgaaaaacctcatctgactggctaagtcttcaattctcatttttttagaatagtaaatatttttactgcaatcacaggaacttgttgcgctttccaatgtgcaagtttctgcagttttgctcttgattctatttacaaatatcttaagccagttttcatcaaacatatgaaaaatgaagcctgcctttttgtccccaaattgtaaataggtgtaaatctttttaagcatcaatctcacaatttcaacagttaattgttgaattctcctttccaatacacgatgttttcgttcaacacaaatctgggtagtagtaaaatgttcatcccgtgtgttagggctacagatacatactacgtgctctcataataaattttactgttatgatgtattcattttttaagtaattttccataatttcactgatgctttaagaaaaagagcaacactatgtttctttttaacgttgaaagaaatcataaatatacccaggttcaatggcgctactgatagaactgctgctgaatttggaatgagcacaatgcactagctgtaagaagtcagttttgggtaatgaataattttacttttccctcctgtaataccaatttcatactgtagcagtttatctagtcagttctcctaactttctgtcctttccaattttattcaggcttttcaaaaatcagtgagccatcagatttactttcttcccaaagaaattcaaatatgaatgcttgaaataaataggttatagaaggcaaatcaagtgttatcaggtttaagattaagacagaaacatggtctaataaaaagatgtccaaaattatctagacatcaaatgctagaaagaaaaaagaaaattacttgcaaaactatttaggatatatcatctttcttaaagattgccagctatattcttgaaaaaaagataaaaattttcttgtttaacctgcatgttattttccactataacattaattttacaaatgttgatgtgagagagaagagttagatagtttctgcaaactggcaaacctggctgtgatagtgtttttattcaagttaacctggtgcactttatagattgctagctttaaaattaacagtgtgaacccctgctttaaacccttctcaaagtgcagtcagccaatcaacagtattgccatcacctgggaacttgttagaccccactttgtcaaactcatttcctggtatgacaatgaatctggctacagcaacagggtggtggacctcatggtccacatggcctccaaggagtaacaccccaggaccatcagccccagtgagagcacgagagaaagagagaggccctcagctgcttgggaatccctgccacgctcagtccccaccacactgaggatctcctctcctcacaatttccatgcagaccccctgaagagggaagggcctagggagccccactttgtcatgtaccaccaataaagttccctgtactcagccaaaaaaaaaagaaagaaagaaaaaagaaaaagaaatgcagcatcctgtcttgccccaaacccactgcgtcagaatctgcattttaacaagatccccaggtatgcacattaagttttgagaggcagtactacatataaaatatgcaacagaccacacaaacctgggcccaattgctatttgtcagatacatgtatgtatttattacttataaattccttcatcagatatgtattacgtgcttattactttaaaaagatgaatctgacacatatcctaccctcaaagagatctcagtctaggaagggaaatacaatgtgttcataaataatatagtctaagttagggacttcataaaatgcttgatggaagaagtggcatttattttggacctggaatgagaactgaaagaagatattcaaaagacaagtgatgtagtgatgtagttttgaatacacgaataatctcagggttactttttctatagcttttggtgaatcaagttgtttattcatacatttaataaatatttattcagctcttactattgctataagacagataccattactgctcaggtggtttttacaacctagtggggaagacaagcagataacaagaaatgacacaattcattagtgttactggtagcgttgtgaaggacaaggatggggtgctagaaatccatgtgacggaccagacctaggcaggggtgggagttatggaggaggtttccctgagtaggtaacatctaagctgagaaagatttagttagacaaagagtgaatggcattccaggcaaaggaaacagcatggactaaggtcaaaacaagaagaaatgaacgaaagagcaagttgataaaatggatgtccaataatattccattgttcaactatgcaacatttttcattgcctcccaaattggrtcaaagtagcctggtcttcatgcctccagtccttcctctttttaaaaattttatacaactatattaatatagaatttacatactataaaatttcattcaagtatattaggaaatttactgagttgtatagctatcatccatataaggtccgttatgtccctttgcaatgaaccctccattctcactcccagcctcaggcagccaataatctattttctgtctctaggggctggaaacttaggattggaattagttggttgtataataaatttagcttattagagaactgctgaactcttttccaaagcaacaatacaattttacagtttcatcagccttgtgtgagggttcctgttgctccatatccattacaacacttggtattgtcagtccttttgtttatagccattctactgggtgtgaagtggtatctcatttcaccagcccctcttcctaacttatttgccagattccccacttctaaacttgctctatgcccaaccaaagtgaaccccttgctgttttttttttcccctgaggctcgttgatatccccaaattatgcctttcttcattctttgaatgtgttacttgactggatatgtatttttggtgaaggagaggggctggaaattgagagatgaaattggtaggagtacagaaggccgttgacttcctcacaacgtgggacacttccaagtttctcctacaaaccccaccactatacctttccaaatatcttgcctgccatcttggtcacccgtgacctaaattaatacttaggaagctatggagatgctcatgcttcctcaggggagaatgctgtgtgaacttagaaattagcaaaaggggaaatgactacccttgaaattgtaccacagaaaggagcatacattcaaatgatggtgaagtcttattaaaaagactttaagcctcccaatttagaagctggcttgtggtagccaagaaattagagaatgatttgttatttaagagtgaaattgctagtagtcttgaattaattaccataaaaaagctgccgctgtaataaaaagcagagatctggtaaccctgcttcattcactttcttcctcttgatgaaaaccttttaattattttgattttgattagcacttccatcagaaaataggaagaaattaggagcaatttacttggcaaaggtttagtaattaaaaccactgaaatcaatggtttaagtatgtatttgggataaacacatttttaattgttatttttgtcttacccaagtggataacataaagttcattatacaaaaatcaaccagtgcagaaagccgattgggaacaaacaaccattcttgaaccctttgaaaatgtatgcccttgatgaattacttgtcaggtttctacttaagtttaattgttagtacttccacttaaaatagcaaaatgactgtctgcaatttctgttatttcaaactaggttttaaattctggggttgaaagtaagcttaaataactctgagtacttgagtaaacactgcattttttatgatgaggcaagttgtatgagccatttaattactttaattcaatccagagatttgatattttctcctgagttctcacagttggatagtttaaaaatatttctaagattgaattgaatcctgtaagaactataataaaaccatacatctgcctgttttctttctttctctttctctcctttcttttctttctttctttctctttctctcctttctttctttctctttctctcctttctttctttccttcttttctttctttctttctttcctttctttcttctttctttctttctttcttctttcctttctttctttctttctttctttctttctttctttctttctttctttctttctttctttctttttctttctttctttctttctttctttttcaagatcgtgctccattgcccaggctggagtgcaagtggcgagatcatggctcactgcaaccttgacctccccaggctcaggtgattctcccacctcagtctcctgagtagctgggagtacaggcatgcaccagcatgtctggctaatttttgtatttttagtagagacagggtctcaccatgtttccagtctgatcttgaactcttgggctcaggcaatcctcccacctcggcttcccaaagtgctgggattacaagtgtaagccaccatgcctggccttgtatttttggataatattgagtgaaatttgcctcaatacataaaaatcctttcaatatgcttcaactctaaaatctttaaaaagctgcttggtttcattattttcacgtggaagcagcattgtcacaaagttttattttgaagactgaattgtatatggagtactgtccaactagaagagaatgaataatcaggaaaagagagactattgacaaataagacttaatggagaagcattgaatttcaaagctgccagagacattagcaattgttcagtttcatctccagatttcttagatgaagaagctgtggcaagccaatttcacaaacccgatctatgatcctcatgctccccactcctctcactcccacaattttgccttgattcaaactttatcgaaaagtgagaaatcacaggtatgagctcactgagcttcccaggcagtcttgccatctacaaacccatgtcattctgtattttcctcttgtttctgacagtgatcctctcatctagtcacactacatccacttatctctggcacttatgtcaaaacaacccctctaggtcctgccttagctctcctgcatatgctttttctttcttcctgtctgttgcctctttcccccagcttataattctcccgcttttattaaaaacatgcacccacagacacacactcacatctggattcccaagtgcgataaccttgtagattcatattttcagatcgttcttagtccacagaatataaaattgattgaatgatggcaaacatctgcagatgacaatcatttacagaaatggcactaaagccatgaagctgaagctgcaggacttatggatctgggctagaagacaggggccatcaaaaatttagcttcagttggaaatcggctcttttagtgcactacatcagatccatgaaagaggaaggaagagttactgctcattgctgcctggagctgtgacttctatgaaattacttaacggggcaaaggaggaagcagatacttccttgcaactaggacgtgagctgagctgatccctgaatcataaatactcaacaagattcggattcaggacccagggtattatggggtacaaccataaaacttctaaatgttggagaaagaataatgagaaagaaaaatgaatctctgaatgaaaatggaactactaaccaaaattccaaatcacgttaatataattattactaagaatgacagcaacaaaatgaataatcagtatatgtcatacctataaagttaaaatctaaaataatttgaagaaatacttaaaaatatttgcaaccctcaaagagataaagaaataatattcataaaattgaaatgacaaactaggggcagggcgcagtggctcacgcctgtaatcccagcactgtgggaggccgaggtgggtggatcacaaagtcaggagatcgagaccatcctggctaacacggtgaaaccctgtctctaataaaaatacaaaaacaaaattagccgggcgtggtggtgggcgcctgtagtcccagctactcaggaggctgaggagggagaatggcgtgaacccgggaggtggagcttgcagtgagccgagatcgcgccactgcactctagcctgggcaacagaatgagactgggtctcaaaacaaacaaacaaacaaacaaacaaacaaacaaacaaactaggaagaatatacagaaatgtaacagaaagtagataggaagaagaatgaagtagaaatgcttgaaattagaaatacggtgattgaaattaaaaccttaacaaagtaaactctagactcacaacaattggagagttggtgattggaaagatgaaccaattaatttacccataacacattagagagaggtgaagaggaaaaaatagctaaatataaaagcacatttaagagacatgtaagatgattaaaagcctccaacatttttcaaaaaagagagtagaggcaatattataggtggaataatgaaaatgataatggctgagaatattaaagaattgagaataaaaaagacaagtggcctcagattgaaactgccatgaaggtctctgtctcaaattctcaactctgcttttgtagtatgaaagcagccgtagacaataagtaaatgaatggacatggctgtgtgtcaatacaacttgatttacaaaaacaggcaggcagcaggctaaattaggctgggaggtcatagtttgacagctcttgatctaaagaataaccattgttggccaggcgcagcggctcatgtctgtaatcacaacactttgggcggccaaggcgagcagatcacttgagcccaggagttcaagaccagcctgcgcaacatggcgaaaccccatctctactaaaagtacaaaaattagccgggcatggtggcaggctcctgtagtcccagctacttaggaggctgaggcaggagaatcgcttgaacctgggaggctgaggttgcagtgagcggagatggtgccactgcactccagcctggatgacagagccagactcggtctcgaaaataaataaagaataacctttgtttacattttcatgtatatgtctccagatgttcctcatatatccatataagtatgtatatatgatgtacataagtgcataagtaaaaatacataagtaattttaaaagaggttatatcatagctgaatcacacatgacttagaccacacttgctcttctgagtacccatttttggacaactctcagtgtccactagcatgtctaaaaaaaatttctcctcctaaaatgctaatgcatgatgtagattttaactacagcttttgaggctcagtggaggagagtgtacatcacactacccaatgcaaagccttttaacagccccttttgctcatctttgttttccttcactgttcctcgccctgcagcaggcagctgacattcacctttcccttccaccctcctctctcagcactggtcctttgcctcctccctcatcccagctctacaaatggcctcagcctgcatattccaaccacccagcaaaacaaacatctagtaactaccgggtcagcaagagaaaatcggaggccctagccatagatagatcaccttatcatttctccagcacattccaggaaggatctcaattcgttctgtcccaatatacctctacatcctttgttttgatgatcacatagaattcattgtatgcatatatcattatttatataactaagcccccaattttgaacaagaggctacatactgaaaatcttttatctaccaagtcttttttttcttacaaacccatccaatacagttgcactgtatccgccaatacagttcatgcaactgtatggaaagcaaactctagaagagtatttgatagctccataagaatattaaactcttatacttctagagcgtaaaaccccagaaaagtattttgtcagaaaaaaatcatgtttttgaaatagtaggttttaaaagaaaacaaagagagttagaagtaagaaaattcaggttatcaggggcttgatatcttttttttgtgactgtagtcaggttacccaggcctttgtggatcaatttctcaaacaaataacagagatgaaaacaactgtcagtagctactgtcacaaaaataatatgataaacatcttttcgtttcctatggctgccataactaattatcacaaacttggtggcttaaaataacagaaatgtattttctcacagctccagagtccagaattccaaaatggaagggtcagcaaggctgcacgccctcaaaacactcttggagagaatcttttcttgcttcatccagcttctgatggctctaggcaatcccccgcttgtcactgcatcactccggtctctgcccccatcttcaaatgaccttcctctgtgtccctgtcttctcttctgtctcttataaggacacttgtcattgtacagtatttagggtccacatagataatccaggaggatctcattttaagatccttaacttcattacatctgtacagatcctttgtccaaattaaggtaatgttcacaggttctgtgggttaggatgtggacatatcattttgaggcccaccattcaatgcactacaattttctttgtaagtgttctgagaacccaggaagaataagtaaatcctctgattcaatcaaaaatgagcagaatgtaaaccaaaaatactagaagatatcctttttcctaggcactggcatacrtttcaatagtatctctaattacagatgtatttacacttctaagtgtcagaaatgaagattattatgacaaatttaaaatttagtaacttgtttttaaactggtatttttgtttttttaagcgatcatctcagtccacattrgaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactaaaaggtaggtgtgtggatgtggagacaaattctttctctttattagatagygacaaacacacttactttctccaaaagtctgcgtagggcagacacgtgtcagagggagaatgaaagtcggtctttgatttccagtattagtgcagaatcttgattttttaatgtttacttcacagagaaatatattcaatatgattttgagataaaaaacacaaaagaacatctcaaaatatagaaataaatttaactcaaggatgtgggggcaaagaaaacccaggaagactattgttctcaatagaaaaacaatcatcaggtttacttagaaaataaaacctggggattcatccacaaggagtattctactgccatacatacatagacaaaaaccaaagatggccaggcatggtggctcatgcctgtaatcccagcactttgggaggccaagaacggcagatcgcttgagcccaggagtttgaaaccagcctgggcaacatgacgagaccccatctctacaaaaaaatagaaaaaaatagctgaacattgtggtacgtgcctgtattcccagctacttgggaggctgaggtgggaggatcggctgagcccaggaggtcgaggctgcagtgagccatgatcatgctactgcactccagcctgggcaacagagcaagatcctgtctcaaaaaaaccaccccctccccgaaccaatagattaggtatagcttttttttttatttctgcaaagttgtgtgattttttagtaaaagtgaaaagtaaaagttagacactgagttgtaatattgggtactggtattgctaggagaataatgaagggagaaaattctcaagacaaaatgatcaaaactccagactagaaaataacataatttgaaataaggataatgatcgttccctagtaacgtatgaagattctttaaaagaaaatcaggccaggtgtggtggatgacacctgtaatcccagcactttgggaggttgaggcaggtggatcacctgaggtcaggagttcgagaccagcctgaccaacatggtgaaaacccatctctactaaaaatacaaaattagccaggcatggcggtgcatgcctgtaatcccaactacttgggaggctgaggcaggagaatcacttgaacccaggaggcggaggttgcagtgagccaagattgcaccattgcactccaacctgggcaacaagagtgaaactccatcttaaaaaacaaaaaaacaaaacaaaacaaaamaaaaaaacaaagaaagaaagaaagaaaaccagtgtgagtaggtactgtcataatgaataaaatgcttgtcaagtaaagttctgtggtttctgattaggcacttaattttttgatgtcatgtcaaaacaacacaagaagctgctacagcattgctgatctagcattctagatttgattaacatgattacctggtaactgactatatatatagcataattcaaattaaccactaggccaaaactatttttttctttctacctaaaattgtatttgttttttcccatttgtaaaaagatgttggggttgcacagacctctgttgttggctgtggggagagctgtgcatagatggggacatattctttggtagcaccttgggcatgagtgtgaagaggattcttagtgttcatgtgtatgactgtgtgtctaagtgagttgatgtggtaggaaccatagcctcgagctcacttcagacagaaatttgaagctctagatgtttctatgtggtgaattaatatagccttcatgagaacaaagggttggcacctcatctagaggtcaaaggccttaaccagattacctgactgaaggcctgaggtgaacctggagctatttcatgaacatgaacgttaccataaaaccaagactaggtgatctaaaaaaagtcaatgacattgacattttctaaggagaaaaccattaaaatatcacggaatttgcaaaccctatgaatttatctcgtaatttctaggggatcatctgaarttatttactaagttagaagcagtcaataatgaaatcagcatgttacaccaattagaatttgttatcaactctcccttgtggatttcaaggtaatttcctgaggcagagcagtcctgctgggaagcagtaaagaatagtagagttatgaagcctttaatcagtgatgttggtcataattgcatatgattttgattaaaagcttaccactccaatttcaaaacttagttttataaaaagagaaaaagcaaatggaaagcaacctttaagtagaattttaaattgggaatattttcataggttggtttcttgttttttcaaggattcatgattaattatagtgaattaaataataaccataataatacttaattgagtaatttatctctcatgtgttcagccttcaggctttttatataaatattaataatcagaaatttttaaaaaggtttcttgggggctgggcacagtggctcacgcctttaatcccagcactttgggaggctgaggtgggcggatcacaaggttaagagatcaagaccagcctggccaacatggtgaaactccgtctctactaaaaatacaaaaattagctgggcatggtggcgcatacctgtaatcccagctacttgggaggctgaggcaggagaatcgcttgaacccaggaggtggaggttgcagtgagccgagatcgcgccgctgcactccagcctggcaacagagtgagaccccgtctcaaaaaaaaaaaaaaaagtttctcaggatagaatgttttattatgaggaaaaaaataaaaaaaaacaaagtttaggtagactgtgtagtataatgcagtgctccagacaactcatattatgttttcagtgattgaagaagcaacatatgaaaaaaattggtattaagggatgaaaaaggagaaaggaatggagaagatgttataagggaataatttagggactagggtcacatctcaaatggtaatattgtatcagtatacttcaagcagacgttttctctattccttctattcccctatatgggaattcaggataatctcaggagagttcttgaaaatgcagtaaaaataaaggagagtttgcctattgttgcataacacattaccacaaaacttagctacttaaaacaatatttatctcagtttctgtgggccagaaatgctgacatggcctagatcagtttttctgcttcagatgtctctggaggctgcagttaagatgttggcttgggctgcaggcatcttagggcacagctgaagcagagtgtgctttcaagttcagtcagctgttgtttgcaggactcaattcctcacaggctgttggactgagggtcttagttcctcgctggctattggccagaggctgcctcaagttccttgtcgtgtggacctttctaacatggcggcaaactaacacaagaactgaaaaccaaacaccgcatgttctcactcataagtgggagttgaacaatgagaacacatatacacaaggaggggaacatcacaaaccagggcctgttggtgggtggggggcaaagggagggagagcattaggacaaatacctaatgcatgcggggcttgaaacctagatgacgggttgacgggtgcagcaaaccaccgtggcacatgcatacctgtgtaacaaacctgcacgttctgcacatgtatcccagaacttaaagtaaaataagctaaaaaaaaaaaaaaaaaaaaaagcctgcaagtggagaaggaggagagagagagagagagtktgtgtgagaaagtgagacagagtaagaaagaagggagcttgcaataagtagaaacaagactgcaatcttttttaacttcatcatggaagtggtatcccatcacttttgctgtattctcttcataagaagcaagttactaggttcagctcacacacraggggaaggcatttacacaagggcatgactatcaggagatggggaccactgggggttagtttcaaagctgcctaccacaagagattttcaccagcaccacaaccccacacataataaataaactctacagttccatggcaagctacaargaagtctttgtgttgtctttatcataaaattgaatctttcccccaaaacacctgtagaaaggctatgcagcattaagtatcaaagggtcaaaatctaatttaaaaaataaattatgagagaaaagcaagtactgttttacaagaaagtatataatttttttattcccataggcttctttttttgttaccttcaaattaactatggtcaaaggattgctcattccagtaataagaacagrcttatttcatcatttacataaatatcagtatcgggcacttgcaaatgagaaaactctgatttgagtaaggattagtttcacttcaatttccatttatgcrtttgccaagtttaaatcctactgtagttacttaagcaaccaacagaaacatatttcttgatgatgctaaaacctacctacacctggctttaaagcagaagaaatgctatccagctgtatcctataaattgcttgataaataatatttacatgttatttctttacacgcttctatttacttccctattaaccagcttctccagatgtattcagtgtaattatgtacaggacatggtgttctacctcaaagggaaataaaatacttatattctacaaggtatggtataaatgggaaagagcacagagattggttgtaacttctctgcaaacaatctttggttaaaggactgacaaaaaatatccatctagtaaaagaaacaagcagtagaaatgtgaaaatgactgtgttcagcataaccctggcacatgttggcacaccaggaccattccacctgctagccccagtgagctttctttctctctgcagttatagatgaagaatggcaaagaactcagtgcagccctagagaaacgtgcgtggaggtggccagtgagctggggaagagtaccaacacattcttcaagcccccttgtgtgaacgtgttccgatgtggtggctgttgcaatgaagagagccttatctgtatgaacaccagcacctcgtacatttccaaacaggtataaggacatcggcaagcctgccgtctctaaagccctgatgataatagtgttgatagctacaacaaccttgttgctaaacactgtactaaatgctttatgtgcataatcgcatttaatctttgaaacaaatcaagagggtattttatgctcctttatagatgaggaaactgaggctcagagaggtaacttacttatccaagtttacacrgctgataaatagcagagctgggattcaaacccaggtctgtgggaggccagagcctgaactcttatcagttattgtctctctgatgctatgatgtcaagactcrgaaaaccatatggaagttactaggacaggatgttaaaaggaatgaagatagctgatggcaggttctgtgttgctcaaatggagtgattgagaaaaatttaatgaaggttgtgggcagaattggggaaagagggatgggacagtgaagcacctgaagctagcaaaaagggtgagatttccccacccttcgactgaggagacaaggggagggagcagttatgggaacccagagggaaagcggagaagagggtttctggactggccactgtcaactcttagcctggcagggagtaggggcaggggctgggagaggcaagagggtttatagatgtagcccatggagggcagcgtcctggggcacagagcctgatggggaaggaaggggagaggatggtgtctctggaggggcaaagagagaatatctagcacaaaagacatttggaaataattctgcagtccccatgaaagaaataattcagccctcttcatcttataaatttccctttgcttagtaggtaagttttcctttctctggttaccatgtttttaataaatgtcgcatatgagagcagtagtaacaaacttgggaaagcaatactaaaaaactgtacatcaaactacattatttttggtatctgttgcaaattctttgaatgttgatatacttatttaattgtcagtttgcctatatggtttattctccttttaactgcaaaaagaggtagtacaagaaaattacatgcactgaatatatccatgttaggtaattttcttaatgctgatttgttttgttaatagatttacttatccttaattttgttcctccaccctctaaaatatcctttaaactgcagagtttctttttctaaattcttttagagaatcttggagcttgtgtgtattttaacctctactatttgacaattaggaaaaaaaaatgacccaagtagggctaagcatcaattctgagtagaaaaaaagcttgcataacgtaagagggtttagttcatgatcatgtgattccctagagcatagccaaaaaattgtgcaagaagatraagtttatgcaaagtaaacactacaaaaacactctcactgagactcatggaagttccattayatattgagatgtcagaataaacacaaccttaatggattgcttccacttaatagatagttgagtactttattttgactgctgtactcaacaaatgattaatttcatacaatgtacttaagtgtaagtgtacagcagtttttcttccaaatatgcatttttgaacattttaatagtagttttttaaaaactatctctcgccccaaagttatggactatttggcaaaccacctcttagaaacaaagtgaacaaatgaatactctatgtagtaaggactacatggaatggtgattgaatagacaatgcattaaaatcaacttcaaactcatccacacatcatagaaccactcaagaaagttgtgtaatctctctgtacatctgtttcttcacctgtaagatggggataataaaaacccaccccataatgttgttataaggggtaaatgagttaacatgaaagcacttacaacagggcctggcctacggaaagcgtagaaagaatgatatacatgttagctatarttatttgtttgggcatgatgatcttgtatcagtcagctattaatacacagtgctacgtaacaaacacactaaaactcagtggttccaaacaacaatgatttactctcacttatgtatctgaggttcagttagtttagggtggattcagctgggcttgactctaagctgcagtgtgagtccaagtcaacttctatgtttcccatcgcttggaccagcaagcctgccggattatgttcttttcatggctatagcataagtttgagaaaacaagccccataaaacatgcacagttcaaatttgtacttctgtcatgtctgctaacatcccactagccaaagaaagtgacatggccaaataaaaagtcaagagacaggaaactatatttcttcaatagagatggtgtgagaagggatgaataaatagtttgaataataatctattctaataaaatcctaaagaaactgcatagctttaatctcatttaacccttacgatttacactcaaatttaaagcaggagcagggattaacagtaccattttacaagagtatcaatgatcaaaaagttaaaagatttgaccaaacttaaacacttcataaagttagatgagcctgtttagttccattcttaatggacaacttggctaaagtcattgccgtaaatgacaaaggcaaaaattcagactagaacaactttaaaaatgatatataaaattaaaaaaatatattgtggttatctttctctgctgtagctctttgagatatcagtgcctttgacatcagtacctgaattagtgcctgttaaagttgccaatcatacaggttgtaagtgcttgccaacagccccccgccatccatactcaattatcagaagatccatccagatccctgaagaagatcggtaagcacttttgtttttttttttatactggattatgcttatttttgccttgccaaaactgtgtgtagaggatttttcattaatgtagagttatcaatttatcttcaaattattcatattttagcttctaacctgaacctactggtaataactggcaaatacatatttttattagatgttagatatatattgtggtaggaccaaaacgctcagtggtatgagcttgtcatgtctacttgtagacacgtttgttcttaatatgcatagtctactgcaggtgtaaaaccgctgtaacctcaaatttagcacatgttccagaacaagcattaaataaaacttatttcaggctgtttgtatatttacatcctgaaatgagagaaaacaaagaagattcctggggtcattggggagtgacaaaactagcagcacgtgagttttgcaactttctaatctttcccccttaagattaccaaatggaaaacccttattttaaattaaaatgacttaaaattaatttggctttgaaattctcttgagattaattttgtgattatttataagacaaacgacaaaaccaaaggtaaggatcacttatttgaagaaaaaaaaggatttaatataaagaaacaagtaaagggtaactgaatgaaaagatcattagttagatacttagactttgcaaaagtaaagcaataaatatattgtgtgagtggcaagtaaaagagtaagctggtgattagttaacattgaaccaagaagacacctccgcctctctccagcagaaaagaaaacttgtagaaaagcaacatttattctcaagatgttcctgctgttctggccaatgcttttatctttattttaaagaaaataatcttaggggccgggcacggtggctcacacctgtaatcccagcagtatgggaggctgaggcgggcagatcacgaggtcaggagattgagaccatcctggctaacacggtgcaactccgtctctactaaaaatataaaaaaaaattagccgggtgtggtggtgggtgcctgtagtcccagttacttgggaggctgaggcaggagaatggcatgaacctgggaggtggagcttgcagtgagccgagatcgcgccactgcactccagcctgggcaacagagggagactccgtcaaaaaaaaaagaaaagaaaataatcttaggaggtatgttagaacatatttaattttcgtaaataaactgttgacagctataatttgcatagttttaacatataccttcttaagaagattacaatttccaaaattacagtttagtttctaaacatttccacgtagaatatttataattacagaatcactatctagtaagatgcagttcataaatacaaattaagctcctttaaaatctttttttttttttgagacggagtttcgctcttgttgccccggctggagtgcaatggcgagatctcggctcactgcaacctccgcctcccaggttcaagtgattctcctgcctcagccttccaagtagctgggattacaggcatgtgccgccacgcccggctaattttgtatttttcagtagagatggggtttctccatattagtcaggctggtctcgaactcccgacctcaggtgatctgcccgcctcggactcccaaagtgctgggattacaggcgtgagccaccgcacctggcccgctcctttaaaatcttaactcttctcacatccttatcattttgtggtgagaacatttgaaatttactctcttagcaatttggaaatataaaatacattattattattgactatagttaccatgctgtgcaatagatctcaaaaccttatttctccaaactgagtataaaaagcaaaaaataaatttaaaaaatcttaactattatctactcaggaatttatttaatgttccaaagttttgattatccttgaaagcttttaaatctggttcattgttttcttttcctagctgttcccattccaagaaactctgtcctattgacatgctatgggatagcaacaaatgtaaatgtgttttgcaggaggaaaatccacttgctggaacagaaggtaatgatagtagtagtaaaataataacagtaataataaaagtagcaacaatagcagcaaccgttattgagtacttagtatgaccagacaatgttgtaaatcttktatatgttttaactcatttaattctcacaacaaccctgtaatgtactattgttatttctttttttacaattacaaaatggrcacaccaagatatcgagtaatttcctcaaggtcacacagctgagagtgatagaagtggtcagattccagaaccctctgtaccataatcatatagtaagtccatcaatgcatcactctgctttttaatctcaaagaaaagcccagagtggttggagcatcctgaaacactgaaattgaaaggggatgttaaacttgaatgaaagctgcttcagaactaaatactagtcaactgcagtttactaatttatttgtataaaagtctcacaggaacataaagtaattttggacttggtttctgtcagctgcatcatatgaaaacacgccagtaatttgaaaaaagaaatggagaataagagaaaawttttctggaattagggcaaagcaaaagcaaaatatggctattggtctaaggggagctgggagcaaaatgagatatagtcaaattgtcattgctcataatccgtaattctgtgactttgggtgatgaacatttgcttgaaaatgaatgcattttaatgtattttccagagagctttacatggttccaccaaaaaaaaaaaagaaagaaaaaaaaagtcacaagtagtcatgcagttttaaccttgcttgttttaaactataatctataagcaagaacagtaagggctaaactctaagaaatctgtcctataaactgtaaatagcaacctactctccattcttctgcctctcagcttccttctaaatgttttcacgaaagctcagcccagagcatgtggggaaatttaatatttatgtggtttaaatgcccatgccgatcttgaatgttctttacacccttcccaccaagtgttcagccatcctctaccagaacatacatcagttatttggagactcgccatccagtgaggcagcaccaaggggtgggcacactcctgttgttatactgaaatgaaatctctctccagaacagaccagactgcccaatggaatacaataagagtcatatatgtaactcacattttacattaaaaagataaaaagaaacaagtgaaatttatcttaatatattttatttaatccaatctatccaatgtactatcatttcaacatgcaatcaatataaaaaatttatgagctagcctacattctttgtgctaagtctttgaaatccagtgtgtgttgtacacttacagcacatctcaatttagactctctatttcatgcccaatagtcacatatggcccatagctaccttgttggacagcccagctcaagagcatcaactcattagttcaggttttaccctatagaaccatgtaaaacaaatctaattctttctccatgtgactcatgttctaaaagtgttagaaaatttttgtggggttggccgggaatggtggctcatgcctgtaatcctagcactttgggaggccgagatgggaggatcacttgaggttgggagtttgaaaaccagccgggccggccgggcgcggtggctcacgcctgtagtcccagcactttgggaggccgaggcgggcggatcacgaggtcaggagattgagaccatcctggctaaaacggtgaaaccccgtctctactaaaaatacaaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaagaaaaaaaaaaaaaagaaaaccagccgggccaacatggcgaaatcccatctctactactactaaaaaaaaaaaaaaaaaaaaaaaaaaaaaaaaaaaaatagctgggcatggtgatgtgcgcctgtagtcccagctactcaggaggctgaggcatgagaatctcttgaacctgggaggcagaggttgcagtgagccgaggtcatgccaccgcactcgggcctggatgacagagtgagactctgcctccaaaaaaagaaagaaagaaagaaagagagaaagagaaaaagaaaagaaaagaaagagagagagagagaaagaaagaaagaaaagaaaagaaagagagagaaagaaagaaagaaaagaaagaaaaagaaaggaaggaaggaaggatagaaagaaagaaagagaaagaaagtaagttactgtgggaagggcaatatacttagagcttaaaggctctagctgaggatttcctggcacaaagcctctgagacagttttgtacggaggaggtttgtaggcaggcacaaggcattaaagggtaaagagagaggcagcagaccacagcgcagttgctaagaggcatcagcctaagccaatgggaagttgaagctgggaacccctgcgggggtaagtcttaaatctaggtgaagaggctgagccctgtagaccgttcattggctgccttggagaggggatgtagccttaggagaggcagcttatttctgctggagataattcttgggaaggcactcagccagtacacgtgtgtagagggtggtaagaagaatagggaagaagagaagtgctgttctaagcagsgggtatatgagcactcagggctggaggtgagagaacatactggaagaagttcagcatggtggggatataatgggtggggacataatggggaaggggctggttagatgtgagagaagaagctggacaggctcacaggggcaaagcagaaggaccttgtaattcttgcgtgggagcttggatgtgatactaaggacaaagggaaaccacacaactggctaaagcaggagagtgacagtacccattagaattttaacaaaatcatatcagcaacagtgtagaagaggatgtgttgactcggggcagggaaggaggcaggaaaccttttgggaagttgtagcaatgatgtaagtgagaggcgcagggtggactggatcacaattgtttctcattctcatctcctataagtccccaatgtggatcaagttcacattcatttctccagtggccccatcaaattgatgggatttactgagcttactgctcactatactttttttccgcacatgtgactgttaagccaactgccttttctacagtgacttctcttgcccagatgagcacatttaggttagtgaatccaagtctaatttaattgagtcttgttagagtcaggtcattgctctaaattgttaaaacaaacgatatacacaaacacacacacacacaaaagaataaattgaggaggtcccaattctgtattttaaaatacttaatatatcccttccttcttgaagagagctacaatttcaagaatttattttgaaaaaattctatcagtttattgataaaaatggtaaaaggaacaaagctgagaacagaacatatcatcagactctctagggacggaaatcaatacataatacttcaagatatcaccctcagctacttgctgttccaccaccagttctcttgcatccagtttttgtttcttttaacttggctataaggatgtgagcacagactctgccaaacagcctgctgaagttctgcaaacaccttgtggattgtgtttccctgaacaaccctgtccaacaatggccttgggcctgtctgaagtattcttagtgaacttctgctgccacctagtgatcattgcgaatttttaaaaagcctctttatcctttaacaagttactcttgtcttaccccaaagcggcatctgcctcactggcatatgacttacagagctcacattttccctctccacaaagttcaaaatggagacttctcagatttagccttccagcacccattctcaaacgtcgtgcattacagaaaagtttaaactataaagttgaaccgcacgagattctcattttgatatgtcattaaagtcagatattggcaagaacatatggtttaacccaatggcttggaatgctggatgggattcccagaagctccatacatcggcctgcttcaggacccttttattacaccaaataaacccaacaaacatccatcgagtgcctattttatatcagaacaatgagacctgctccttctccttcaggacattttacttaatgggggaaacatacaagtaaacagacaaatgtaatcagtgcaagaaagaatcggacagcaatatgcacaggataaggacacttagctaaacctgcagacattgggaaagatgtcagggaaaagggatggcagaaggaaagacaaggccaaaggcatgggactgggaggcactggaatatcagggcaacagaaagtgctgtcatttggtataaatggaacacacaggatatatgaaagcaagaaacagaagatgagtctgtgaggttactatgatccagttcatggagggccttgtatgtcctggtgggaaaattggtttttattgtgggaagggaaccttttaatgcattcaaagcagtggaatgaagtgatttggtttgcatttgttaatcatgtgaagaagaataggttggagggataaaacttgtggtggtgagatgagtgacagagcgacagccatctacaaaagaaacacaaggtacagactgaattgtgggagtggtagtggggatggaaaataaagaacaaatttagagaggcagaactgagtggacatgatgctcagacttaccagagcaggtgagtcaagaatgatgtcaccattccctaaatgaggcaaactgggagagaagcagatttggggagaaaactactaaacatgtacgtccctccaaaaccttcaagaatgctaaagggacagagtcaagttcttccaaagtttmtgtctcttccatttattttgcaatgaatttcaacttgttaatcagaaatggatttggagtagtagctattcaattgttttatacaccttctagaagaaatatttgtcagatgagtatgtcaaaaacttctcagaccctcccctttacttgaatgtatcttccagcagatgttggtggaatcaaagttcattattactcctatatcttttatactagtgttatgatctgcagtgaggacatgcattgctattgctacgcctggcctggaatgtctgaggtgtatttctacaacaccaattattttgtgtgtctctccttttaatctccaccaaaaaatggagacagctagattcataacccttagacatcctatattttattactaatacttggttgtggaagtttgcattctaaacaagtcatcaacataaaaatctctaaaaatattttatgaaaaatattcagcttatgatattttaaaaatcacaaacctaagaaaacacacaaacctgtgtttgtattgtgaaatcagaggttaatcttcctcaccctgtgaaaaaattaggggcataaatctataggaaggagattgggtgaatccaagttacttacggatgacataaaagatacaatcaactttggtgatccaattgccacactacaactatctgaccaacacgtttctgtttctctttagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcaggtaaatgccttgagttgtcttgcctttactcatgacatttaacgtagatgccattttaatttggtgggattccttagtaagctaatttttccccttggtgcctgagtcccttttggataatagaacagaggtttagcagctaaggaataagcaagagtataccgagtcatgattaatcatgaaaataagaaaatcaatcctgcctgttattatgtgtgtagagctttttttttttagacggagtctcgctctgtctccaggctggagtgcagtggcgtgatctgggctcactgcaacctccgtctctctggttcaagggagtctcctgcctcagcctcccaagtagctgggattacaggcacgtgccaccacacccagctaatttttgtatttcagtagagacggggtttcaccatgttggccaggatagtcttgatctcctgacctcatgatccacccgtctcggcctcccaaagtgctgggattacaggcatgagccaccgcgcccacccggggtttagagctcttaaacaacaatgaaattggtaaaatttaagcagttattaggatattgcttaataataatattttaggaaggggaggtttcagatcatcaacctgtttagttcaatctctcattgtttatgtctatatatgtttgtttttttctttaatggagggaatatcattggatttatatagcaagtaatttattcatgaatagaacacttggaggttactgattcacttcagtagattttgaatccatgtgggataaccatgcaggattttatactgacattttaaatacatgtctggaaaacttaatcaaatcagagcagagttattcttttgaatccagtcattgattctgaattctcatctttattttcttttgcaacagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccatataattttatgttatttaatatgcttccactctatatttatgctaaagaaaaagtgttttaaagaaagaaaggaatttcaaagtggaaggtgcaggaagagacacaaacactggacctcagttttgggaaaccaagggaatagctctcagaaaggttaagatcctaaatgaggctaagcaaatgtgacccaagaatccactgcgaatcactctgtgccttgagattaaattgaacttgacctgatccccatcccatggcagaggggaacccatccatgcccttgacctctttgagagtttgcatttcttctagccacctctggctccaagtttctgcacttactcaaatctcagtgtcatggacaccccaactctcatggcaacacagttcttctctctgttctacagctatcactttttgttttgttttgttttgttttttgttttgttttttttttagacggagtctcactctgtcgccaggctggagtgcagtggtgcgatcttggctcactgcaacctctgcctcccaggttcaagtgattctcctgcctcagcctcccgagtagctgggtctacagatgcacaccaccacgcccagctaatttttgtatttttagtagagacggggtttcaccgtgttggccaggatggtctcaagctcttgaccttgtgatccaccctcctcagcctcccaaagtgctaggattacaggcatgagccagcgcgcccggccacataaagcctttttcctcaaagtactcctacatctaatttgttaatgatgtagactttattgaaattttgccataacagagagaatttagcagcattagcagatttaagttatgtattaaataacttaaaattaatccctgcatagtatcttgcatagatagatatgtatatagacacacacaacccattatggtacttacaacacatttgtgtaaatagtagtgttcctgtttatctccccaccatactgtgacctcattatgattggaaacggtgtcctgatcaaatttgtgtaacccaactttctcaggccagaacaccctggaacagtacaatcaaaaggagaaagacaatgataaacaatggaatagtaaacaaatgtagccccatggtagtggcattgtttgatcctggcccaaatccctacccttcctctgccagggtttctaagcagttcctgaattctcccttcattcactgaaattctctgaagcctggggctccaggtcctttgatgcttccctggctttaactctcagtccctgccctggggacatgagctaaccttcacctggccttggaaccactccccactgtgctgccattgtcattgctcttgtcatttactggtgccaacccagtcactcctcttttgccactgttctttttgccctcactttatgaccttgatgtcaacaggcttcttccttctcattttactgtatttttaatcaggcttctgaaaatgcttgcacataacttagttttttaaaacatacttggcattcgactctttgctttgccttttcgttcagtttctaccactcccaacttctccatgatatttgcttaaattcctttgagatctggggcagaagacaattcaaggataccacacaattaaaggagttactttgcttatcctcgactggtaaaaagaggggatgtatcactaaggagaaaagacctgaatttaaggacagactctgccacctaaacacattgtaagcctgaacaatgtcatcgagcctcagttttctcatctgtcaaatgtaaatgataatctcatttccctaaatctcagaattgataatttcattagagttacgattagtgaaaaaaaaaaattgaacaatacaatgtaccttatagctcaaaggaattattctgaaggaaaaaagcaagactgagcaaatctcagaagcttgggacctctgagatgttcttggcttatactggatccttggatctgtcctaaaaccaactcaaaccatgttttggctcgaaatgcctctggcttcataattgccatttagatggagattatcatagggaattctaagctaagccaaaactcaatgtgatctggctttgtgcttctaaaacccctccctcttcttcctccttaattcccaattaccatcaagatctgcacttggatccctgacgctgggtcaggatgggtctggtccttgagggcggaggtggggtaactggcctgttgctttcttagagttcactagacattgcacaggaatatttgtcatactaacagccctggaacgtgagttgaaaatcctcaacttgttgcaaaataaaagtatgtgagaaactccaagagctttaagcaaacacaataaatgccagcaatgcatgatgtccctgattacgccacagggccagagaattattaatgtgacagcacacgtcataaatctatgactaaaacagtgtggcaggaggccctttagagatggaaacagattaggcagcatgatgatcagagttgaatgaagattaaaatactgtctgagagacttgataaaggaaattatacaaacattacgttttaatgcccttaagaaaagccatagttcagtgaaaattgtgagcttaatagatttggtcagcaagagctggactttgcctaatttagtcttaatcctcagtgtgagaacaatgtcttgcatatattaggtactcaataaatatttaataaataataagttattacattgattttgtggccagccaatgaaattatctctttaaaaagtgaagagtaattttacatagctcatgtttttcaaactcagctaaattatatgcatgtctgaattattcagatgttgcaactctagaaaggaatttaatctattctcaaaatatttatgaaatgaaaaggagcaaaaaaattctgttatttgacccttattaatggcttcatgaaagaaagtctgcctttggtaattttatcactgatattgttctgaaacagtggtcagtaagctatggcccataggccactttcagctcactgcctgttgttttggtaaatactgctttattggaacacagttatgctcatttgttgatgtattgtctatggctacttttattctacaacagcagagttgagtagttggggacagagactgtttggcttgcaatgcctaaaatatttactctttggtccattacagaaaaagttagccaaccgcttgtgtaaaaatatttcttattttatcacgtcatcaatgaacattaaatataatgaattagactgcttcttgaacccctataagaaatggcacttttacctggccttgatcgattgttggaatcaactggcctcaccttatttgagtcattgtgtagtgtgcaacccaatgaagctaaaaagttacagtgatttaaatttcaggtttccacaattcaaataaagtcatggatacatttattgatgggttctagttatgtttgtggtatagctctaaaatgttagtgttgatggcgtggactctaaatagagatagtgcataaacatattagttttttttttgtttgtttgttttttctcttttttccaatgccctgggtaaagtaaatactcctaaagagtaaggggatttttttttttttttttgagacagagtctcactctgtcacccaggctggagtgcagtggcacaatcttggctcactgcaacctctgcctcccaagttcaagtgattctgctgcctcagcctcctgagtagctgagattacaggctacaggcacccgccaccatgcctagctaatttttgtattttttagtagaaacggagtttcactatgttagccaggatggtctcgatctcctgaccttgtgatccacccgcctcggcctcccaaagtgctgggattacaggcgtgagccaccgcacccggaccaggattttttttttttttttaaagcataagcccgcaaggacagggtaaatgataaagtcaacagaaacaacaatgttctgaaagctgaaaagcacgtagataagttgtaaatgatgtggccgacctgaaaaaaaaaataatttaagccaacagtctggaaagatgagttcccaaaaggctcagaagtgggtgtcccaagcacctctagaaatgggagggatgagaggggtgctaaaatgaggttcattccaaaaatctgtataagaaacagtttgatcccaaatcttctcccacattccctgtggtggagtgactgctccttccaaccccaggcaaaagatgggttattagtcgtttggctaaggtaaaagagagagcatcctgaatgggggatgcctgacatccatgagggcagggtgctgaactaacaagaggattaagtgaacgcgtacatactaggtgcaaccacaattcaggcagttggatctgtactggaaaagtatttctctagggggaatcttaccagcctaagagaaaagacctaaaaaggactgaaattagctgggggagggactatcaaatggaacagcccaaagaggtcatcaagccccattcctgggctcagacctcagatcagctcctttgtccctttcttttaagtatgagcaagcaagcatgaattcccagacctccagggaaaatttctaacatgaaagacagagagtaaaacacacagaaaaaggcaatttggaggaaacagaagaaaacttcaaatcattaatagccaggggatgagggaagaaggtgagacagtgcaactaataaataaaatgaaggtgttattaaaaaagaaaatgtcagaggacataattgagccctaggaaactaaaactattataataaattgaaaattcaatagaacaaaaaaggaagacagagttgaagaaatttcctatgaagtagaataaataagaaattaaaagtgaaaagataagaaggtctaacatcagaataactgaagttacaggaaatgagaagagacacaataggagatgtaatcaacaatttaaaaattcaagagaatttcgaagcacatgagttggcaagtgaaaaggctctctgagtccctagtccaaaaggtgaaactatgcctataccaaggcacaaaatgatgaaatttcaggacacgggagactaagagataatgtataagtttccagagtaaagaaaaattatgataacttcaaacaaagggccaggaatccgaatgaaattagttttctcaatagcaacaccaaaagctagcaggctagagcaatgctgctaaacttctgaaggaaaataatttctggcctactatttggcacccaaactatcaataaaattggagggctgaaaaataaattttcagacattaaagttcttagaaaatctcccgatctcccatgcagtcttctttaggaggctactggaggacggtcttcaaaaaagggtgctaaaacgaaaaggaagacatcactcaaacaaatcccaatatcctgtgattttccttgtctctctctttttttttattgccacgagaaaacatcaggtcctcattgcctctagtctagagctagtttcttaagctataatgtgcatactatcattccagatcttgttaaattgcagattcagatttagcaggtctggagaatctgagagtctgcacttctgaccagctcccagttgctgttgctgatctgcagcccctactttaaattgcaaggaggcttctggactactggaacagcctaactggtctcttctccagctgtgccactctttcaccttccttttctccagttcttggaacaattttcctaggacaaagctttgattgtggtttgacatttcatctcatattctgcatcaaaaagaagtaactgccttagttactcttttccaccacactaacctttgtttcaacagtgtgtagcctaaagcttatcaatatgagttttaaaaatgctagtaacatcttcatgttcaaggtatctaattgattctt

SEQ ID NO: 12432 - DNA, 66020 bp, Homo sapiens
aacggggcttttacacgctccccttttacacacttactgataaagggacgaggagaaatagtcaacgtagcttcctgtgggacagcagagaaaagaggcttgaggggtactgcacgagcaaaattaggcagccactcagtatagcgtgcgagattagtgctagctccacctccttttccctaattccttcttccaactgaatcccttctaccggacccctttttcgttctgggtgattccgttctccagtagccccgccccttcgattcctacttgagttggcctcgcccattaggctctaagcccgcatctcaaccctccactcatttctgtcccttggctccagcaactccacctggtgttcctcgagccaggccccggcccacgtgctcagagccttggccacgcctcccctcttagccccgccccaccagccttccgggccaggctccgcccccaccaggattcaccacgctgggcccggcaccttcctcaggtttttccagggccccgcccatgctcacctggagcgcagaccgtttcgcagaccagcgggcagagatagcagaactgacagtgctggaggcggggacggggagagagagtgagcgtggggcgtggccgggggcggagttaggatggggccgggaccagacccggaccagaggctaggtctaggttaaggttggagtcaggatcgcttgtggagtcaaggttgcatcaggggtaaggggttgggtcagaggccaggatttagggctgggggtcctcagagggtcccggtgcatcctgaggcccagtggagccttgagtgtgaggtgaggtctcacctggcactggtcgcagtgctcacccatgttctcctcatcacagtgacagctctcacattcagtgcatcgctggggaccgggggagcctggttagatggaaactctaacgccacttgggaggtacccgcccctggcccacccctgcaccctggacgcttccccagactctaccctctttatctctaacactgagctctgtatctgccccccaaaccagcctcccctcccctcccctgcccctggtttccttcctttccctttttttccttttttttcttgaggcggagtctctctctgtcgcccaggctggagtgcagtggcgcaacctcagctcactgcaacctccgtctcccgggttcaagcgattctcctgcctcggcctcctgagtagctgggattacaggtgcgtgccaccatgcccggctaatttttttgtattttttagtagaaatggggtttcaccgtgttagccaggatggtctcgatctcctgacctcgtgttccgcccaccctggcctcttaaagtgctgagattacaggcgtgagccaccacacccggccctgcccctggttttctatctcagggcgaccccatgtctccctgtcagggtgggctcaggtgctctctccacccgctctctgcctattctccccctagcctatcagcccctgtgccatccctccttcccccgactctctttgccacagacccctgtctctgtccccacaccccaagatgcagcttgggtcttgtcctctccttcctggaccactgccccagcctcccagccttcatcagtctgtcctcacctcacatgcctgcagaaggatctcttttctttcagaactgaccctggcctgcccttgctctgagccctcccacagcaccaccccagggcccctgggacagattctggggacaccttggtgggtggatctgggctggggacatacattgcagaaggagcagtagccacacagggaccctggctggtagttcccatactcctgagcatcctgtggacctgcggggacaggagggcagcagtgacccaggctgactcggttccttcccacccacaccagcccaggccacttacctgtgtcctcaccgctttcctcctcgctggaggcacctccagcctcctctctcctgtccagtgggttggggatgatggtgaagcggggctcatcttcctccagcccctcctcctcctcctcttcctcctcgctgtggtctgggctcagtggggccccaacctcagccctctcttccctcctctcctcgtcttcttcctcctcctcctcctccttgtcttcctcttcttcctcctcctggttcaggctgaggccatgaccttcctcctcatcctcctcatcttcctggtcccggctgccatgatgggtgcctttctctccctgctctgaactttcatcgtcttcctcatgggagccggggtcctcttccttctccttttcctcctcagaatcatccttcctcaaatggcttctatccttgaccactgtgtgtcctggggggtgatggctcatctctttgatggaccctctttgaccatggccagtttcttcatcttggtggctttgcctgtggctgggggcctggtggccaagctcagcagagacctcctcatcttcctccctggggactctgtggtggtgatggtgagggacttctgttttatactcatcttggaagtcctcttcatcactcttgtggcctcgaggttggtggcttgcaacatagtggccgaactggactgtgatctcctcttcttcctcttcctcatctacaaggccatggtggacatgttggggaccctggtgccaacgttcagtggacacatcctcatcttcttcctcgtctctgtggccttggtgcctgtggtcagggacatgatggtggtgttcacctgagacagcctcaacctcttcctttctgtggtcttggtgcctgtgggcctggtgtccatactcagtggagacatcatcatcatcattgtcatcttcttcatggcttcggtgcctgtggctggggtcgcgatgatggtgtccatctgagacatcttcatcctcttcaatcccgtggccttggtgcctgtgagcctggtgtctatattcaatggagacatcatcatcatcatcatcatcatcatcatcatcatcatcgtcatcttcttcatggccttggtgcctgtggctggggccatgatgatggtgtccatctgagacatcctcatcctcttcactcccatggcctcggtgcctgtgggcctggtgtccatactcagtggaggcctcctcttcctcctcctcctcctcctcctcctcctcttctccttcatcatcttccccatcatggcctcggtgtccatgcctgaggatatgatggtgatgctcactggacacaacttcatcctcatcctcgtcttgatggctgtggctcctgtggctggggaggtggtgcctgtgctcagctgagtcttccgtgtcttcactcccgtggcctctgtgcccacgggcctgcccaccatgctctgcaaagacctcctcacctgagacaccctcatctccgactttgtggtcttgggacctgtggcctgggagtaggtgcccatattccttggcgacatcttcatcctccttttcacggtctgggtggctccagaaatgatgcccattctctgtggaaacatccttgttctcatctggatggtctctagggctgtggaggtggtggcgaagctctgctgatgcctcctcggagagcccggcgactccagtgttgttgttccggtttctgaagcccagcccatcccctctgagctgctgggtcatggccggggggaggagcaggctggccaccccagcccagaggacagaagcgtgcagccatggcctatggtggcccatggggacggacaggcagcactggctccagctgcctctgcggcaatgtggacaaacgttggggtctttgtccctttggggttggtctctttttttctctgtgtctctcctttgtcctttcggtctctgtccaccttcctctggtccttgctgcctggctctggacacccctctgaggctgtctccggagccccctgacccccctctggggccctccctccccattccccagccaatagggtccttcccctcccctctctccagctaaatttactctcagccctgagttattctgggtcagtccccgcctgcctgcctcctgctcctcctcctcccagctggggaggggaccagtgaggggtctctccctggccaggagacggtggccaagggacttgactttgaactaccaacaagctcacgtttggcagctgcaaagacaaaggctagacttttagcaggtttttgggggagcctggggcacctgggggaggcagaagagacttatcagaggggagagactcctgggacggaaggactgggggttcgattgcggggtgtttccagctggaatgatacgtgctggtgagagagtgatgtcagtattgaggccctagaatggggggaaaggaacatggcccccaacacacgtgcccatgacctcctgtccctggaactcagatctgggggcagggactgggctaggccagggctataaatacagctgggaggggtagggggactcaggttacggaggccacagctgtccccatcacagagggctggcaggagacaagtggccttgcccgtctctgtgtgtcagtatttcctactcctcacccttcatgactgcccccactagggtctcctttcctgttcacgggtcctcctctctcttcaattctgtcatctgctctctcagggtccctgtccctcctccatgggattgcctctccctctcactctgggcttctgtcccactcttatcttagtgtcagtcctcccccaagtctgtgtccctctctctcccctaaatctctggcccctcctttctgagttcctgcccttcccccaattctttggtttttgcatccccctctgccccttgcctcagtcaaggtgtctcctccccatctctggcatccacctctctgggtctctgtccccactctctctcagagtctctgtccccctctgtctcagagtctctgtccacctctccctgggtctctgtccccctctctctgggtctctgtccccctctccctgggtctctgtccccctctctctgggatctctgtccccctctctctgggtctctgtcccctctctctgtgggtctctgtccccctctctctctgggtctctgttcccctctctctgggtctctgtccccctctctctgggtctctgtccccgtctctctgggtctctgtccccctctctctgggtctctgtcctcctctctctctgggtctctgttcccctctctctgggtctctgtccccctctctctgggtctctgtccccgtctctctgggtctctgtccccctctctctgggtctctgtccccctctctctgggtctctgtcccctctccctgggtctctgtccccctctccgtgggtctctgtcccctctccctgggtctctgtccccccctccctgggtctctgtccccccctctctgggtctctgtccccccctctctgggtctctgtcctcctctccctgggtctctgtccccctctctctgtgggtctctgtcccactctctctgggtctctgtcccactctctctgggtctctgtcccctctccctgggtctctgtccccctctctctgtgggtctctgtccccctctctctctgtctatccctgggtccctgctgccccaccttctgattctctgtcccctaagtctttgtctccccctctttgggttaaattgtcccctccctgtctggcatcctcctttctgagtctgttccctctccgccactggcccccaactccttctgttcccatctcgcgcttgcccttggagtctcccctgtgtgtctctctccccccggcccgggcctctgcaccccccaggtcgctgtccctctgtccccttatcgcggcctgggacccgccctctccccgcctcccgctttggcgtctccaagactccccgccccccagacctcgccccgccccaggctaggctggaaagtggaggatccggtttgctctgggcgggtctggaagcagagccggcggagggagcgccggggccctgggctgcaggaggttgcggcrgccgcggcagcatggtggtgccggagaaggagcaggtgagcgccggaccagggtctgcgggagcgcggagctggggacctcgcctccaggctcccagagaggagggcgctggacacccagattcctgggtcagacggaggagggggatgggagggtccaggttccagggtccagggcatgggggtcgagactcctgagtctggagcgggagggcgctgggggcccggactcctgtgtccgtggggagcgcacggggtgggtggctctgtgtcccataggacagaactgggtgccctctcaccccacttccacccctacatttgttcctgtccccagagctggatccccaagatcttcaagaagaagacctgcacgacgttcatagttgactccacagatccggggtgaggagttcgcccctggactgaccccagrgggtccgcggcccgctgaccccgcccgcggatggycacgccccagccctgctccttccccattcctggactcggggaccttcccaagggcgttccttgccgacgctctccctctaggagcgtttgggtctstgtagacacccctcattccccattcgccattctcccgctcagggtcagtgtagacgctccagggctcggttctgcttctttcctccccgatgtctcttctatgtgcttctgtctcttcgtgtcactttctgtgtctctgtctttcccttttgggtatttctgtttcattcattcattcattcattcattcattcatccatccatgcaagaaaccctcactcagcgctcccaaggtccctttagcctaattcaacggccctgccagggttccaatttcccctgggacacgtgctgtgtggcttcgggcaaatcatttcacctctctgggtcccgtttctcatctgagcatcaaaagaggcttgatctcctggggttattatgagaattaaacaagttaatgcttgtgatattcctggcacagcgcccagcacaggacgctgggaaatatctgcagctcccactgggaggtggcaattattaccgcgggcgggccctgtcttggtggccggggacaccaattgagctagatagggtgtgtgcgtccgcgaggagctcccgcccttcagtgacggcctctcaagcggatccaggctttctagttttttttttttttttttttttgagacggtgtctcgctctgtcccccaggctggagtgcagtggcgcgatctcggctcactgcaagctccgcctcccgggttcacgccgttttcctgcctcagcctcccgagtagctgggactacaggcgcccgccaccacgcccggctaattttttgtattttagtagagacggggtttcaccgtgttggccaggatgatctcgatctcctgaccttgtgatccgcccgcctcagcccctcaaagtactgggattacaggcgtgagccatcgcgctgggccaattttttgtattttttttttagtagagacggggttgcaccgtgttagccagatggtctcgatctcctgacctcatgatccgccggcctcggcctcccaaagcgctaggattacaggtgtgagccaccgcacctggcccaggctttctagttttttgttttttgtttttttgagacagagtctggctctgtcgcccaggctggagtgcagtgttgcgatatcagctcactgcaacatccacctcctgggttcaagcagttctcatgcctcagcctccctagtagctgggattacaggtgcctaccaccatgcccagctaattttttgtattttagtagagacgggatttcaccctgttgcccaggttgrtcttgaactcttgatctcaggcaatgcacctgccttggctttccaaagtactgggattacaggtgtgagccaccgcgcccagccctctagttgtttttcaagacagtttttggggtgygggaagtatccacattcctacttcagtgtgtattttgttatgactatatattagtgcagtatggcttgtaaatgatggataaataaacagatatgcgcttgttggacgtgagtgctcaaaacctttttactgataggtcagtgtggtcaagacaatttaggaaactctggtctggcctgaggaggaagaaacgcagaagataattatagtaaggcaaggggttgcagctcccaaagacgagccactgggctctgtgagagctgggaggaggtgtttgcttaagactgggaggggacacaaaatgtcactaatggtttctggagggaggaagagtggctagtgaggtgacatttgaaagtgagctggagagaggcccatggaaagcgatttggggccgggcatggtggctcacgcctgtcatcccaacaatctgggaggccgaggcgggtggatcacctaagtcaggagttcgagaccagcttggctaacatggtgcaaccctatctctactaaaaatacaaaaattaactgggcgtattggcgcatgcctgtaatcccagctactcaggaggcaggagaatcacttaaacctgggagacggaggctactatgagcagagatcacatcactgcactccagcctgggtgacagagcaagactccatctcaaaaaaaaaaaaaaaaagaaagaaagaaagaaaaaagtgatttgaacagcatgtgcaaagtccttgctaaggaccatatggtttggcttgaatatgaatcaaagttcagggtgcagggagcactgtcatgagagaagaggctgcagaggagggcagggccagagcttgcagggtgtcagaggccaccctaaggggctgggatcttgtccttgggagctggggcatcaccgcagcagtggggttggctctgggtgtggaaaaactttctggggctgggagaggatgaacaggagctcgggaggaggctgtagagagcgtctgagcgggaggggtagtggcctgagccaggtcagggctttcgggacacagagaggagggcatggggcaaagactcagggggcaggaaggcagagcttggggcttgatgagggtgatgagggagagagggggtgccgccatcggtggatggctccgggacgtatggtctgctgactgggacacagtggggctgtccctgagatggagagctcaggagggcaagcaggtttgggaaatgtcgctgagtgcaatgtgggaatctgtgcatatgagcggcctagggggaccgaggggcatgtggggactgagattgggaaaggtctggactaatgtccagaatctgagaggtccgagttgtagctggtaattgaaactggaagtaggtaagacgtcacagggaaaacaacgtgtaaagtcaggggagttgcaaactggcaattctatagccaattgtgtgcgtgtgtttgtgtgtgtgtgtgtttagaagagcatttaaaaatatctgtcttctgtctctctctcttttttttttttttttttttttgagacagggtcttgctctgttgtccaggctggagtggcacgatcatggttcactgcagccttgacctgctgggctcaagcgatcctcccacatgagcctccggagtagctgggaccacaggcatgcaccaccatgcctggctaattttaaaattttttgtagaaaccgggtctccctttgataccagaccaggctggtatccaactcctggactcaagtgagcctcccacctcactctgcctgccaaagtgctggaattacaggcgagagccaccatacccggctacctcttttttttttttttgagacggagtctcgctctatcacccaggctggagtgcagtagtgcgatctcggctcacttcaacctctgcctcctgggttcaagcgattctcctgcctcagccccccgagtagctgggattacaggcacccaccatcacgcctggctaatttttgtacttttagtagagacaaggtttcaccatgttggccaggctgatctcgaactcctgacctcaagtgatctgcccacctgggcctcccaacgtgctgggattacaggtgtgagccactgctcctggccctggctacttctttctgttgagttacttgactggcctctgcacacattgggtttgagaatcatgtagggaaggcttgcactgggaacacctacactcaagggaggtgaaaagcaagagaaagccacaaacaagtcaggcatgaagcagccggggcggggaggaaggccagaggggcaggggtatcctgccaaggagagggtttccagaatgagagcctttcagctgtagccagggccacttgtgatacagtcagatgaaacctgcataagggccgttgtatatggagccaggcaggaaattgatgatttttatcaggaacaatttcaggctaggcacagtgactcacagctgtaatcccagcagtttgagaggccgaggtgggctgatcacttgaggtcaggagtttgagaccagcctggccaatgtggtaaaaccccatctctactaaaaatacaaaaactagccaggtactgtggcacatgcctgtaatcccagctactcaggatgctgaggcacgagagtcgcttgagcccaggtggcagaggttgcagtgagctgagatcgtaccactgcattctagcctgggagacagagcgagactccatctcaaaacaaaacaaaacaaacaaacaaaaaaaaaaacaatttatttcagtttctgtggctccaccgaggaaagagtgtaggaggcaagctgtgcagaaggaatggctcctagcactgaatgtcagaattttccacgattttggaaacgttctatgtctacatccaatatggcagtcctggccacagggggctactgggcacttggaatatggccattgtacctgagaaactgaatttttttttgaggtggagtctcgctctgtcgcccaggctggagtgcagtggtgcaatcttggctcactgcaacctccgcctcccgggttcatgccattctcctgcctcagcctcccgagtagctgggactacaggcacccgccaccatgccaagctgatttttgtatttttagtagaaacagggtttcaccatgttggccaggctggtctcaaagtcctgacctcaggtgatccgcccaccttggcctccctaagttctgggattacaggcatgaaccactgcacttgacctgaattttttatttgatttaattttaacttattagaacagaaagagctccatggctacaaagaaccccatgcagctatcacattggacagtacaagctccagactattccgtgaagagcttttattttattattattatttttttttttttttgaggcagagtctcattctgttgcccaggctggagtgcagtggcacaatctctgctcatcacaacctccgtctcccaggttcaagcgattctcctgcctcagcctcctgagtagctgggactacaggcgcgtaccaccatgcccggctaatttttgtatttttagtagagataaggtttcactatgttggccaggctggtctcgaactcctgacctcatgatccgcccgccttggcctcccaaagtgctgggattacagtcatgagccaccatgcccggccttatttcttatttttagtgacatggtcttgctctgttgcctagcctgaactgcagtggtgtgatcatggcttattgcagccttgaactcctgagctcaagtgatcctcctgctacagcctcctgagtagctggaaccacaggcgtgcaccaccacacctggctaattaaaacaattttttttgtagggatggggtctcgctctattgcccaggctgttctcaaactcctgggctcaagcagtccttctgccttgacctcccaaagtgcttggattgtgcccagccgtccttgaagttttgctcagaagagcaaactttctgggaagtagctgcaggtgttggaagtagctgcaggggaactaggggattcaaggatggagctgaaatgggtgaacggacaaagtcggtaaactgaggcatgccagggccctggaggtagactcaggaatgaagaagacactttattgtagttctcactgtgccaggacctggcctaagtgtgtttggttcatcccatgtgtggatcagttagccgttcttttagtgtctttacggcttttgccaaatccttgtagcacctctgctatcccttctgtaaaattgctcttaaatctgctcactaggtttgtgtaaatacaggtctcccctgatatctgaactcctggaatctggaacaaagaatttagatacatttttctccttctttcttcctttctctttcttttcttttcttttctctctctctttctttctttctctctttctctttctttctctctctttccctccctccctccctcccttccttccttccttcctttccttcctccctctctgtctctctccctccctccttcctttctttccttagtttttttttttttttttttttttttttttttttttgagatggagtttcgctcttgtcgcccaggctggagtacaatagtgtgatggctcactgcaacttctgcctcctgggttcaaccaattctcctgcctcagccttctgagtagctgggattacaggcacccgccaccacgaccagctaatttttgtattttttttagtacagacagtgtttcaccatgttggccagtctggtctcaaactcttgacctcagatgatccacccgcctcagcctcccaaagtgctgggattacaggcatgagccactgcgcccggcctcttgcttgcttgcttgcttgcttgcttgcttgcttgcttttctttccttcttttcttttttttgaacagggtctcactctgttgcccaggttggagtgcagtggcgtggtcacagctctctgcatcactgcagccttgatctcccaggctgaagtgatcctcctgcctcagcctcctaagcacatgctgccacacctggctaattttattttattttattttatttatttatttatttttagagacagggtctgactatattgcacagctggtctcgaactcctgggttcaggtgatcctctggccccagcctcccaaagtgctaggattacaggcatgagccatcatacccgaccctacattttcaaatgaatttctcattctccaaacccctgttacttactcaggtgccaatcacctttagaaagcaagagagacttgtgcatttctttaggtgggggaaagttttatatgtggaaactttccaaatggaaacctgttccatttggcacagagaggaagaaacaagccacacagaagccaaagacaatgaaaagcaaacaaaggtgtttccctactcgctagatggctgttgccagctccattttttgagcccgaggcctgcttttcttgttcaaaagagtagcaaagggttaggcattcaaaaatattctagcacccggctgagcctctctccttgacagtcgtcaggagaactgaaaaaggaatgactttctcactgcgttattcaaggttattttaagctccgtgtgaagttcgtgtcgcgttgcctctggctgggactggtatgcgagcctcatttcaggaaacacggcgttctttccctggctcctcatagctccgtggagtaggccgcgctattattgtcttttcattagaggaggaaatttaggctcagagaggtgaagccgctcgcccaaagtcacacagccgcgtcagccccgagcatgcgggctctccctgagttacccgctggatgttctttctcgtgttgaacgtcatgtgtttggatgggggcacagggcacagcaaggatacccccagtggccctctgccttcccacttgaggctcctcaggtgacagtgacctgcttcttcctgctcaggctttctggactcactggcttccttcccgtggggaaaggggaccgtcctcggctccagtctctccccgaggccgtcagagccagggccaggggcagcgtggactctgcctgcctctgtgggtgtggactcagtgtcgacagccccctctacaggagcatgaacacgctgacagggtgctggggtcggggggcagccctgggttcacgctccgccctcgcacccccagagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatgtgaggcgggcctctgtgggcggggcccgggcaccagggggctgcatgctcggggctccagagtggagccgggacgcccgccctgaaccctggcccctccgcccatccctgtcttggctctctttgtcccctccgccccacctatcttctctctgagggggtcccgttctctctgcgtctctttgtctctgtctccctctgtctccgtgtccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccgtctctccgggtctctgtttccccttttctgtgggtcactgtcctcatctctttgggtctgtgtttccgcttttctctgtgtctctgtccccgtctctctgggtctctgtctctgtctctctgggtctctgtctctgtctctctgggcctctgtttccccttttctctgtgtctctgtccccgtctctctgggtctctgtcttcctctctctgggtctgtttccccctctctctgggtctctgtccccatctctctgggtctctgtctgtttctccgggtctccgtccctgtctctccgggtctctgtttccccttttctctgggtctctgtccttgtctctctgggtctctgtccctgtttctccgggtctctgtccccgtctctccgggtctctgtttcccctttactctgggtttctgtccccatctctctgggtctctgtccctctctctctgggtctctgtccctctctctctgggtctctgtccctctctctctgggtctctgtcgccatctctctgggtctctgtcccatgtctctgggtctctgtccctctctctctgggtctctgtccctctctctctgggtctctgtccctctctctctgggtctctgtccctctctctctgggtctctgtccccgtctctccgggtctctgtttcccctttactctgggtttctgtccccatctctctgggtctctgtccctctctctctgggtctctgtccccgtctctccgggtctctgtttcccctttactctgggtttctgtccccatctctctgggtctctgtccctctctctctgggtctctgtcgccatctctctgggtctctgtccctctctctctgggtctctgtccctctctctctgggtctttgtccccgtctctctgggtctctgtccccgtctctctgggtctctgtccctctctctctgggtctctgtcccatctctctgggtctctgtcccatgtctctgggtctctgtccctctctctctgggtctctgtcccatgtctctgggtctctgtccctctctctctgggtctctgtccccatctctctgggtctctgtccctctctctctgggtctctgtccctctctctctgggtctctgtccccatctctctgggtctctgtccctctctctctgggtctctgtccccgtctctctgggtctctgtccccgtctctctgggtctctgtccccgtctctctgggtctctgtccccctccctgtgtgccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggtgaccgagggtgggtgggggctgtctcctgggcctcggcctgcctgccatctcccccacgactgtgggtggcctcccccgccgcccagtgtgtgtgtgtgtgtctctgtcttattctttgtttctctccccctgcctctgcatgttcctcggcgtctgtgtaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaaggtgtgacccagggacttggaaaagggggctggaggcctggactcctgggtctgagggaggaggaggggctcgtgtttgtccttctggccccgatgaggagacgccctggtctggccatttttcccctagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggaggtgagtggtcgaacccatgacccacaacccacgacccacaacctgcaaccccagcgctcaggatcccagtagtttggtctggtcgagatttggggaattacctatggttaagtgtctttccccgtcattattcatggttttaaaaacttctgtctgagagtgagttagctcacatcagtaatcccaacactttgggaggccgaggtaggaggattgcttgaggccagtaattcaagaccagcctgggtaacagagcaagaccttgtctctaccaataataataataataataataataaagaataaaaaataaattagccaggtgtggtgtcgtgtgcctgtaatcccagctacttgggaggctaaggtgagagaactgcttgaacccgggaggtggaggttgcagtgagccgagatcaagccactgcactccagcctgggcgacaaagcaatactccatctcaaacaaacaaacagactttattttgaaatttctcatacatacagaaaaatgcacgaaggtggacagcttgatgcatttttttctttttttgagacggagttttgccctgttgcccaggctggagtgcagtggcgcgatctcggctcactgcagcctctgcctcctgggttcaagcaattctcctgcctcagcctcctgcctcagactcctgagtagctgggattacaggcacgtgccatcacacccggctaatttttgtatttttagtagacggggtttcaccgtgttagccaggatggtcttgatctcctgaccttgtgatctgcctgctttggcctcccgaagtgctgggattacaggtgtgagccaccgcgcccggcctaatgtttgtatttttagtagagatgaggtttcaccttgttggctaggctgttttcgaacttctgacctcaagtgattcgcccacctcagcctcccaaagtgctaggattacagacgtgagccactgcacctggctccggctaatttttaaagttttttgtagagacagggttttgccatgcagcccaggtggcctcaaactcgtggtcgaaagtggtccacctgcctcagcctcccaaagtgctgggattacggtcgtgagccactgcgcccagccagccaatatcttataattttatcaaaacatgaacaagatacattactaggtttgaggaaagtttttgatttttgtgtatttttcttgtatcaatcctcttaccaaattttcttattgatctttatttttatttttggtggggttttccaattttctgggaatacaagccatgttttcttcaaataggtacttttgtcccttccagctttacaaaaaaccaaaaaccaaaaaatcaattttcacttcagtgatttcatttttttgcattattgagttagctcaaaactccaggatgaatacagtgttagtggtaatgtggtctagtttctaatttatttatttatttttttgagagggagtcctgctctgtgcacaggctggagtgcagtggcgtgatctcagctcactgcaacttctgcctcctaggttcaagcgtttttcctgcctcagcctcccgagtagctgggactataggcacgagccaccactcccagctaatttttgtatttttggtagagacggggtttcaccatgttggccaggctggtcttgaactcttgacctcaggtgatccacccgcctcggcctcccaaagtgctgggattacaggcatgagccaccgcacctggcctagtttctaattttaatggaagtagagtcgatatagtgctatctttatggtgcaattggattttggtaaatatctatattgtggttagatagccctttctattcccatttcctttactttctatttgaactttcactccctctggctcctggatggttaatcaatgacaggattgactcatacaagaaacacctgcctcattcagggactcaggagtctaggtcctcagccccctcctccctggggaagttaagcattactgtcttcaaaatctagctccctcctgaagtgtccaaagacatgacaattctggccaggcgcgctggctcacagctgtaatcccagcactttgggaggccaaggtgggaggatcccttgagtccaggaattcgagaccagcctgggcaagatggcaagacccctgtctctaccaaaaattaaaaagttagctgggcacggtggtgtgtgcctgtggtcccagctacttagaaggctaaagtaggaggatcaagatgtagtgaggtgtgatcatgcccctgcactctatcctgggcgatagagtgacaccctgtttcagaaattaggctgatgcggtggctcatgcctataatcccagcactttgggagtccaagttgggaggattgcttgaggccaggagttcgagaccaccctggccaacatagcaagacccccatttctaaaataaatacataattaagtaaaaaaagaaatgacaattccaatgagcctctgaacagaagattaggacaaggctgatgtttgccgactcctgggaaatgcggttttctcctatctccagcaaaggctgatgggaggtaatcaagcccccttctcttcttgcctcagggactggaattgacatccctgtcctgctcctcctgattgatggtgatgagaagatgttgacggtataggggcccggatgcccggatctaagggggaaggagggttgggggccaggactcctgggtcctgagtcttagggagggtctgggggtctgactccgggtagggtgaatatcctgccttttctgacgtgatgaataaagaatgcctttatcctgtagcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtatgacactgggggcccaactctggatcctgagatgggagggaactggggacttgggctcctgggtctgagggaggaggggctgggggcctggacttccaggttccgggagaagagggtgctgggcatatagactattaggtcctggaggggaatggcctcctccatccctttggacagggcccaacaggagttggggatggaggcgggctagggatgcagaactggctattccacaggtggagaggattatgacccggaaggagctcctgacagtctattcttctgaggatgggtctgaggaattcgagaccatagttttgaaggcccttgtgaagggtaaaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattctttcatccatccatcctttcacctgtccatccacacatccactgacaattcctgagaattccatccgctcattcctccatccgtcttctcacctgtccatccacacatccactgacaattccattcagtcattcttccatccatccatcttctcacctgtccatccatgcatccactgacaattcctgagaatgccatctgctcattcttccatccatccatcttctcacctgtccatctacacatccaccgaaaattcctgagaattccatccactcattcctccatccatccatcttctcacctgtccatccacacatccactgacaattccattcactcattcttccatccatccatcttctcacctgtccatccacacatccactgacaattcctgagaatgccatccgctcattcctccatccgtcttctcacctgtccatccacacatccactgacaattcctgagaattccatccgctcattcctccatccgtcttctcacctgtccatccacacatccactgacaattccatccacttattgttccatccatccatcttctcacctgtccatccacacatccactgaaaattccattcactcattcttccatccatccatcttctcacctgtccatccacacatccactgacaattccattcacttattcttccatccatccatcttctcacctgtccatccatgcatccactgacaattcctgagaatgccatctgctcattcttctatccatccatcttctcacctgtccatctgcacatccactgaaaattcctgagaattccatctactcattcctccatccatccatcttctcacctgtccatccacacatccactgacaattcctgagaattccatccgctcattcctccatccatccatcttctcacctgtccatccacacatccactgacaattccattcactcattcctccatccacccatcttccatccatttacccatctacccatccatcttttcattcatccatccaactgttcttccatctatccatccacccacccattcttccttccctacatgcttccaatatacatgaagcactctggctagacatgaaccaaagcactgtctcccagtgaggaagtccagatatttcactagaaatggcagcttggaggacggaatgatgaaaaccaaggcgggggagcataatgcacacctgggagaggctggggagggtcttatttatttattcacttattgagacagggtcttgctctgtaggccaagctggagtatagtggtgtgatcacggctcagtgcagcctcaacctcccaggctcaagtgatcctcccaccccagccttccaagtagctgggaacatacccgcccaccactacacctggtaaattaaacaaaaaaaaaattttttttttgtacagacgaggtcttgctctgttgcccatgctggtcatgaactcctggcctcaactgatcctcctgcctcagtctcccaaagtgctgggattacaggcatgagccaccatgccagcctcctttatttagtcaacaaatacaatcctaggctccagagactaaagccaacccatttcctgctctcaaagaccccagatcccactaggattgtttggatacaaccttaggtaaaatttaagacagaagcacaggcaagaatcactgtcgttagaaggaaaacttcaaggaaaagttgtgtgtgtgtgtgtgtgtgtattttgagacagagtcttgctctgtcgcccaggctggagtgcagtggtgcgagcttggctcactgcaacctccgcctcccgggttcaagcgattctcctgcctcaccctcctgagtagccgggattacaggcacgtgccatcatgcccggctgatttttgtatttttagtagagacggtgtttcaccatgttggtcaggctggcctcgaactcctgacctcatgatccatccacctcggcctcccaaagtgctgggattacaggtgtgagccactgcacctggccagagaagttggcatttaaaccggaccttggccaggcacagtggctcacacgtgtaatttcagcactttgggaggctgaggagggaagatcgcttgagcccaggagtttgagaccagcctgggcagcatggtgaaatgccacctctataaaaaatacaaataataagttggggagggtggcgcatacctgtaatcccagctacttgggtggctgaggcaggggaatcgctcgaacctaggaggcagattgtgccactgcactccagcctgggtgatagggcaagactctgtctcaaaaaaaaaaaaaaaaaacctaaataaataaaccaaataaactggaccttgataagtcagtagaatttggatttagtaagctaacgagtgggacagataagtattcaggaagattcccagggctctgtgtggggagggtcatttttggtgtcagaagaacttttttctttttttttttgagataaggcctcgctctgttgctcaggctggagtgcagtggtgtgatcttgacccactacagtcttgacctcctgggctcaagagatcctctcacctcagccccacaagtagctgggaccacaggcatgtgccatcatgcctggctttttttttttttttttttttttttgagacggagtttcgctcttgttgtccaggctggagtgcaatagtgccatctcagctcactgcaacctccgcctcccgggctcaagtgattctcctgcctcagcctcccaagtagctgggattacaggcatgcgccaccacacctggctaattttgtagttttagtagagatggggtttctccatattggtcaggctggtctcgaactcccgacctcgggtgatccgcccgcctcggcctcccaaagtgctgggattacaggcatgagccactgtgcccagccttttttgtatttttagtagagatggggtttcactatgttgcccaggctggtctcgaactcctgggctaaagctatctgcccatctcggcctcccaacgtgctgggattacaggcgtgagccattgtgcttaggccagaagaattttacgggggaaatacacactaagatagaaactccccagatacacggtggcaatatatacagcattctacctcagctccccacccatgtttgtggtgtggtatatattttaattatttttcttattttaattatttctttctttttcttttttttttttttgagacagagtctcgctctgtcgcccaggctggagtgcagtggcgcgatctcggctcgctgaaagctctgcctcctgggttcacgccattctcctccctcagcctcccgagtagttgggctctctatttttagtagagacggagtttcaccgtgttagccaggatggtctcgatctcctgaccttgtgatccacccgcctcggcctcccaaagtgctgggattacaggcgtgagccacggcgcccggcctcttttttttttttttttaaagagtctttgtctgtcgcccaggctggagtgcaatggcgccatctcagctcactgcaacctcctcctcccaggtttaagcgattctcctgcctcagcctcctgagtagctgggattacaggtgcccacaaccgcacccggctaatttttgtatttttagtacagacagggtttcgccatgttggccaggctggttttgaactcctgacctcaggtgatccacccgcctcggcctcccaaagtacttggattacaggtgtgagccaccgcgcccggccttaattcatttttaggtattttttgagacagtctcactctgttgtccaggctggagtgcagtgggacaatcatagctcactgcagccttgagatcctgggctcaagtgattctctcgcatcagcctctgagtagctgtgcgccaccacaccaggctaatttatttttaatttttttgtagggatagggtctccctatgttgcctgggctggtcttgaactcttgggctgaagagatcctcctgccttgacctcccaaagtgctaggtatagtacaggctgtggtagggtagaaagagcaagttatttttgctttggaatcagacaaaactgaatttaaataccagcttgggccgggtacagtggctcacgcctataatcccaacattttgggaggctgaggtaggatcacttgaggtcaggagttcgagatcagcctggccaccatggcaaaaccctgtctctactgaaaatacaaaaattagctggcgtggtggcgggtgcctgtaatcccaactagttgggaggctgaggcaggagaatcgcttgaacccaggaggtggaggttgccgtgagccaagatcgtgccactgcactccagcctgggcgacagagcgagactctgtctcaaaaacaaacaatcaaaaagaaacaaaccagcttggccctttcttgctgtgtggtcttgaggaagcagcttcccctctctgagccccagtttctctctgtggaaagtggagataatatcttacaggagtgttataagcctccatggcaaggtatgagttgtgcccggtcccggtgggggcccaataagagggatctcctcttaatatgattccatttcctctgggggtacatccttcaatataaggtaactctcagtgggcaaatctgattcactctgcggaagttaactcagcagcctcctgggagaaaatacggcagctctgcaagatgtggtttgagggggtggtgttgtaagcccagcaggagtggaagtgatcacagtccactgggggaactggagatggctgataggcttggggatagcagagttgaatggatggaatttcagcaagaaagaagggcaaggtcatgaatgcgtcttttttttttttttttttttttgagacagtgtctcgctctgtcgcccaggctggagtgcagtggtgtgatctcagctcactgcaacccccgggttcaagcgattgtcctgcctcagcctcccgagaagctgggactacaggcacctgccactatgcctggctaatgtttgtatttttagtagagatggggtttcaccatgttggccaggatggtctcgaccttctgacctcgtgatctgcctgcctcggcctcccaaagtgctgggattacaggtgtgagccaccacccctggcccatgaatccttcctaagagtctagcataggcaggcccagtgctgggcagttggtgtactcttttgcccttcatctcccttccctgcctgcaaggattatcaccccattttgcagatgaagagactgaggctcagagagaggaaaaatggcttgcccagggtcatccagctagtagcaggggtcaggcttttcatgtgagtctgtataattctcaagcccattgcaaggggcatgtttggagagaggtcagaggctcgcagggttggtatgtatcattggcatgaagggagtgttggagacaaggccagtgaggcaggtagggccaaaccacccaggacctcaaatgccaggcagaggggctaaggctgtccttgagaggcagcagaggaccagggtccgttatgtggataaaaaagactctctggccaagcgtgaaggctcatgcctattatcacagcaccttggaagactaaggaaggaggttcgcttgagcccaggagtttgagaccagcctgggcagcatagtgagaccccatgtctataaaaaattagctgggtatggtactgtgcgcctgtagtcccagctactcgggaggctgaggcaggaggatcgcttgagcctgggaggtctcaaagctgaagtgagctgtgatggcgccactgcactccagactgggtgacagacgaagaccctgtctcaaaaaacaaaaacagactctctgggagtgggtgggggcagagtggagaggagagaagagactgcagtgatggtgtttgggggtgccgaagcttgagctatagctggggccaggaggacagtcggggaggctcagcagagagtcaggaggctggacgtgggacatgaagcttgggggctgatggcctgtgagatgggaggagcaggaagggacaaggacagtacctgcgggtctgccttattgattgggtggacagaggggccattcctgagatgaggacgtagggaagatgggtttgagggctagatgctgagttgagtatggaacacggtgagtctgaagggacaaggtggggccagggtcgagtgcccaggtgacaaatggtgccagattaaggcggaatataaagcaaggtattattattattattatttttatttttttattttttttgagatggagtcttgctctgtcgtccaggctggagtgcagtggcacgatcttggctcactacaagctccacctcccaggttcatgccatcctcctgcctcagcctcctgagtagctggcactacaggcgcccgccaccatgcccggctaattttttgtatatttagtagagatggggtttcactgtgttaaccagggtggtctcgatctcttgacctcatgatccacccatctcggcctcccaaagtgctgggattacaggtgtgagccactgtgcccggcctattattattatttttgcaacagagtttcgctctgttgcccaggctggagtgcaatggcgtgatcttggctcactgcaacctccacctcccgggttcaagcgattttcctgcctcagcctcccaagtagctgggattacaggcatgagccaccacgcccagctaattttgtatttttagcagagacgaggtttctccatgttggtcaggctggtctcgaactcctgacctcaggtgattcgcccacctcggcctcccaaggtgttgggattacaggcatgagccacagcatccagcctattattattatttgagacggagtctccctttctcacccaggctggaatgcagtgacgtgatctcggctcactgcaacctccacctcccgggttcaagcgattctcctgctcagcctcccaagtagctgggactacagacgcatgccaccatgcccagctaattttttgtattttagtagagatggggtttcaccgtgttacccaggctggtctcgaactcctgagctcaggcgatccgcccatcttggcctcccaaagtgctgggattacaggcgtgagccacggcgcccggcctgtaaagcaagatattatgaacaattttgtttccttcttttgaaactgtggggaaagtaggagagcttcatagaatcgtagaaagtcgtggaaaagtccgctctgaatggacgtctgggttttgaaagagcacagaaagccatgaggtcctagacatgttactgcctttctgggcctctgtttcctcaagcacagccttggaggttacactggccaagctgtagtgtcgccacagcgtggaacttcttcccacagttactgtaattgattacagtgctatgaagggggtgccactatttcccatttaatagatgaggaaactgaggctcccaaggttcaatggcttgcctgaagtcactcagttggtactggtggaccggggactggaacccacgtctgcctgccccagagcctattgctcacctccactacatgagattatctctttctgtggtaccagtttttggagcaaccaaaatgagatgaatttgttttggagatagatatggagcaagtggaggcagaaggaaacctaactccatgtcacgacaaatgcccttcaggacttttcatgcccctgttgactgcacatgtttggatccactacatagctggatcaaatttttaagggtttctggttctctcttgctgtttcagtgacctccagggtctctcggagtccctctcctgttctcattttctgctgttgtcacctctttcccttcacaatataccccaagtttcagaaatcagagtgactcacgtttgtcatcatctgctgtgtgtgtgtgtgtgtgtgtgtgtgtgtgtgtgtgtgtgtgtgtgttgcacccgggcctttgcttctgctgtgcctgctgctttgaacgcccttttcgcaccttaggggcatacctcccagtcctggtggtctttcaaagtgctacctcaacacccattctctgggagctctcttgggccactctatacctctgtgaccatatcctcctctgggccctaatcatattatatgcctatagatgcctccttagacacccctccaccctgccttccattatggcctgtccagccttccctttaatcgcccatccatctctgattgtccgtctgccccatcttgtttcctctctccccatccatccgtctgtccatctatccatctatccaccctgtacatccatctatccatccatccgttcattcatccatctctttatcctttcatccatccatttatccatcccatccatccatccttctatctgtccatccatccatcctaatcatattatatgcctacctctgagggcaccaagcaccctgagggtagttatgtgttggggggacatatttcccccaatagaaccagcttcttcagggtaggaactgtatctgatttctctctccatccctcccactgcttggtccataacatacctcaataaatattaaatgaataagtgattccttttgtttcttcttgggggctgtaaaccagtggtctgtgctctggccctgagccaaatgaccttatgcctatgatagcctgactgctttaagacccccacactctgcccagtagcaacccctttatgcagagtttaaaagtcagacatgcaaaatagaggcaaaatagacattcagcagatgtccctcctcccctgacttcttgtcccctctccctctaatccttccagcctgtgggagctcggaggcctcagcctacctggatgagctgcgtttggctgtggcttggaaccgcgtggacattgcccagagtgaactctttcggggggacatccaatggcgggtgaggggtcagggcctgggggttgggcatactgacaaagggactgtgctgtcctccctctctgccttctttttttttttttttttttttgacggagtctcactctgtcacccagcctggagtgcagaggtgtgatcccagctcactgcaagctccgccacctgggttcacgccattctcctgcctcagcctcccgagtagctgggactacaggcgcccgccaccacacccagctaatttttttgtatttttagtagagacggggtttcactatgttagccaggatggtctcgatctcctgaccttgtgatccgcccgcctcaggctcccaaagtgctggggttacaggcatgagccaccgcacccggcctctctgccttcttagacgcccctcaaccctgccttccattatggcctgtccagccttcccttaattgtccatccatctctgtccatctgccccatcttgtttcctctctccccacccatccatctgtctatccatccatccaccctgtacctccatctatccattcatccattcattcatccatctacttatccatccatccatccatttgtccatccatccatttatccatccatccatccatccatccatccatccatctgtccatccatccatccatccatccatccatccatctgtccattcatccatccatccattcatctgtccatccatccatctacctatccattcatccatacatccatccatctacctatccattcatccatccatccatccatctatccatccatccatctgtccatccattcatctgtccatccatccatctacctatccgttcatccatccatccctctgtccatccatccatccctctgtccatccatccatccctctgtccatccatccatccatccatccatccatccatccatctgcccatccatccatctgtccatccatccatctacctatccattcatccatccatccacccatccatccatccatccatccatccatccatccatccatccatccatccgtccctcatacccttgcccatctcttgtccttaacctttgagctaatctcttcccctattcatcccaccctgccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcgtaaggaccgggcaaagctggggggcccccccgcgcgggaaggacctgggggcgggattacatcagggatggggcgtggccaaaccagaggcagggctggtggtggccagtgttggggaggggctggtcctcaccacccctccttttgctggcagatgtatctgctctcggacaaggccacctcgccgctctcgctggatgctggcctcgggcaggccccctggagcgacctgcttctttgggcactgttgctgaacagggcacagatggccatgtacttctgggagatggtgagtgctgacttggcgctcctgcatccctgtcctttaggccactggatgccagtgttcccgaaacaattaccatacaattccccgacccctgacgtcacctgacaggcgccccatcctccgtcgctgatatatgcctccaactgcttcctctttcttttctctctctcacatcatgcattattttatgtgtttattttttgagacagagtctcgctctgtcgcccaggctgcagtgcagtggcgcaatcttggcttactgcaccctcagtctcccgggttcaagtaattctcctgcctcagcctccggagtagctgggattacaggcacctgcccccacgcctggctaatttttgttttgttttgttttgttttagtagagatggggtttcaccatgttggccaggctggactcctgacctcaagtgatccacccgcctcggcttcccaaaatgctgggattacaggcatgtgccaccgtgcctggccaagattctctctttgttttggcctttgataatatatctcagtgtggatctctgtgaatttctttttctttttcttttttttttttttttgagatggagtcctgctctgttgcccaggctggagtgcagtggcatgatctcggctcactgcaagctccaccttctgggttcatgccattctcctgcctcagcctcccgagtagctgggactacaggcgcccgccaccacgcccagctaattttttgtatttttagtagagatggggtttcaccgtggtcttgatctcctgaccttgtgatctgtctgccttggcctcccaaagtgctgggattacaggcgtgagccactgtgcttggcctgtgaatttcttttacttggagttccttgagcttcctggatgtgtagacttttgtctttcatcacattttggaagtttttaggacattatatcttcaaatattatttctttccctttctgtctctcttttccttttggactctcattatgtatgtattaatattctgtatggtgtctcgcaagtcccttaggctctgcttattttccttcatttgtttttcttttttctcctcaggctggataatctcaatgtacttagcttcaaattcactgatctttattttgccttttttatgaatctactgttgagtccctctagtggtttttatatttcagttattgtgctttttagcttcagagtttctatttggttcatttctgtctctgtagtctttttttttttttttttttttttttgagacagagtctcgctcagtcgcccaggctggagtgcagtggctcaatctccgctcactgcaagctctgcctcctgggttcacgccattctcctgcctccacgccattctcctgcctcagcctcccaagtagctgggactacaggtgcccgccaccacgcccagctaatttttttgtatttttttagagacagggtttcactgtgttagccaggatggttgcgatctcctgacctcgtgatctgccctcctcggcctcccaaagtgctgggattacaggcgtgagccactgcgcccggcctctgtagtctgtcttttttttttcctggtcccactacaaaactttatttttgattacagtaccattctcaatctcttctacaaaaagcagaaaaaaaagcagccacttcactcaagacctatatacagataagatgttttctgtgtttttttcttttttttttaatttttatttttaaaaaaataaattcagtgttcacatttctataaagaattaacccagtttcaggaaaccctgcctctatctctgtattcttattctctaggtggtgagacatctttttcctggctccctttagttcttttttcatgatttcctttagctcttcgagcatatttaagacaatttatttaaagcctttgctagtaagttcagtgtctgagtttcctcagggatagtttctattcatttatttttttcctactcatttctattcatttcatttcttttcttttatttatttatttgttgttcttgttgttgttgttgagacagagtctcattctgtcactcagactggactgcagtggtttgaccaaagttcactgcaaccttgacttcttggactcaagcaatcctcccacctcagcctcctgagtagttgggtctaccagccacatgccaagctaattttaaaaaatttgcagagatggggtcttactatgttgcccaggttggtcttgaattcttgggctcaagcaatcctcctgcctgggcctcccaaagtgctgggattacaggtgtgagccaccatgcctggtctctattaatttcttttttttccagtatatgaaccatattgtcttgtttctttgcatgcctcataatttttggttgaaaagtggaacattttgaatatgataatgtggcaactctggaaatcagcttatgccctccctccagggtttgttgtggctgctgctcattgtgggtcattgttgtttgtttagtgacttttcttttttctttttctttttttttgggggaggggggatggagtctcactctgtggcccaggctagagtacagtggtgcaatctcggctcactgcaagctccacctcccaggtttaagtgattctcctgcctcagcctcccaagtagctgggattacaggtgtgtgccaccacacccagctaatttttgtatttttcatagagacggggtttcaccatgttagccaggctggtctcaaactcctgacctcaggtgatccacccaccttggcctcccaaagtgttaggattacaggcgtgagccaccgcgcccgccctgtttagtgacttctctaaaccttttttggaaagtctgtattctttgcatgtgtggccatggaagcccctcttctgttagcttagtggtctgctggtgacttgacagagatatccttaaatgcctagaaccacagaagcaaatataacaagaaactccctataagtgctgggattagaggcatgagcgacgcccaccgtggctgtatattgaagcagtctttcaatacttagccaagctgtttacagttctgctttagtcttcacttcctgcttgtgcagagcctaaagttcagccagatgtaagagcttcaggttttctctggtattttctgagcacgcctctagccctagtcatgcatctagccgtctggatttcctggtacacaaggaagactttcaaagcccttattccctccaagtatttcctttcatggcctctttcttcccaagatgcttagtgtatctattactgcctctactgtgagtccttgcctcagatggatgtggttaattcatttgcctttaaaagattttaacaggccgggtgcagtggctcacacctgtaatcccagcactttgggaggccgaggcaggtggatcgcctgaggtcaggagttcgagaccagcctgaccaacatggagaaaccctatctctactaaaagcacaaaaaattagcctggcatggtggcgcatatctgtaattccagctactcgggaggctgaggcaggagaattgcttgaacctcggaggcagaggttgtggtgggctgagattgcagcattgcactccagcctgggcaacaagagtgaaactccgtctcaaaaaaaaaaaaaaagattttaacacacactgcctggaaagccactttttctctggggaaagctctaaggcaggtgaagcaaagtcaagtccttgagctgttgcttcagggagccaccagatagggccacacacacaaccacaattctggagggtaagtctgaattgctccctctagtactagcgacccacaccaggaatgtgtgtctttgtcttcaaggttgccactgaactggggagctgggggtagtaagtgggtaggttaaaatgtcacagtaccctcttactgaaatttagtggtctcttcattaagcattttcttgtttttttttttttataagttttcgattagattccagaattctagaaaagttgattctgacaacttttgatagctattgattgcttttgtggagggataaagttttgaagttccctacactggcatttttggtcacctctccaagggcttttaaaaatttcattgttagagacagggtcttcctcagtcatccaggctggagtgcagtggcatgatcatggctcactgcagcctcaacctactgggctcattcgatcctcctacctcagcttccctagtagctgggactacagaagcagaccaccacgcctggctaactaaaaaaaaaaaaattttgtagagatggagtctcaccatgttgcctggctggtcttgaattcctgggctcaagcaatcctcctcatttgtaaccacccaatgggttcacgttgcccgctgcctagacagagccgatttatcaaaacaaggaaagtgtaatggagaaagagtaattcgcgcagagccggctgtgcgggagacctcagttttattatcactcaaatcagtctcctcgaggattcagggatcagagcttttaaagataatttggtgggtagaggcttgggaagtggggagtgctgattggtcaggttggagatggaatcacaggggttggaagtgaggtttttcttgctgttttctgttcctgggtgggatggcagaactggttgagccagactacagtctgggtggtgtcagctgatccatccagtgcagggtctgcaaactatctcaagcactcatcttaggtgttacagtaatgatgttatccccaggagcaattgggggagccagaggctgcgtgacccctaaacttaatttctaatcttgtagctaatttgttagtcctgcaaaggtagactggtccccaggcaagatgggggtctttggggaaagggctattatcaatttcgtttcagagtcaaaccatgaacagaattccttcccaaagttagttcagcctatgcccaggaatgagcgaggacagcttaagggttagaagcaagatggagtcggttaggtctgatttctttcattgtcataattttctcagttatcatttttgcaaaggtggtttcacttcagcctcccaacgtgctgggattatagtcgtgagccactttacccagcctccaactgcttcttgacctgtctgtgactgctgaattgattctaactgcagcccagcccctgacttgcatccctggtctctgaaccacctgacttctggcattttcaactgactttcagtttcttccagatccatctccaaacattacttcatccttggcctctgatgaccccagttagtttctgacctctgactctgttccttcccttgacttcaggcttcctccccctctatgaaccctctttgacgcatccgtgccctctttgtctctccagggttccaatgcagtttcctcagctcttggggcctgtttgctgctccgggtgatggcacgcctggagcctgacgctgaggaggcagcacggaggaaagacctggcgttcaagtttgaggggatgggcgttggtgcgtggggcacggtgcctgggagcagggacgggggctgccgccagagggggatgtgcaactccgcactcctcacatatccctgcgccatccccttaaattcccttacctctcccttcacaccctcaccctactccttcccatccctgtcacataactaactcctctgccccagacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacaggtgagtatctgcgacaccaacatcccaaacagtctccaagtggactctgggaagtatggggatgagcccctgccattgggaacatctatggtcttgaccagccactctccctggagatcccccagaaagtctctcttctctctcagaaaggctgctcttcccataagaagccccgctcccttccaccaaaagccaaccttcccacggcaaagcccatcttcctaaaaagttccactccagatagagaaactccttgtgaccctgtcaggaaattccacctttaaccttggaagtccttcccgctttcagggaagagtccatttctttcaaaggaagtcctagctcatccacaggaagtcctacggcatccacaggaagtcctttccacttcctttagaggtccctagtttcagttttcagcagttagaatggcctcactgaacaattacctttttttttttttggacataaacaaactttggtctaggaaatctcacccttcctataggaaatcatctgccttgggaagccctacttgctcccacagtctctccgatcctgacaagttgacattttggaaacattatcaatatttttagtttaaatctgacaggggctcagagtcccactttagtacaggaagttgtgcccaacaggaagtcccatcctcatctgttggaatggtttggctgacatttcaaacagctacccagagtcccttgctgtggatagtggttaaactcatggattccagctctaccacatacaaactgtgtttctttgggccgtttccttaacctctctgtgcctcatgtgtaccaaggaggagatactagtacccacccccttatgtgtcaagggttcggtggactaatctacataaagtgcttagccctgtatctgccatatggtgtcaatttaagtgttgactgtttactgccaaaacctggcctaagttgtctttgcctttcaccaccgtttccctacctcaatagttgtggctgtgacattgggcacttgctctgtactctggagctgcagtccaacccttgctgggcgtcttagggacggggctgtgggggagatttggatcctaatccttcccaccccccacagtctctgctgacacagaagtggtggggagatatggccagcactacacccatctgggccctggttctcgccttcttttgccctccactcatctacacccgcctcatcaccttcaggtcagtaccctggggtgagagtggtggggatgggggcggggtgctcagtttctccttcctgccccctctgcccacctttcttccctcatcggcccattgtgtcccttccctaggaatgggactctctgtccctccactaagggagtgctgtgggaggtgagttttgggggggatcctccctgtggtatctctagtggcagttactctgcctttctggccatggctctgggggaaggtccctttgggatgactttaggagaccacctctctgtccctctgccatgtctccgggtgaagaagtttgagttttgctggagaatgcctctccaccttctcttcccctcatttcttgctctgtgcttccccccttgctaggaaatcagaagaggagcccacacgggaggagctagagtttgacatggatagtgtcattaatggggaagggcctgtcgggtgagtggagcctccagcactgtgtgaggtggggacaccctgggcagttcaggacatgtgccagttccacgttgtgttagtcccctcttgagttgctacaaagttgctaaacctgagactgagtaatttataaagaaaagaggtttcattggctcatggttctgcaggttgtacaggaagcatagtgctggcatctgcggctggtgagccctcaggaagcttccactcatggcagaaagtgagggaggagccagtgtatcacatggcgagagcagaagcaggagtaggggtgccacatagatctcatgtgaactaactgagcaaaaagtctccaaagggatggtgctgagccatttgtgaaggacccaccaccaggacccaaacacttcccccaggccccacctccaacattagggattacatttctttgttctttttttctttttttttgatacggagtctccctcagttgcccaggctggagtgcagtggtacaatcttggctcactgcagcctctgtttcctgggttcctgatcagcctgcctcagcctcccaagtaggtgggagtagaagtgcatgccactacgcccagctaatttttgtatctttaaagtagagtcgggatttcaccatgttggccaggctggtgtcaacctcctgacctcaagtgatccgcgcactttggcctcccaaagtgctgggattacaggtgtgagccaccgggcccagccagggattacatttctttctttcttttttgaaatggggtctcgctctgtcgaccaggctggagtgcagtggtgtgatctccgcctcctgggttcaagcgattctcctgcctcagcctcccgaatagctgggactacaggagcccaccaccacacctggctaacttttgtacttttagtagtgacagggtttcatcacattggccaggctggtcttgaactcctgaccttgtgatccgcccgcctcagcctcccaaagtactgggattacaggcatgagccaccatgcctggcccagggattacatttcaatgtgagatttggaagggacaaacatccaaactatatcacacgtcccatcagggactgagatactgaggaagcttcccaggtgccaagctcaagacttggctcaagatttggttctgccatcaaggaggccatcaccagaaattgattttcttcatgctacacatacttccatccctctgtagcaagcggaatcagttgattgagggatttttcacctattttgttcgtggtcccaaggcccctgcttttaatcactatgctatggttgccgttaaggtattttaaaagtcaggcctaagcaaatgaaatagaatatttatcaaacttctttttttgttgttgtttttgaggcggagtcttgctctgtcgccaggcaggagtgcggtgccgcgatctcatctcactgcaacctccgcctcctgagttcaagcgattctcctgcctcagcctctcaagtagctgggattacagtcacctgccaccacgcccagctaatttttttgtatttttagtagagacggggtttcaccatgttggccaggatgctccccatctcctgactttgtgatctgtcctcctcagcctcccaaaatgctgggattacaggcatgagccaccatgcctggcctatatatagttttttaagacaatgtagagaggatacaaaatatttatctgtagccataaaaaagaacgagatcatttcctttgcagtgacatggttggagctggaggccattatccataacaaactaacaggaacagaaaaccaaataccccatgttctcacttataagtaagaactaaatgatgagaacacatggacacacagagtgaaacaacacacattggggcctattggaggacagagggtagggcgagggagaggaccaggaaaaataactagtgggtactaggctaaatacctgggtgatggaataatctgtacaacaaacccccatgacacaaatttacctacctaacaaacctgcacatgtacctctgaactaaaaataaacgtcaaaaaataaaaaaaagaacaaaatatgtatcaagagagaagggaaaaactaagataaacatttggaccactgagaaaggttgatagaaggccccagtgtctgaggtcaggatcagtaatggtgtccttccctagcaatttctcatctgcacatgtgatgatgatgacgaccttgataacagctgatgttatgaaacacgtacaatgagcaactactgtgctcaattcttttgaaaatcagttggttttttttttttttttttgagatggagtcttactctgtcgcccaggctggagtgcagtggcatgatctcggctcactgcaagctcctcctcccgggttcacaccattctcctgcctcagcctcctgagtagctgggactacaggtgcccgccaccacgcccggctaatttttttgtatttttagtagagctggggtttccccgtgttagccaggatggtctcgatctcctgacctcgtgatctgcccgcctcggcctcccaaagtgctgggattacaagcatgagccaccgcacccgtccggaaatcagttcgtttaattccaacaacccagtgcaatagggcctataattattctcattttgcaggtgaaataatggagtcattcagtcacttgcctcagatcatgtggttggtaaatggtagagccgagatttgatcccagatcctcttgtacctgagtctgtgctctcagcccctgtggagcccccccactgagagctctgttgaaggacagatcccaagatccccccagagaggctggggctgagcccaggaacctgcctgtggcctggctggaggtgattcaagatggcagatgtgggggaagctttctgacccaccgctctcccttcttaccaggattctgcaggagaactgtgaaataccatgatggttttctctatcagtagggagcttgctgtcctctctgcatctgaccttctttctctaggagttcttagtttctgtagctttcactattctcctccttctcctcctccttctcctccttgtcctcctccttgtcatcctccttctcctcctcctcgtcatcctccttctcctcctcctcttcatcctcctcctccttctcctcctcttcctactcatcctcctcctcttcctccttctcctcatcctctttctcttcctcctcctcatcctcctcctgctcctgctcctccgccttctcctcatcctacttctcctcttcatcctcctcctgctcctgctcctccgccttctcctcatcctacttctcctcttcatcctccttctcctcttcctcctcttcatcctcctcctcctgctcctgcttctccgccttctcctcatcctccttctcctgctcctcctcctcctgctcctctgccttctcttcatcctccttctccttctcctttcttcttctttgagacaggatcttgatctgtcactcaggctggagagcagtggcgcgatcatggcttactgcaccctcaacctcccaggctaagccatcctcccacctcagcctctcaagtagctacagatgcatgctatgctcggctaatttttatatgttttgtagagatggggtttcgccatgttgcccaggctggtctcaaattcgaaggcttaagtgatcttcccacctcggcttcccaaagtgctgggattacaggcatacaccactgcgcttggcctcacttatttccttccttcctccttccttccttctttccttccttcctttcctttccttttctttccttccttcctttctttccttccctttctttctctctctctttctctctctgtccctccctccctcccttccttccttcttttcttccttccttcctccctctcttttctttctttctctatctccttccctccctccctctctccctccccccaacccttccttcctcccttctgagacaaggtctcactctgttgcctccgctgaagtatagtagcttgatcttggctcactgcagcctcaacctcccagtgtcaagtgattctcctgcctcagcctcctgagtagctgggactgcaggtataaacacacctggctaatttttttttttttttctgtagagatggggtttcaccatgttgcccaggctggtgttgaactcctgggctcaagcaatctgctcaccttggcctcccaaagtgctgggatttcaggcttgagctaccacgcccagcctcacttttttttctttttttttaaatggcagctttattgagctgtaatccacatatcataccgttcacttacttaaggtatacaattcagtgcttcttggtgtactcacagaattgtgaaatcatttccacaattcattttcaaatattgtcatcactccaacaagaaactctgtacatgcttagcactgcttttcgttttcccagccctaggccaccattcatgtacctgctgtctctgggtttgcctgttttgcacacttcacataagtggagccatgcactctatggtcttttcttcttcttcttctttatttttttattttttgagacggagttttgctctcgttgcccaggctggagtcaatggcgcgacctcagttcaccacaacctccgcctcccgggttcaagcgattctcctgcatcagcctgtcaagtagctgggattacaggcatgcgccaccacgccaggctaattttgtatttttagtagagacggggtttctccatgttggtcaggctggtctcgaactcccgacctcagctgatctgcctgcctcggcctccccaaatgctgggattacaagcgtgagctagcgcgcccagcccgtttctactttaatttttttttttttttttttagacagggtctcgctctattgcccaagctggagtgcagtggcatgttcatggctgactgcagcctgggcctcctgtactcaagtgatcctcccatttcagcctccccagtagctgggactacaggtgcttgcccctactactggctaaatttttatttttatttattttattattattattattattatttttgagacagagtctcactctgtcgcctaggctgcagtgcattgcaacctctgcctcccaggttcaagcgattctcccgcctcagcctcccgagtatgtgggactactggcatgcgccaccagacccggctaatttttgtatttttagtagagacagggtttcaccatgttggccaggctggtctcgaactccctacctcaggtgatctgcccgccttaactcccaaagtgctgcgattacaggcgtgagccaccgcgcccgatccgggtatatttttaaaatattttttgtagagatgaggttttgccatgttggccaggctggtctccaactcctcggctcaagcgatcaatccacctcttgaccggagatttcagaggtcagaggttagatacaagagtcaaaacccaagaaattagctctgggcagactgagtttcgggtcaggcagggtgagatgtgccaagccaaaagtctcgatgatggtggagatcaggactcagaggtcagagtgaggcctcctcccttctcttctcttcccccacaggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggtgagtgccccggggccttggaaccctggcccctggccacctctcatccttcctgcccactcccggggtctccactcccggcttccccgcagctgggcagcaggtcaagccaaccctgctgattgagaacccctcttaggaaagtcgggcatgacgattgccccagggtaattggctggcacctggagatctggcttcagggacggcaggattcaggagaaaaccccactgtccgccactcagcctctgctgctatttattgctaggcctgaagtttaacagatatttatgggagcgccccgacctgggtgccaacctcacctcctcccttctcttcctccacatagctcgttggtcccaggccccttgccctcctgcccccgactttttctttctttcctttttttttctttctttctttctctttctttctttctttctttctttctttctttctttctttctttctttctctctctttctctctttcttttctttctttctcttttcttttcctttcttttctttttctttttctcttttctttctctctctctccctctgtcctctgcccctctgcctccctccctccttccttccttccttccttccttccttctatgcttccttccatccctccaagctaagggtttaacccttgccctgcctgcattatggagtatcctgcattaggatactcctccttttgaggagagcaaacagaaaagtttgtggatacaacctggtgactggttttttgtttgtttgtttgtttttgttttctttcttttcttttttttttttgagccagagttccactgtgtcgcccagactggagtgcagtggtacgatcttggctcactgcaacctccacctcctgggttcaagcgattctcttgcctcagcctcgtgagtagctgggattacaggcatgcaccactacacctagctaaattttttttgtattttttttgtagagatggggctttgccatattgaccaggctggtcttgaactcttggcctcaagtgatccactggccttagcctctgaaagtgctgagattacagatgtgggtcaccgtgcctggccaacaacctggtgactgtttacaagggacctgacacatcctgaatggttgacagtgatgacagtgatgatccctactcaagcttttcccagtagacacgctgagaggcaggcttcctctaagctatgttagcagtgttacaaagtgattcaacataaataatttattcaagcagggagcaagatatgagagttttgcagaacactaatacttctgtttgtaatttgttgtattttgtataaagtgacttttgagatgaaagggctaaggccatatgctaccatgctctaggattgccagtgatattttggacagtttatcaagcctaccactttccaggtgaaaaatggaaagatctcagcttaaaagggagaaacgggcctggcgtggtggctcatgcctgtaatcccagcactttgggaggccgaggcgggtggatcacctgagatcaggagtttgagaccagcctgcccaacatggtgaaaccccatctctactaaaaatacaaaaaattagccgggcatggtggcaggcgcctgtaatcccagctactcgggaggctgaggcaggataattgcctgaacctgggaggcggaggttgcagtgagccaagatcatgccactgcactctagcctgggtgaaaagagcaaaactctgtcaaaaaaaaaaaaaaaaaaaaagggagaaatgtctaatcatctccggaattgaatggatgaatcatcctttgtttcgccagttccctctagatggacatttaggttctctctttctttctttttttgttttaaatagagacagggtctcactctgttgcccaggctggtctcaaactccagggctcaagcaatcctcccaccttggcctctcaaagtgctgggattacaggcgtgagctactatgctcagccttctgtttttttattattccaaaataataaaagtttacatcccagatgtaaagtttatgggtcaaagggtacatttatttttgacatggatagatttccttctaagtagcttcactcatttccacacctgccatcagggtaagagagtgcccccttgaggccatgctcgacaatgcctgatactttcactctaaaatgtagctctcaatttaactgaaaaaaaatttgccaatttaatgggtaaacatgacctctccttgttataatttatgcactcttgactaccagataggttggacatcttttcctaagcttaatggccatatgtccttgtgcccccttgttttttttttgtttttgtttttgtttttgtttttgagacggagtctcgctctgtagcccaggctggagtgcagtggcgcgatctcggctcactgcaacctccgcctcccgggttcacgccattctcctgcctcagcctactgagtagctgggactacaggtgcctgcctccacgcccggctaattttttgtattttgtagtagagacggggtttcaccgtgttagccaagatgttctcgatctcctgaccccgtgatccgcccgcctcggcctcccaaagtgctaggattacaggcgtgagccactgcgaccggccaccctcccgtttttttaattggggttcattgatttgtatatgtataaatgtatatactccttatactctggatcctaatcctcggtagttttgttggtcttaatatcttcatatcttctcgaagtctgtggcttgtcttttcactttcacttttgtatgtttcttttcttttcttttttttgagcctgcctcggcctcccaaagtgctgggattacaggcgtgagccaccgcgtctgtccatacactaggtttttaatccatccaaagtttaagtacatgaggatgcaaaataggggtagaatttttattttccccataggaattattgatgtttactggccgtttgaacgtcctctgtgaattgtacgtggtatcctttatctggcttccttccttttgcgtattagtttgtaaggactctatatgttttgccttttataggttggacagatattccggcagtttttccagcttgattcttacagggaccagctctttgctaaggccatcgttcattcagtcattacttaataggcgcagccattttaaaaatgggtgccagggccctgcatggaccagcttggtactgaataaatttgagtaaaccccgggtgactgggagggtcctggtcctgcccggtggaggctgcagcttcctctgaaggatggcattgggaagacttccattttccttggcgtcttgtgacacttgacccttgtggcatctccccacaccccaggctgaccccgggtttgtaccacctgggccgcactgtcctctgcatcgacttcatggttttcacggtgcggctgcttcacatcttcacggtcaacaaacagctggggcccaagatcgtcatcgtgagcaagatggtgaggcaggggcggggccaaagtgggcggggacatagggaaaggggtggggccagggagggagtggtccgtggagaaggggcgtgactttggggagcaatggggcgtgtttttgggatataggggtggggccagagtaggaaagggcggggccagactcagccacatctccccacagatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacggtaggggggatgacggcctgacagccttcctctgagtctctgtccccgctccctgggtctctgtcctcctggctctaagaaaatatctgtctctctgagtctctgtctccctctttctctggatctctgagtgataccctatattccccatcatcatctctctgggtctctgcctaccccaccccctctgtctttctgtctgtctttcttttttctttttttttttctttttttttgagatggatgttagaaatgtttattttgtggtgtcgtaaagaaatagtacttgaacataaatttaatttttttagtaaagccatttttattttttgtagaaagggtacactcgccagcagttttgtcatgagagtacacggaacaaaggagatagggtcatttataacctgacgcgtctattttactgctgtgtctggtttttattggctggaaccggactttacattttgtatttgtcttgattggctagtaacttagaagtttttaaaagaagcgaaggcagaggagaacaaaggaaggaggaagtaacttgtggaatgttgagaaaggtaaaaacacttttaaataaggaagaggaacaggctatgatctaatgcttgcttgaaccagtataagtatgtcagggcaaatatttaggctaaattgtgagagctaagaacataaagtacattgatttattttttatggctagtagatatttaagaatgttagcacaggtgtttgaataaattttgtttctaagagaagttactatttattgttaattagatggggaggaaagtctttgaagaggaacctgtactttactttttacatggagttttgctcttgttgcccaggctggagtgcaatggcacgatctcagctcactgcaacctccacctcccagatcgaagcgattctcctatctcagcctcccgagtagctgggactacaggcgcgtgccaccacgcctggctaacagttttgtgtttttagtagagatggggtttcatcacattggtcaggctagtctcaaactccccacctcaggtgatccggccatctcagcctcccaaaagtgctgggattacaggcgtgagccaccgcgcccggcagtcttcctgtctttcttaggtctctgtccccctcaccccatctctgaatgtctctcttcacagtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcaggtgaggcctgactgctctctgatctgaccccacccagcatgacccgtggccctctcatgactcttgaaccccgtctaatgaattctgtttttagtccctgaactctgatccaatctaatgctgccttctccccaaacccaaccagaccctgcttgtaatttggactttggactgatcctctccctgagcccaggttgaacttccttatttgtatttttttgagacagggtctcactctgtcgccaaggctagagtgtggtgatgtgatcgtagcttactgcagcctcgacctcctggactcaagcaatcctcctgccttcgccccataagtagctgggactacttaaaattagccaggccagcaggcctgcctaatttaaaaaaatttttggagagaggggtctcactatgttgtccatgctagtctcgagctcctggactcaagtgatcctccctcctcagcctcccaaagtgctgggataatctgtcacctaggctggagtgtagtggcaagttctcagctcactgcaacctccacttcccactcccccatacccagttaattttttgtatttgtagtagagatagggtttcaccatgttggccttgaactcttgacctcaagtgattggcccacctcagcctcccaaagtgttgggattacaggtgtgagccatcgcgcccagccaactttgttttttattgtggtaaaattatataaaattttccatttttacttctttttttttttttttttttttgacggagtctcgctgtgtcacccaggctagagtgcagtggcacgatctcacaatctcagctcactacaagctccgccacccgggttcacgccattctcctacctcagcctcctgagtagctgggactacaggtgcccgccaccacgcccagctaatttttttgtatttttagtagagacggagtttcaccgtgttaacccggatggtctcaatctcctgacctcgtgatccacccgccttggcctcccaaagtgctaggattacaggcgtgagccaccgcgccccgcctttttttgagatggagtctcgctctgtcgcccaggctggagtgcaatggtgcaatctcagcttactgcaacctccacctcccaggttcaagcgattctcctgcctcagcctcccaagtagctaggactacaggcgtgcgccaccacacctggctaattttttgtatttttagtagagatggggtttcaccgtgttagccaggatggtttcgatctcctgaccttgtgatccgcccgccttggcctcccagagtgctggaattactgacatgagccaccgcggccggagttgatttttaccatttttaagtgtacaagtcagtgacattaattacatttacagtactctccaaccatcaccactatctattttcaatacgttctatcacccagaacagaaagtgtgtccccatgaaacagcaactccccacttcccctccccacaggtcttagtaacctccagtgtattttctgtctctatggatttagtctagatgtttcatgtaagtggaattatgcgatatttgtcttttggtgtctggctgattttactgagcatgttttcaaggctcatccctgttgtagtgtgcatcagaacttcattcattccgttttatgaatgagtaatattctattgtacaaatagaccacatttgggcccagcgtggtggctcatgcctgtaatcccagcactttgggaggcctaggcgggtggatcacctgaggtcaggagttcgagaccagcctggccaacgtggcaggaccccctttttactaaaaatacaaaaattagctgggctcatgtctgtaattccagctacttgggaggctcaggcacgagagtcgcttgaacccaggaggcggaggctacagtgagccaagatcgtgccactgcactccagcctgggcaacagagcgagactccatctcaaaaaaagaagaccacatttgatttacccgctcatctgttgatgaacacttgggttctttctgccttttggctattgtgactaatgtttgttggaacattggcatgcaagtatctatttgaatccttgtttttatttcctttgggtgtgtatctcaaagtggaattcctcggtcatgtggtaattctatgtatagctttttgagaaaccaccaaactggtttccacagcagctgcaccattttccattctcaccagcagtgtatgagggttttaatttctccacatcctagccaacacttgttattttccttttgtaaaaattatagtcatccagctgggtgtagtggctcatgcctgtaatcccagcactttggggggctgaggtgggaggattgcttgagcacaagagttcgagaccagcctgggcaacatagcgaggctgctgtctctaccaaaacaccagaaatgagataccacttcacacctgcagcctcaacctcctgggctcaagtgatcctcccacctcagcctcccaagtagctgggactacagttacgtgccaccatacctggcttgtttttttaattttttttttacttttattttatttatttatttttagtagaaacggggtttcaccatgttatccaggatggtctcgatctcctgaccttgtgatccacccatctcggctggatcccaaagtgctgggattacaggcgtgagccaccgtgcccagcggctattttttttttttttaatgaaactcctttttaatcctatgttaggtctctctgtttgcttcctttcttgttggcatgatttttgctgagaaaatataaaatttcattggctttggttgtttttttttttttttttttttcagagatggggtcttactatattgcccaggctgatcttgaacccctgggctcaagcagtcctcttgccttggccttccaaagtgctgggattataggcacaagcccctgtgctggacctattgtattagtttcctagggccgccagagtaccaaaaactgtgtggctttaaatcacagaaattgtctcacaattctggatgctagaggtccaaaatcaaggcatccgtcaagctgttttcttctgagggatgtcggggagagtctgttccatgcccctcctgtcacgtctagtgctttgctggccatctttggcttctagttgcgtcattgaaacttctgctttcatcttccagatttccccttttaataaaacgttacttaaattggattagggaccatgctaataacttcattttaacttgatcacatgtgtaaactctatttccgaataaagccacatatttcataaataaaaaatttaaaaaggtctcattctgaggcactatgggttatgacttcaacttttttttttttttttttttttttttggagacagagtcttgctctgtcacccaggttggagtgcaatggcgtgatctcggctcactgcaacctccacctcctgggttcaagggattctcctgcctcagcctcccgagtagctgggattacaggtgcctgccactatacacagctaatttttgtatttttagtagggacggggtttcaccatgttgcccaggccgatctcaaactcctgacctcaggtgatgcacctgcctcggcctcccaaagtgctgggattacagccgtgagccactggacccggccggacttcaacatatctttagcgggatacaattcaatgcatgacactcatagatttatgagtttatttctggactttcaattctattccactggattgcgtctatccttatgccagaaccacacagttttttgggttttttttgagacggagtctcgctcttgtcacccaggcgggattgcagtggcacgatctctgctcactgcaacatccgcatcctggattcaaacgattctcctaactcagcctcctgagtagctgggattacaggcacctgccaccacgcccggctaatttttttgtatttttggtagagacagggtttcaccatgttggccaggctagtcttgaactcctgacctcaggtgatctgcctcggctttccaaggtgctgggattacaggcgtgagccaccatgtctagcccacacagtgttgattactgtaggtttgtagcaaattttgacattggaagtatgagtctcctttgttatttttcaagattgttttggctattctgggcctcctgcaattctatatgaacttaaagatcagagtttccatgtctgtcaaaaaggttgttggaattttctttttttttccttttttttttttcttttttttgagacagagtttcactcttgttgcccaggctggagtgcaatggcgcgatctcagctcaccacaacctctgcctcccgggctcaagcgattctcctgcctcagcctcctgagtagctgggcttataggcatgtgccaccacgcccggctaattttgtatttttagtagagacagggtttctccatgttggtcaggctggtctcgaactcccgacctcaggtgatccacccgccttggcctcccaaagttctgggattacaggtgtgagccaccgcgcccggccagttgttggaattttccgagggattgcgttgaatctgtagattgcttcgggtagtattgatatttcatctaggtgttctttttaatgcttttccagcagtatttggtagttttcaggctacaaattgttcacccttttggttaactttattcctaggtgcttaacctttagatactgttgtaagtggaattgctttcttaatttcctttttggattgttcattgcgggtgtgtagaaacacaactgatttttgtgtgatcttgtaccctgcaactttgctgaatctgcagccctagaagctttcttgtgattctctggcatttcctatatataggatcatgtcatctgtgaatagagatatttttacttcttcctttccaatttggatgccttttattttttttcttgtttaattgttctagccagaacttccagcacaatgtggaatagcagtggtaaaagtggacatccttgtcttgtccctgatcttaggcagaaagctttcactctttcaccattgggtatgacggtagctgtgggtttttcagaagtaccttttctcatgttgagaaagtttatttctattcctagtttacgatttttaaaaattatgatgcatggtggcttgtgcctgcaatcacaatactttagggagccaaagtgggaggatcacttgaggccaggagttcaagaccgacctgggcaacatagtgagaccttatctcaataaaaaaataaaaaatttgccaggcgtggtggtgcatgcctgtagtcccagctactcaagaggctgaggtgggaggaaggcttgagcccaggaggtcaaggctgtggcttcagtgagccatgatttcaccaccatcatgattgtgccaccaacagagtgaaaccttgtctcaaaaaaaaaaaaaaaaaaaaaaagccatgcatggtggctcaagcctgcaatcccagcactttgggaggccgaggtgggcagatcatgaggtcaggagatcgagaccatcctggctaacacggttgtaggggccagccctacaaggtctgtgggtttttctccccgtgtgcagagacaagagattgtagaaatgaagacacaagacaaagagatcaaagaaaagacagctgggcctgggggaccactaccaccaagacgtggagaccgacagtggcccctaatgcctggctgcgctgttatttattggatacaaagcaaaaggggcagggtaaagagtgtgagtcatctccaatgattgataaggtcacgtgagtcacatgtccactggacaggggcccttccctgttaggtagccaaggcggagagagagaggacagcttacatcattatttcttctatgctcttttaagaaagatcaaagactttaatactttaatactttcactaattttgctactgctatctagagggcagagccagctgtacagagtggaacatgaaagtgaaacaggagtgtgaccgctgaagcacagcatcacagggagacggttaggcccctggataactgcgggcgggcctgacatcagtcaggccctccacaagaggtggtggagcagagtcttctctaaactcccccggggaaagggagactccctttcccggtctgctaagtagtgggtgcttttccttggcactgacgctacctctagaccacggtccgcttggtaacgggaatcttcccagatgctggcgttaccgctagaccaaggagccctctggtggccctgtccaggaataacagaaggctcacactctgtcttctggtcacttctcatcatgccccttcagctcctatctctgtatggcttggtttttcctaggttatgattgtaaagcaaggattattataatattgaaataaagagtaattgctacaaactaatgattgatattcatatataatcatatctatgatctatatctagtataactcttgttattttatatgttttattacactggaacagcttgtgccctcggtctcttgccttggcacctgggtggcttgccgcccacacatggtgaaaccccatctttactaaaaatacaaaaagttagctgagcgtggtggtgggtgcctgtagtcccagctactcaggaggctgaggcaagagaatggcatgaacccaggaggcggagcttgcagtgagccgagattgtgccactgcactccagcctgtgggacagagcaagactccatcaaaaaaaaaaaaaaaaaatcgtgaagtgttgttgaattttgtcaaatgccttttctgtgttggttgagaagatcatatggcttcccccacaccttgttctattaatttggtgtttgcattaatttttgtatgtttaactacccttactttcctaggataaatcccatttcgttatggtataaaatccacttaatgtgctgctgaattagatttgcttgtattttttcaggatgtttacatgtatattcataagggctactgctctgtaattttcttgtgatatctttatctggctttggtattacggtaatgctggcctcatagaatgagttaggaaatgttctctccttttcaatcttttggacgaatttgagaaacatccttgttattataattcttctttaaatatttgatagaattcaccagcacagccatctggttttgggcttttctttattgaaacgtttttgattcaatctcttatgataattctactgagattttctgttttttcttgagtcagcttagctaatttgtgtgttcctaggaatttgtccatttcatttatctagtttgttgacatataattgttgatagtattctcatacaatcctttttatttcggtaaggtcagtagtaatgtctccattttcatttctgatgttagttatttgtgtccaggctaactttggagcccaactttaacctgacttcaacctccaccttataccgtgataccatcccaacttgacctctgacatctgacccttggcccttctaaactgactttttttttttttttttttttttgagatggagtcttactctgtctcccaggctggagtgcagtggcacgatctcagctcactgcaacctccacctcctgggttcaagcgattctcctgcctcagcctccccagtagctgggattacaggtgcccaccaccacgcctggctaatttttgtatttttagtagagatggggcttcaccatgttagccaggctggtctcgaactcctgacctgaggtgatccgcccactccggcctcccaaagtgctgggactacaggcgtgaccaaacgcccttggctctaacctgacttctaatcgcatcctgtaacctctgactttagtgatcttgacttctgtctgctgctatagactgaacaattattgcctggcatctaaccttcgtccttgcccctggctgggccctgacctcaagtgacctttgacctctggcctttgcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgtaagaacagagcttggcttaaaaaggagaaatataggggaccgggagcctggaaggcgaggggaagggggcatgccccaaatgactaacgggcgtggcttaggtagcgaggggcggggtttaagcaacaaggggcggagcttaagcactgaggggcagtgcttacgggtgaggggcggggcatgttctcgaatcaccaggggctgggtctgggatagcgtgcgtgttctgagggtgtcggaaggggcagctgggattgggaaggggcgtggcctgagccctttgactccgcccgcccctgcaggggtttacctttctaaggaagccgagcggaagctgctaacgtgggaatcggtgcataaggagaactttctgctggcacgcgctagggacaagcgggagagcgactccgagcgtctgaagcgcacgtcccagaagtgagagcggggcctggtcggggatggggcttctggcctggggcggatcctgacttcagctgaaggcagggtcctgggagggagggagagagggaggaggcccgggaagcaggcagagccctgggggtgggtgggctgcgggtgcccccggtaagaggccctcccttctcagggtggacttggcactgaaacagctgggacacatccgcgagtacgaacagcgcctgaaagtgctggagcgggaggtgaggccttggggcctggctgggggactgtggcaggggtcccatctcccgctctgacattcctcccattccgcaggtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaatcgtgtccggaggcttgattcctgggggagctggtgggtgtctagatccaggatgggagctggagctggggtgttgggtttggggttcttggtggatttgctgctgtaattcagatattttggagtccgtttcctcccttgagccccattgttcttgccggagacccagcacttctgtctgcactgttctgacggctctcgcttcagtaggacaagaccccatctgtaccccctcccacccagtttcaactttccagtggaaaaataactcagtgataataagcaaattatttcctggaatggaggtgggtgggtgttgtgtacatctgctttggcaatagggaaacggatgatgcaaatttgagtagataaatgcatacgtgtctttaaaaagtctaattagtgggaaattgcaggccaggcgcacacagggttgaggcaaatatgtgtgattatacatgcagcttaactaaataacccataacaagctaaactggtaatgacaaggttgaactgacagcaatcattagttaaatagcaagaaagccaccaacaaccaacacatccaaaaatcaaaaccaaacatccttcctccaaattggaggagatccaagtatctgtcaccgtgggtgcagagtagcgttgaaacattgccaagtgttgtgtggcaactgcaacttctctggaagatgctgagttagttctcaccaacccaagtagtaataatcactgtaatgtaacctacttccttccttccttccttccttccttccttccttccttccttcctccctccctcctttcctcccttcctccctccttccctccctccttcttccttcctttcttttcttctttttttttttttttttttttgagacagagtctctctctgtcacccaggctggagtgcagtggcacgatctcaggtcactgcaacctccgcttcctgggttcaagcagttctcctacctcagcctctggagtagctaggattacaggtgcccgccaccatgcccggctaatttttgtatttttggtagagacggggtttcaccatgttggccaggctggtcccaaactcctcatctcaggtgatctgcctgcctcggccttccaaagtgctggaattacaggtgtgagccaccacacccggccactttttcttcttttctttcaataaggtctcactctgtcacccaggcagaaatgcagtgactcaatcacagctcactgcaacctccacctcctgggctcaagcaattctcccactcagcctcctgagtagctggttctacaggctcacaccaccatgcccggctaattttttggatttttggtagagatggggtctcaccatattgccctggctggtctcaaactcctggggtcaagtgatccactcacctcggcctctcagagtgctgggattacaggcgtgagccaccgtacccggcctccagtactttctatatatgtgtgtccagcattgttttaagtgcttcacgtgcgctacatcagtgaaccctatgataaccatacaaggtaggttctattattgtctccattttgcagatgagaaaagtgagacacagaaaagtagctcaaataaagtcacacatagaaagtagctgagttgggggttgggcgtggtggctcatgcctgtaaaacagcactttgggaagccaagcaagtggatcacttgaggccaggagttcgagaccagcctggccaatatagcaaaaccccatcactactaaaaatacaaaaattagccgggtgtggtagcggacacctgtagtcccagctactcgggaggctgaggcaggagaatcacttgaacccaggaggcggagattgcagtgaaccgaaattgtgccactgcactccagcctgggtgacagagcaagactctgtttcaaaagaataataaaaaataaaaatggaaagtggctgcgttggaacagaaatctgggcaatccagagagcatctgtaatgcacgattttatatttggaaatgtcaactgccgtgaagtcacaggaactcactcagtccatgtgcaagtttgagcttttgtctctcagctgcaaatccacccttgcctccgctctgtgatgttggggcggagcctctgcaagccacgtttttgctttcccagctgggttgctataagccccggcctaaagagggcgctagacggagaccggccattggaggaggaagcagggatttgctccacctatttgcttcaggcatccgagcaagcgtcgccccagaacaacgctccctctgacagcagcagttgcttccaggttttttgtttgtttgtttgttttttgttgttgttgttgttgttaagacggagtcttgctctgtcgcccaggctggagtgcaatggcgcgatctcagctcactgcaacctctgcctcctgggttcaagcaattctcctgcctcagcctcctgagtagctgggattacaggcatccgccaccacgcccagctaatttttgtatttttagtggagacaggatttcaccatgttggtcagactggtctcgaactcctgacttcaggtgatccagccaccttggcctctcaaagtgctgggattacaggtgtgagccaccacgcccggccctcttccaggtttcaagttttatttttttggcacctccctaacctgtttctttttctatttctgtcgcccaggctggagtgcagtggtcgaggctcactgtagccttgacctcccaggctcaagccatactcccgcctcagccttcagaatagctgggaccacaggtgcacgccaccacacccagctaattttttgttttcaaattgtttcgtagagatgggggtctcgccatgttgcccaggtgggtctcaaactcatgggatcaagggatcctccaacctcggcctcccaaagtgctgtgattacaggcatgagccaccacgccggatgccataaccagcatcattgtcagccttctgtcacaccagcgccaccctggtagcccctggctctagtctgggtttcagttctgcagggctgctgcctcaacattttaggttctgatagctgtattctcagtcctggagtgacaggtgtagcctgcagttactatttttatacggtgcagttactatttctgcgctgtttcttctcattcctttcacggtttcctgagacctgtttaatttatctgagacccgtgtattaattcatctctgttgaagtatctatataacaggaaaactccaggtcgtgtgtgtagaaatctgacgtgagtcatcaagatggagaatttgcacgaattccacatgtaaagcgatttggagaccaaaaattccttaattgaagaggaggctggtactcttgaggaattaccctaaaataactgctgcaagcttatattttgcatcttccattcaaataggacttgtctccgtttatgcagtaactgtgtattggggaaaggaaaatactcagaccttttagggattagcagacactggcccggcctatttattcatttttgagatgcagtctcactctcttgcccaagttcgagtgcagtggtgtgatcacagctcactgtggcctggctcaagtgatcctcctgcctcggcctcctgagtagctgggatcacaggtgcacgccaccatgcccatcaaatttttttttaaaaaaatttaggccagtgcggtggctcatgcctgtaatcccagcactttgggaggccgaggcaggtggatcacctgaggtcaggagttcgagaccagactggccaacatggcgaaaccctgtctctactaaaaatgcaaaaattaaccgggcatggtggtgtgtgcctgtaatcccagctactaggggggctgaggaaggaggatcacttgaacctgggaggcggaggttgcagtgagccgagatcatgctgcactccagcctccgcaacagagcgagactccatctcaaaacaaaccaaaaaattggtctttaataattttttatttttgagacggaatctcgctctgtcacccaggctggagtgcagtggcgcgatttcagcttaatgcaacctccacctcccgagttcaagcgattctcctgcctcagcctcctgagtagctgggataacaggtgtgcgccaccacgtctgacaaatttttgtatttttagtagagacagggtttcaccatgttggccaggctaataaagttttaaaataaaaaaataaaagaaaaaagaaaaatacaccacatttgaggtattttccaacccatttagtgagtaacctacaaaaatgccaactcggagtgtcgtccaagtgcgtgagaaggctctgcatccggctgatgctgagcttaagctcagtcttgtgactcagcagctcacatgatactcagaaaagaatgtggcaaatcgagatgctgtatgacctccagaaagtgccaataggagcattttccggcataaactcgtagggttttggcacaaagccatgccatcttctgcacacaactcatctctgtgaagaaacaattccttgtctcggttagagatagatacctggccatggagcaccgagcaatgataaaacctgagctgaccatcaggaactcggtgtaatccgacccacaaatccagaagattgagcacaggcaatggcagtgcatcaggtggaaataagaaataaagtgttggccgggcgccatggctcactcctgtaatcccagcactttgggaggccgagacaggtggatcacctgaggtcaggagttcgagaccagcctggccaacatggagaaacccccatgtctactaaaaatacaaaattagacaggcatggtggcgcatgcctgtaatctcagctactccggaggctgaggcaggagaattgcttgaacctgggaggcagaggttgcggtgagctgagattgcaccattgcactccagcctgggcaacaagagcgaaactccatctcaaaaaaaaaaaaaaaaaaaaaagaactaaggtgttggcataagcaatgacacaagcaaattgcttgagtggacagcacagaccgttctgccatctatacccactgttttgtcttctctccatttatacccatggcttcatggacagctcctcatgactttttttcttttctttctttctttttttttgagatggagtcttgctctgttgctcaggctggagtgcagtggtgcgatcctggctcaccacctctgcctcccaggttcaagtgattctcctgcctcagcctcccgagtagctgggactacaggtgtgcaccatcacgcccagttaatttttgtacttttagtagagacggggtttccccatgttgaccaggctggtctcaaactccagacctcaggtgatctgtcctcctcggcttcccaaaatgctgggattacaggtgtgagccaccgcaccaggcagctcctcgtgattaattgaactggggaggacacaactttgggctggtttttagatggctcagcatgatatactaggattctcagagtcagccacattgcagccctcagaggaaccagcactagcctggcagtctcccttcccagaaatctgagccccagctcagcaatgcccacttctgagctgggcagcaaccctgagcaaccaatctcaagagccctgaggttcatctgatcctctctttggtaacatagcaggattggctcagcaagcctgcgctgacgccacagatacagaagaacaggctgataccagctgctgagccccagaggctgcccttttctagccagaacattttttctgaccaggaagctgtcatcgccacatagctgtttctcctcttccccgattctataaatacaaaaacacagtccttctttactgggatgctgctggccacggtgcaggcagaccgttcatgtttagccggagtcacgggctggagggatgctccctcctctacctgtgcgtcttccctcag

SEQ ID NO: 12433 - DNA, 12713 bp, Homo sapiens
tccattgggctgggtgctgacacttcgcctggctttggcaagcctctgcccttgggagtagatgcaggctccgtgcttatcttcagatgctggtgaagttctatgggtcatccaagtcagttgacctcctggacttagaacatcccatgacctagagataagttgactagatctatccagaatgaggatcaacccagattagaaaagactcacctgaatcttttaaacgttgaaatttagataactttttctccttccttcttccctcctcctgcaatacttggccttgttccttcccagttgcttccttaccctagccccagccaagggagttcctagactaccagtagaggctaaacatatgagccaaggggtcaaacaagcttgagttcgaagcctggctctgccacttattgctgtgtggccttggataaattaatctctcttttcacgcttccaggcttccagagatgatgtacccaaagtatgatcatcatttttattaaaatattgtgctcacatctgattgattaacagttcctggcacgaggtcagtgccaaagagccttggactgactgcttatggcctggcctccctatctggtttcttactatgtagcgatccaagtgaattcagatgattccctggactaccaccctccttcctgggacacatccatccctcaaacactgttcatcactggccatcaaagcagcagccacactgctccagcaactcaacagctatttattgagatgggtgtgtgagtacatgagtgagtgaatgaactgaaagaacgtaagagtgaattaactgctaagtgaattagtgaattagtgacttaatgagtcagcgagtgaagaagagtgtgcaggattgaatatatcatgttcttttccctcaacaaattgaatatgccgtggtataaaactttcaccctcaaatgtgtcttcttcattaacacaagcaggggttaagaatggcagaagaaaagttacagaccagcagccagaggagaaagatactgtgctagtttcctattgctgccttaacaaataactgtacatttaagggcttaaagaacacaaatttattgtgttataattctggaggttagaatccaaaatgggtttcagcaggccaagatcaaggtgtggggaggactgagcccctctggtggcactaggggacaatccttttgcttgccttttccagctgctagtagccacctgcatttcttggcttgtggcctctttcccttgtcttcaatatcagcagtgtagcatcttcaaatctctctccacctctgatcctctgcttctctcatcacatctcctctgactgtgacactcctgccttcctcttacaaaggccatgtgattctatcaggcccacctgataatccaggatcatctccctagctctaaatccttagagtaatcttatctacaaagtcccttttaccaagtaaggaacaaattcacaggtttcagggcttaggacgccagcatctttggagaggcattcttctgccacttgcagatgccttgttcagagggtaaatgcaaccagtgagtcccactccacagaggaaggggcaggagggggatgaaggaagtttcaaagcatttgacatacacatgcttatgccaggtatgtttgctgttgttgctgtggcctgagcactgagggttttggaaagcttaggtgattccatcatgctgcaaaatctgagagatactttgacagagatatgctaagagcatatgctgctgtaattgagggtaaaatctggccctgtgattcctggagatgatggatcaagagcagggtgtctttaccctggctgcacattgctatcaactggaaagatttttctttaaaaaaatgttattttgaaataagagtgcaaagatcatacagaaatgtcctgtatacccttcaccccgattccctaatgttggcatcttacataaccctgggtcatgcataaaaactaagaaatcagcaatggtacagtactattaactaaatgaaacattttattcagatttccccagatttccaccagtggcccactttttgtctgtcacaggattcagtctagcatctctcattgcatttgtcctgtcttcttggtttcttccaatctgcatcagtttcttagccttgccctggttttttaaaatcttgacattattgaagggtactgatcaggtatttggtagaatgttctttatttcagtttgtctaatgttttttcatagaccttggctatggatttttgggaagaatatcatggcggtgagatgctgttattatggcaacacagaaaggggttctgtgatctcaacatgacctgttattgatgatgcttactttgatcacttggttaaagtggtgtctgccagatttccccgctgtaaagttactatttgtccctttccatgttctattcattagtagtgggtggctaagtccagcccacactggagagggggagtgccatctgtttttattcctatcatttcaatttgtttaatcctcatggctttattatcacctcactactttttagagatatggttgtaatgagctagacttgcccaaagttactcagctagtaaatggcaaagctagaatttgaacttatatgtgtctggcttaaaaggccatgttctttccacttcatgttactgccaccaagtaaagaggatctcacagtctccgaggcggaagctccctctcagcttgtctggacagtgtttttcaaatccattcttggagtgtgacccatcagtgggtcatgaggtcagtctgtgggtggcattttaaataacaacataaagtaaaggtgactacaacagagtagaaaataagagtatgtcacacaagtagaaattttttatctctatatcttctctgtgctttgctaccttcatctgaattcacttatccttgtatggagataaaaatagccctcccataggcttgttatgaggactgaatggaatgaggtacataaagtgcttagaagagagactggctcatattaagcattatataaatattaagtatgtatgtatgtaaacgagtcatgatgtaaaatgtatttcttattgcagactgcaatcaagatgtttgaaaatactgaactcacatctgtagacgaggagttggcagatttacgacccccagcttgcagcctattttttaaaaataaggttttattggaacatagccacactcattggtttaggtattttctatggttactttcgaggtatagtggcagagctgggtacctgcaacagaaaccctgtggttcaccaagcctatcatatttactacctggccctctagaccaatgctcctgcctggaggtcatctcataatctagggaatattggacacctcttcccgggcatgtggtctggtcatgctactgtccttgcaggcatgcttgctctaggctgtgtgactgccaggcacttggatctccagaagctcattactcttctctattaaactgatgcctacatggtgaaaggctaaaaccatggtactttggtcagggtccccgcaggaaacagatggccactcaaattaaaatgattggtgagggcagagtgtgggaaagtagcagagacctcagaggctcataaaagtagagttttaccaccctaggcaggaggagataaagaaagggggcaatgcctgtactggaaggagagagtcatttagagaggacaccttatgaggaccagtgaccttcagtccagggacacagaaccagctccaagtgaccctggggtggggatccaggagaataaatgccttgacttaactttcctccatctctgatctcctgtggagggccccattgaccaaagtgagatggaaatcagagggtatgggatcctctgatgtggctcatacagaccagcttcccaggccagagaaggttgaagagaggttggagaaggctggaaaggggatctggaagggcaactcttagatacccagcacacagcattgatttaggaagccagatttatttacctttcctaagctcccctaaacaaggacttcccctgcttcatcctccaagttggaactttgacaacaccaaaaggttgacatagcttttcccttttactgccttttcttcttaaatctgctagcttcccgatagctattgtgggttaatcttcctggatcttatcatgagagggatggaaggttaagaggcacagataagctactctgtgtgtgtgtgtgtgtgtgtgtgtgtgtgtgtgtgtgtgtgtgtgtgtgtctgagcctgagcagagtctgatgaatatgtggactttcattaaagttcttcctcatgtcccatcttttgatctcagaaaggagctgtgtcccattcatctaggcagccctgctcatgtccaaaaaatgtgtgagtcaacctctggccccttgggagaaagagccagggggaaaaaggctacctaggctgagaagtgtccccagagtaatccgttcctttgcgagaccccctactagcccagacttccttgatggcacctgatatcttataggcccccaaatcctgccacacaactacagcttgtcccctggaggggcttccctggccagtccagaatgctcaatttatgagagatcattggctcacagggaggaaggggatggcttaggtaggccagccaccttgcagcagagctgggcaagaattcaggattggagactcttattagtttccatctttcttttacagaagatgaacactgaagtcttggaaccctgggaatgaacctggaaaaattcaaaatatggtctagtcttaggcaagtttccttgtccggctcagctgctgagaccacatatctggaccctcagtgccctggcaacagctctgtgcaggcaggatgaagcacaggcttaggtcaagcaatcagccgtcaaaatccacactctcacctgtgagtggctgttcaaccttgaacatgttactttttatgttaatgaaactcagttttctagtcctataaatttggggctatcatcaaccattaagtgatattaaacccagtgccacacaggcaagtacctagcagtgtccaaaggcccccagaatgacactttttcatcttttctcttccctccaattgaaagactagtggaatatctgcaattactttgaccaaaagccagaagccggccagtttgagtgtagctgttacagctttgtgttctaaacctaagaaatggggacccctcacatgagagtggggaggcttctggatgtgctacaaattccatttcattttcatgaactccagtgttaattaataaaatctcaaggttctcccccctctttcgcctcacatttcttcagagaaatgaagagttccaactcatagcccaagtgctcaggttttaaattagacaactttgtcctgacaggaaccaagtcacagctgtcatacctgattacttttagagttactactaaaccctttgtatggcatgagctgccactgttcaaggcaaacagaaacacttcacattttatcatgacagccctggatctatccacctccccatgttcattatgctcagcctgtctttggaagggatgatgaggcatcctgaaaatcgtatagtgaggaaggcagaccccatggcctgtcactacagcctagggattttaagcccctaaagtgcagcaaaacccactgcctccaggaagccaaggagaattatttctgggggacatagctgcctcatagcctactatgaatgaaccatcatctttcatgagaggcaaacattgaccctcaagtaaccaaccaatacgagcacctgtacacaaatgcccacaggtgttggctgggattggctggcttgtggatgatgtcacagtttccctcctctgactcaacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaaggtgaacttacgaacatgggaaaagaaatccagctaaagcctaaggcaaatgtctcttcttacgttcactttttgctgaattacagaaacaaattcaaggagcagcagccaaatacctaygttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggmacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagyaccgaatgtcagctagaaaccggtgcagagggaaaagagtcaggcagagctgatggatccagtttgaaaaaacaaaatgccattcaaccgtatttcctgttcctggtctcatgtgtggcattagagtagctgtgactgatgctttgtggaggagggagtggcttggtagaggagagactgatcctgaggaggggaacggagaggacgggaagggaaagaaggggaagggaggagaggagggaggggaagggaagagaggggaagggaagggaaaggaggggaatggaggggagggaaagggagggaagggctggctttgagagaagtgtcagcagtaaacaaaaggtgtgacttgggccactgggtgggagcctccaggtgtaaagtagcagcagtcatggaggtagaagcaccgtggttctgagtggtgatccaggtgagaggaccctactcagtgtcaggttcaggaacatgacgtctgactctgctaagcagtggcaggactgggaagactgccagggctagaaggcctagagttcaagctcacacttgaggccccaggagaaacatatggcatctgagttgagacaggcctgagggaacccaggatttccagcaacacttagatacgctcagtggggccagggtgaactcccaggggtgttccctaatcaggaggaggcaaggggcagattttaccaaaaaaaaaaaaaaaaagcagggggctggggaaccagatcaatcgtttttcagtggatagatgtataatatgtggcctccactcctcttcctcttgttcatagcactctgactccctttcgtgaccaaggctggataagagggcaggatcgccttggccacagtcattggctcagtggtgggcatgtgacccaagttggtcctatcagggtggacctctggacctgtgtaaggagtcctgggggacaccgcagtccagggaatgtggacagccatttgccatctcatagggcccaagaaggaggccgagatgctagaatccctgtggcatcagaacagtctcctaaacttttcattgaagatgaacaacacatttcattttttccctgagatggtttgacttaggttttttcctacttgactataatttgacacaaatgggattgtgctgtaagtgtctgtctggtaactagatttttcaggcaagaatatactgtaggcaacattccataccaatcaataaagattgaaatggaatattttgaaatggttcttctgacttcttgacatcaaaaatactgggccaaaatgcaaagctgcttttttgtcaccagtttatacatgcaacagatctccctaactccacctctaaggacccctattccatgatagagggacctacactttctactctactgcgctgaacagtaaaaatacatatttttgaacagtcttttagaactgcatgagcctttaggggatgagaggtaatacagtgatttagaaattcagggtctggaatcaaacaggtcatttgtggaggattttcatgtgccaggccatttgctgggtacagggaggcacattacgcactactgctaagttcccgccctataaaaaatttccttctgacaggagagatggacttgggcataaattgcagcactgcaaagcaagatgatgaaagtgaatgcagaaagtaatgggggagggactggggaccacccagcaagcctgtgctgcagtcttcatgaaggaagcagccttattccacttgacaactttgtaggcatgctggcaaaattcccgttccgcattccccacagctgctattccaacttggctctgcttctcttccctctcaggagacgcccgcattttctgcttcattgagaaaatagagatcctcagatataagtgctctcagtttccttcattcttgaaatgtaatccataccaatcctttcctcctggtctcacccctcacggagagctatccccctcctgctcttcctgccccctccctgcctccctggggcccttgctccttactataagggtgctggccctccagcctgtacactcatacaagttcacttgatgccatgatatggtggtccccaccttaatgttggcagaacttagggcaagttctcattcctctgagcctcatgttcttatctgtgcaaggaggataatgcctgccttacaggttgttttagcaattaactgaggtaatacatgtaaaagtatttggcacagtcctaaatctaataggtaatatagcggatatactctagggtggctgttccataatcctttcctcctttcttggtgttcacacccttgtataatcccctcctattaagtgtgggctggacaggtgactttcttctaacccatagaatgtggcaaaggagatgggatgtcacttctgtgattatgtgatgataaataatactatatattgctagccactttgctctagggattctccttgctgcttgatgaagtaagtggtcaagtttgagaagcccatgtggcaaggaatgacaaggaactgtgggaaatgtctagaagctgagggtggcctcagaccattagccagtgagaaacagaagttctcagtccaccaaccacaaggaacttaatactgcagcagccacacaagtgggtaggtgaatccttccccagtcaagccagcagatgagaacttggccctggctgaccaaggcctgaagcaatgcacacagctaagctgttactggactcctgaccccacagaaactgtataaatgtaagtttaaaactataaatgtttaaaccatatgagtgtattttgttttaagccactaagtctgtggtaatttgttacacagcaatagagaatacattactcaataaatgccctcttccttataattctagaagagactgtctttaatcttgtttctatctccagcctctaccttccccatttaatttcctttcctttgttaccaatctcttgttaccaacatcttgaaggtggagggccacctcccaccgtccagtgctaattagatcctgatttgtattacccagtagtagttccagttgggttgtcttgtttccagcctgaaatgtgggctcttggtgggcagcagctgtgtgatgtaccacactcctctctgggaagagggcccccacacagctaggccccagctctcatgccacccctttctggtttcctgtgtgattaattatgtgaatgtgggtggccaagtcagagttttgacaagagtttgcagttcccctgctgaaaactaactccattaacagtcctttatgaaaaagacaataggagggtctgaatctgctggcttctaatgactgtaatgtaatgacaatggagagagagggagggaaggaggaggagaagttgggggagcctggacctaagataatgggtgagagaaaaagtagatggacaatctggtgtggtgccagcattccaggcccactcagctggcctcaggtgctcctgtccttgagaagaggaaggcaggcccatcaccatcttgatgactgaatcactcaactctgatccttctctcctcaaccgtttttctgtgttcatgtagtcattaatttacttactcattcattcaacagatatttacataaatcttatgcctgcaatataacagcaactattctggtgctgggaatacaacaaggttcctcatctctcacgttccggtgaggagagacagacaattaaaaaaacaacaaataggccaggcgcggtggctcatacctgtaatcccagcactttgggaggccgaggtgggtgtttcatgaggtcaggaatttgagaccagcctgatcaacatggtgaaaccccatgtctactaaaaatacaaaaattagccaggtgtggtggcacgtgcctgtaatctcagctactcaggaggctgaggcaggagaattgcttgaacccaggaggtggaggttgcagcgagcccagattgcaccattgcactccagcctgggtgacagagtgagactccatcttaacaaacaaacaaacaaacaacacaaatacatatatcgaatcagtttttgatagggtaaagtactcactagaaaataaacgtgggtaatgagataaatgatgatagataggatagagggcacttgaaatggatggtcagaagttttctgcggagctggcatttgggtttggatttaaagggcaagaaggagccagacaagccaaggtgtaagagaagagtcctccaagcagcagggaagcaagtgcaaaggtccttgcagaagcgagcttggcatattagagggacagagggaggccggagcaactggaggtgtgaacaaatgggcgagatgtgtttggaagggtgaaggccttggcaaggggtttatgtggaaatctaagtgcaactgagagccacagagagatttcagtagtggagaaccacgtgcttccatctctgactttgtgttactcatcattctagggtcttcagagactatcaagtgccaacaaggggattacccctctgcccctctaaaggattgcaagaaagaagacaccaaatccatggcattttttcccttaggaaagaagggagataatgagaagcctccacttggtattccttggagcagctggaagctaaaaaccaaatgtgggaactgtgaatcctatctctgggatatgttttctcaggaaatggaggaaatgggtgggcacgggtggcaaaatattccaggggaatacttcttcctgggccttgtggggaacaactcccaaaaggccagtggttctcagctttaagcctgtgttagaatcacctgcagggcttattaaaacacagattgccgggccttacccccagagtttgatttagtatttctgggagttggatctataatttgcatttctgaaagttcccaggtgatactgatgctcctggtcccaggaccacagacaaattctccttcttgtagcccctcattcactctgcgtaggaggcatggctcatctggctggtgggtttgggaggaggagcagaccatgctcagttagccctccccactctccctttctctctctccccatcgccctagctgcagagcatattcagacagctctccaatcagttcatcagtaataaaggtgacatgctgatcctcatctgtttttctcttgcatctgccaattgattctgcacttgagaggggaataagtatatttatttattgggtttccctcaaattccaacagagaagttggtatcagttgcaaaacaatcaactggcatccgggccacacagcagcataggaatcttggttttagcttccactaaaatatcaattatttgagggcaaaaaatgtccaattcctgggcctttaagataggaagtcaggtctgtggatggggtgaggtcaccaggatgaggtcacaaaggcattgatgcccctttgtcctatcatgtgaccacttgtcacacttccatcaaacagtacctgccccttaggtgtgctagggaataaatgaaatgcctgggacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggcccaaaggggatacgacccttcaggttggccctgacctctgggttggattaccagtgacacaatgaacatttcattatgaggccatcccttgaggtagttgcattgcaacagctctccctacccagtgctgcatttccagtgctttctctgttcaggctgctgggtgacatttctatgtctccccttcaacggtgaaatatttcagtggttgtccatcacctatgggagtctgacatggcataatcaggccactggggcattgctagttgtgctgtccctgatattcaccgtggtaggcagtttctgaaatggctcccagtgatctccaactcctgaaattcacactctgtgtaatcccctccctttgagtgtgggctagacctggtggccaaa

SEQ ID NO: 12434 - DNA, 20966 bp, Homo sapiens
tttatccattttttcattcattccttccttggacaaataatatttattgagagcccactttgtggcaagcactgtgctaggtgcagggaatcagcagtgggtccagtccaagctcacgccctcacggatctacattctagaagccggctacctaagcaaacctatgccaacaaaacttctctctccctgctcaggggctgggatcggagcaagggatgggaggaggatgtgtggcttggggaaggtgaggacgctatggactaagttaaggcctatctaccctcgacctttgcccctccaggcagctgggggagagcggaggcagggtcgctcagggttctacccacacgctgctgttggtcacccgggccccgaaccagcccttccagtagacggagtcctgccccccgtgctcgaagcggacgaagcggacgcccggcccgtagtcggtgaaggtgtgggagatctgggggtggaggtaacaagagtcagcctcggaggtcctgaggcctctcctgccgccccaccccggtacaccgaccgacctgcagctcccccactcggtttctccgcggtattcagaactctctccaccacccggtgactatctcagcccagcccagcccagcccagcccagcccagcccaggagcgctgtgggcggggtctcctcgagccacgcccctcatgtccgtgccccacccctccgccctgggtcccccaggctcacctccatccagcccccgccgtcactgtcttggggcactgccacctgcccgctgctgaactcagccagcacgttctcgtgctcggacagtagcttaacggtgagctcgtagaggcaaccagcgtcgctgcggcccgagtacctgctcagagggagggagcgaggtggggggcgggaggtggggtgggggcatggcctcagccctgctgaacacgtcctggggatggggatttccacaaaagtcctcctgtgcgcccaacatccctgtcagccagcactgccagtgttcccagtttacagataagggaaacgaggccagcaagagaaagtgacagcccacgagcgaaacacgaggactacattccaagttggccagaccccagcttggggccaaagccagtccacagagtggcctttggtttggaccgcagactgattttgaaatatatacattacatatatacaaacatatatatgtgcatatatttgccaacatttaaaactcaggaggggaggtgggtttccaggttctcctgcaaacacggaagttgtcaacctttgcagacccgtggcccacgtggcctcaacccctgcagtggggaggcagcacccccaggcggggggttccccagctggctctcccctctgccttaccccgctcctcccagccccatgccaccccaggaccctctcaccagtccttcaccacgatggccggctgagtcgtgtccagcagctcctcccagtagccctcagcctgcaggtcaatgacctgtgctttgcgacaccacctgggagaactggagttaggacagagcgaacgctccccccttcccacctcctccacccccttctccttactcaaaggaggaggcgaagtacttcttgacgctctcatcgtgggtgaactccaccccactgtctccaggcagctcctccaccctccagccgtccccaccatgctccacgtcacaccagccttccaagtcctctgtagggacacgacagccccaccctggtcactcagtccctgctaaggctggctcttgccactatgtggtggggggcagggcaaaggtcgcacttggtgtcttggtgggcagatgatgaatgagagggtggaccagtgggcagtttctaaatctgcctcccgggaggtatgtcccccatcccgccctgccccagctggctgagggtgggaggacccgggagaccccagggcacaggtggccagagagctacagtaatagacagccttggggctacccagtgctggcactgagccaggcgcttaatcccatttctccctcaaagccaggcggcgccgtttcggcccatttcgcagcaggggaagctgagctcgcccagcgagggcctctcaccttccccacacgggttacgcagaaggttgcggcgccgcttgctcaggaagtagaactgctgccagtggtcgcgctcctcctccacgccgccctcgggcaccagcccctcctgctggcacttgagcagccacagcggggcgccgtccaccagctccttccagcgcaggcacaccaggcggcaggcctgcaccagctcggcggccggcagtgcggccagcacgcgcagcagcagcggctcgggcagctcgtccaggtacgcggcggcggccgccgcctcctcctcctgctggtcctccggccgctcctcctcagcactcgcctcctctggctgctcctccgggcttgcctcctcgggctggcccacgctctctgcaggcagggatgggtgggaggctgtgattcctccaccctgtactcctccaggccccaggactgcaatgtgcccgtaacctcccccacccaccgtgggacaatccacagctggggccggagattctgtgactccatactggtgcccaaggaggagggccacaaggccacagaccaaccccggatcagcccctaagtccaaagaggtgcctcagaggcctatttcctctgctggaccagtaaaccccacgcctgggcagatggcaacaaggatcatattattattattaatggcatccatctatagcactgcacagtgcttcacacaggaacttctttcttcctcccaaccaccctctgagattcctgctcccctcacctcctcaggaagccttccgggacttccccctatgacaccctctcacagcccttcctagcttttgtcctggggtgtgatcctgtgataaacgcctgtctctggaccatacggagccttataagggccagaacatggtctggaaaacacacagcttcatgccctgtgcctggcatctggcactttcctggtctgttgtcaggaactcatgttttgggggcactcatcaagtgttaggcaccgtccaaagcatttcaacttcatttactctttaaatcctcataccacttctttgaggttgctcttattgctgttcttatttcattgatgaggaaactgaggcacagagaggtgaaacggcccaggatcacacggctaatcagtggttggagcctggatttgaacccagacagcctggctccagagccatcttaaaccaccacagcctccacagaataattcactgaattagtaggcagtgttaggattttgactttttttttttttttgatatggagtctcgcttgctctgtcactgctcaatctcagctcactgcaacctctgcctcccgggtagctggaagctgagaagcgattcttctgcctcagcctcccaagtactgggatgacaggcatgtgccaccacgcctggctaatttttgtatttttagtagagactggtttcaccatgttggcatggctggtctcaaactcctgacctcaggtgatccacccgcctcagcctcccaaagtgctgggattaaaggcgtcagccaccacgcccggctgacttttctttttaaagatagggtctcactctgttgctcaggctgacctccaactcctggactcaagcaatcttcctgcctcggcctcctaaagttctgggattacagtcatgctccactacacccaggccaggattttgactttgcaggtgcaaatgctcaggctcagggatgaagtgacttgttgaaggacacactgccagtatttagggaaggggacatgggacctggggccttcaggggctggagaacagagcctggagacccagctgtccccagctattgtgtgacttggggatgaggagggacttattaaaagaaactctatcaagcaaggagatgacataggggcttggggaaggaaactttctccacctccttttcccatccgtggccctcagttttctcatctataaaatgggggtaatcattgtgccaggccatacaaacaggacagacgtccaaatcccctgaggaaggggacaagggcattctgaattgtaaggaggcaggcagatgtcaccgcggcagccggactgtctcttgcatcccagtcggcttcagctgggccatcacagccttgagtaagtggacaccgagtgcccaagatgcctggacgagggagagccagtgaggaggagacggggccactctgggtgatcaggaagactacagctctcagacctacggatggggagttcccatgggctaggccctggagagccaaggcggtggtgggaacaggccaggcactggggaaggggacaggtggcaggacccagacccaagtctccaggcccaccagcccctaacctcctcatatgcagcctctcctccctgcccaacccacagtcaggcccttgagagctttcacagagcccagagcacacagtgagtcctcagtcaatcttactgagtgaacctcattgaacacagcacttctccttccttattaacatttttttggccacatctttatgatgtggggatttacaccggcccctttggcaaagaggaaactgaggccaaaaaaggcttaacagcttctcccagaccacatcgcagaacggcaggaagacagaggaaaatgccaggccctgaagtcacatcacctgcccaggcagatgcccacagctctctggggagctaggcccagtgtcctcacctctccagccctccctccggccctggccccatcggacacctgatgctccccgaaaggtgcacctcacccagtcccctcttctggccccggggcctggcactcgaggccccagatccaattacagctccccccaccctctctcttacacacacaactccccacattgttgccggcggaaagttatctggcccctggaagctgcctgcctgcgaggctgactcactcacctggagtgggccccagagtccagggtatagctgatccctgggaaaaagcaggagccagttctggagccctacagagggtgtggccagaaggccgtggattgggagcaagggctgcaagagctggaattttcagggctggaggcgggggaatggggggtgagggggggcctgagctttcatcagtctgtttgccaccgcctaacccaagcaatgcccatccccagctggacctgatgaggaaagagtgagggctgtctgcaggcaggtcttgtttccatcctgactcagcaggcaacccctgcaggccccgcagggagttggagggatgggggtgaggggtcttgggtgccagagaggatgactgggcagcctgggaaggccctgagcaccagccaaagctgcccccaacgctccctcaccgctagtcgggtccccactgggcatctcaccaccccggggaggggcagcccctccagacaagggagctcaggaggaaggcaggaataggtgaggccaggcctgggaccccaaggaacccacggggattcagacggcccaaggcccagagctggaagagctgatgaaagaaaaggctcgcagcctccctcccagacgcatcccaggcccccgccagacagaccctcaggaagctgggaggcgggaatgtgggggtcctctggtgctacttcctggctaaatgggacccaggagttctctctccttgccagtcgcctctcaaggcctcccgccagaccaagatagcagagagacgtgctctttggagaccgcctctagggcttcgctggcgtgaaagtttgccgcgccaggtctccgggtcccctcgctctctgacgcccctctgtgcagcgctcgcccgccgaccccatctcccctccccgccgcagcgagcggtccaggcggcggctacctgggtcaccgtctccgtccatcgctgcggagggcggtcgcgagaggaggagccggagcgctgcgggctgcgcgagtcccggggcggcgagtcccggcgctgtccgcgtctgtgtcggtcccggcgaccgcgcctcttaaaggcccccgacccgacccgccccgccccgcctctggccccgcgcccggccgccccgcagtcccagcagtctgctcgaggcccggggctgcgggttcctcagcggaccgaggaggctgggaaaggtcaggagtcgttttttttccaactggggaggggtccgatttggggcatctcgcagctcgctcctgggggactgctgggaggaggcggctaggggaggcacggagaggctgggtcaggccgagggtgaggggcgggtggcccaggcggagtcggagtataggaggtgccttccgccccaccccccacaccaggtaattttcctacgacgcggtgggggtgcgtccctggcccagcgctgcgcggggcggggcgcggggcgcgggtggcggtgccctggcgggccggggcggggcctcgctttccaggcaagcgcaggtccaggcggtgcagcttgggcggcccaacggatcgtgccgcggcggccgagcgcaggtgaccggcaggagggggcgcggggggcgctggggagggggcgcggctgggcgggggctgccgggaaggctcctgggttccgggtcgcgccgcagttgccgagggaggcctggcaccgaccaggcccaggccgccgagcttgcccgggctgcgctgcgcggctgcgaacgggggctggggtcgccatcgatgtacaggggtccgagcccagactttggggggcattttaaggcacagcgtgggaaggggaggctgcaggcgcgctggcggacttggggctggcggagcccagccgcggggctgggggtgggagtgggggtggggagataggaagggcccttccctgtcgcccaccctcttgccactcccacctaggcaggagatcatgtcctctgagatcttgagaaggtggctggagccctttggacctccgcgggaggcagtgataattagcctcctcctcccatcatgttctgaggatgggagagaggatggtgacggcaccggaggcctggggtgctctgcccggctgcgcattatatccccattaaagactggcctactgaaaaaggctggccctggaatcaaagaagatccgggcttcttccccctctgcccttatttttgaccttgggcagtgccttccacctctattgtgagaggccagagaaaaaaatcagagctcaccttttattaaagtacctgatgtgtcccaagctccttggaccgccccagtgacccctggaggtaaggcatccatttacagagaaggaaacaggctgggagaggcaccatgctctcccgagataaatggcagagcagggatgaggcctgcagcatagcttttcaacagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaaggtggggtacaggccgggtctggcatgcctccagtacacagtcatgacaccaggaacatgtattgagcacttagtatgagccgggtactttggatggtttaacacctttacttctctcacagtaacccaaagaggtagctactgttagtgcacacatttttcagatgggcaaactgaggccaagagtggtgtttcttattcttactatactctttttttttttttttttttttgagacggagtttcactctgtcacccaggctggagtacagtgacacaatcttggctcactgtaacctccacctcccaagttcagcctcccaagtagctgggattacaggcatgtgccaccacacctggctaatttttttttttttttagatggagtctcgctctgttgcccaagctggagtgcaatggtgcgatctcggctcactgcaacctccacctcctgggttcaagcgattctcctgcctcagcctcccgagtagctgggattaccggtgcccgccaccacgcccagctaattttttgtatttttaatagagacacagtttcaccatgttggccaggctggtctcaaactcctggcctcaggtgatctgcccgccttggcctcccaaagtgctgggattacacgcatgagccaccgcgcccggcctcttattctgctcttaagattatttccccagtgacctttcctaggcgagggaatgttggccaactgagactaattctgctcaagacacaaggccaggaagtcagagccatattttgttggcctagtttctaggctccagggttgggcctactgacatggtcccagaaggccaaaggggttttgcttgtggaagaatgggagatccagtcgtcttctcagtatgttacaacaacaggtaaagcaaggcttccactgatccttgcttgctgtgttgttgggttgacactgggatggcatgggaacctcattttccacaacatgaccaaattctggagcaaaatgataataaaaccactcctccaagctgtgcatgagccaaatctggctgaggcattaataattgttctaataattgtttttacatttttaaagtgttataaaaagaagaagaagaaacaacaaaaaactatacaatagagatagtttatggcccacaattcctacaatattttcgcactttgccaaaaaagcttcccagcccctattcttaactccagtttacagaggagacaactgaggctcagagaggaaaagcaactggcctgaggtcacacagctgagtactggtagagctgggactagacccaggtctgtctggcccacatcagagctttgtccatcacagaaggcagctgggctgggtgcagtggctcacacctgtaatcccagcactttgggaggccaaggtgggtggatcatctgaggtcaggagatcgagaccagcttggccaacatggcgaaacaccatctctacaaaaaaatacaaacattaaccaggtgtggtggcatgcacctgtaatcccagctactcgggaggctgaagcaggagaatcactggaacccaggaggcagaggttacagtgagctgagatcgagccattgcactccagcctgggtgacgagcgaaaccctatctcaaaaaacaaaaacaaaaaaaagatttgtgtttttaaggggttataggaaaagaaacaacaacaaaaaaactatacaatagagatagtatgtgggccacaagtcctaaaacattttggcactttgccaaaaatgcttctcagcccctattcttactccagtttacagaggagacgaccaagggtcagagaggaaaagcaactggtccaaggtcagacaaccgagtactggtagagctgggactagacccaggtctgtctggcccacatcagagcgttctccatcacagaagaggtctggtcatttccatcaccatgtgtctcagggcccccagggaagtcacctccctgtgcctgcaacacaggaagcacctaatacgcggtgggcactgtgatctgcrgcgtcccacagcacagggcttgagggcagccgccaagatgcaggcagaggagtggggaggaaggggcatttgggagaaggcggccactgaggggcttcccttcagtgtgaactctgcttttccatcagaggggttcgagttctggagcctggatgtgaatggaggcgatgagtggaaggtggaggatctctctcgagaccagaggaaggaattccccaatgaccaggtcaagaaatacttcgttacttcatattagtaagatccggggacttggggtaggggaaagcccaaatcaatttaccctggggtctctcccaccctggaaggggcagtcctagcccctcactgccctagtggtgagcccagcccctcccacccctctgcctgcccccagcacctgcctcaagtcccaggtggtggacctcaaggccgaagggtattgggaggagctgatggataccacacggccggacatcgaggtcaaggactggtgagtgcctggggcgagggtctggggtggggcatgccaatcaggcgccccacccccgccctgcccccaatctccgaggccctgatgggccctccctctccctgcaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtgcgtgggcctgggggacgggggcagaggcagatcgtccaaggctgaggctgtggtcagacggggcctaggttcagatccaagctctgcaccttctcacctgtgcttccaatgctctgagcttcactcgctgtttctgtaaaatgggtatatagtgtttccctcatagagctctgaaagaaatcagtgaaatgatgctggcaaagccagggccaaaaaatattccaaaaggttggcagggcgtagtggctcacacctgtaatcccagcactttgggaggcccaggtaggcagatcacctgaggttgggagttcgagaccagcctgaccaacagggagaaaccccgtctttactaaaaatacaaaattacccaggcgtggtggcacatgccagctacttgggaggctgaggcagaagaatcgcttgaatccaggaggcggaggttgccgtgagccgagatcgcgccattgcactccagcctgggcaacaagagcgaaactccatctcaamaaaaaaagaaaagaaaagaaaaaaaattccaaaaggttgactgactgttactaattactagtattgattactactgttttctagactggggtcagcaaatatttgtttgtttgtttgtttgttttaatttacttaacatatttttagggacagggtctctgtcacccaggctggcgcattcatagctcactgcagactcaaactcttaggctcaagtcatcctcctgcctcagcatcctgagtagctgggagtacaggtgtgcaccaccactaattaaaaaaaaawtttttttttgtagagatggagttttgctttgttgcccaggctggtctcgcactcctggcctcaagtcatccttctgcctcagcctcccaaagtgctggaactacaggcatgagccactgtgcccagccctagcaaatgttttcttaaaatggcggatacgaatattttaggctttgcaggtcacattgtctctgtcacaattactcaactctccaactctgctgttgtgtgaaaacagctctagacaatatgtaaacgaatggacatggctatgttccagtaaaactttatttataaaaacaggcagtgggcctgcaggccatcgtttgccaaccccagccctgtccaatagaactttctgtagtgatagaaatggtctgtgtctatgctatccataaggtagccagtagctacatgtgaccactgaacagttagtaagagccagttcctagtacaactgagtacctgaattttttatttcatctaattttacttaatttttttttcttttttgagacggagtctcgctctgtcacccaggttggagtgcagtgacgcgatctcagctcaccacaacctctgcctcccggttcaaacgattctcctgcctcagcctcctgagtagctgggattacaggcatgcgccaccacgccagctaattttgtatttttagtagagacggggtttctccatgttggtcaggctggtctccatctcccgacctcaggtgatccacccgcctcagcctcccaaagttctgggattacaggcatgagccaccgcgccgggcacttttacttaattttaacctaaataatacatgtgccccgtgatgagtatattggayatcctttggcagcttgcagtttctttccattcctttgggctgaatgataatcctgtggagtagaccagcaggattttgctccattttatagatgaggaaactgaagcacagagaaaggaattggtctgtcccaaatcacagagttcaaactagaactccactgatttctagctggcaccaagaactcagccccttccttgttcccctgcccccctcaggcagtgccacactcagagtctgctcccaccctttttgttaaggctcatcttttatttcttttgttttttagagacacggtctcactctgttgcccaggctggagcgcagtgacgtgatcacagctcactgcagtcttgaactcctactttagcctgtactcctgcctcagcctgcctagaactacaggcacacaccaccatgcctggctaattttttttttcttgtagagatggyatctcacwctctggtttgcgacaagactagttgcaaactcctgggctcaaacaaccctcccacctcagcctcccaaagtactgggattcccggtgtgagccgccacacccagcctgagtcagctcccttgacctttctcccccctctacctgccctgccaggtctcccacacattctccaactacccgcccggcgtccgctacatctggtttcagcacggcggcgtggacactcattactgggccggctggtacggcccgagggtcaccaacagcagcatcaccatcgggcccccrctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttccsctgggcccctcagaaagtcgagcttggaggccagcctggatctgtctctcccttcccctcctgggaccattctacctgtrttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctytcgctctgcctgcctgctcagaagaggtggctttggcccagaggctcaggccgggactgagatggacagacccagggtggggtggggtccaggtygggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaacctgtgccctgtggtttctggaaggaaaggcagactttaggtggtcctgcctggacctgcagatggtacaatggcatggcttctgtctaaggtacagaggggttggcatttcaggaaccaggccatcacagaaacaggttcatgggcagacccctcagtgagctgcaggtatctcacctggcagccgtccagtactgctggcttcctctggaggcccagccacaggctggggttggggtgtgtggacatctctgggcagctcttgagtccaccttgtgccagatcagcagtgccacccaggctctgcctcctggtgttactctttgccaacagctttacrgacattggatgaagccgaagcatttagaatggtgcctggcacacagttggtgcgtgatatggttaagctttgtgtccccacccacatctcatcttgaatggtaatcctgggtgtttagggagagacctggtgggaagtgattggattatgggagcggttttcccccatgctgttctcatgatagtgagtgagttctcacgagatctgatggttttacaagtgacggtttccccggctccctcctgccgccatgtgaagaaggtcgttgcttccccttcaccttccaccaccatgattgtaagttccttttttcttttcttttctttyttttttttttttgagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgcccggctaattttgtttgtatttttagtagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatcacccagtctcgggtatttctttatagcagtgtgaacatggactataatccagtgctcaataagtactcctcacatttagctatctcagtcaagggtgagctagataagggctttggccagggcaggatcaccacccaccagcccatggcaaactgcaaaaggacggccttccacggagaacatgtagccctgactgcaattaatgtgtcctgggccagtccccttgtgcagtacacagcctgcacaacccttggtggttgcctgaacaaggtgcttgctaaatatttgttgactgatggaagaaattcatgaacttaatcctgataaaaaacctcagaggttttttattttttgagacaaggtctggctctgtcgcccaggctgcagtgcagtggtacagtctccactcactgcagcctcccaggttcaagcgattctcccacctcagcctccggaggagctgggattatagacctgtgccaccacgcccggctaatttttatatatttagtagagacagggtttttgccatgttggccaggctggtctcgaactcctgacctcaagcgatcctccccacctcggcctcccaaagtgctgggatcacaggcgttagccacctcctagcacctcaggttttttacctttgagtctatgaagcctgcggaggtcacgccctagggaaagaaggagcccactgggtgtcagctcctgcctctagggaggggaccgcgggtcaagggtggagccctgggccgcataaggaaggaactagtgcggaggtccggggagcggccgcgcgttcgggagcttcggccctgcgtaggaggcgggtgcaggtgtgggtgctgagccgcccgccgcctggagggggagacagcttcaggacacgcaggccgcagcgagggcccgggccctggggatcccaggttcgtcttcccgcggcgagggttaggggccgggccgagagggacggcagcggggtccggggcgggggtggggaccgagcgcagcgcgtgacgcggcggcggggcccagcgacaacgaagccgaggccgtaggctcgggccgacctggagctccgccgctgcgcccaggtcgcgtccccggggggacgggcggcgggcgagtggggagccggggtctccggcgcctgggcgttcacggagcctgcgggcgctggtccgggcggccaggggtggggggcgcgggcggctgggcccggacttcgactgggggcctggccccggggccacccaggcggaggctctgcggccgcctccaccccggccacatcccgaggccggcgccgggttcggagaactgtcaagggacctccaggcccccacacgcctgcgagatccggcgcttgccttgccccagccacagtttctgtttccgagaaaccggtgaagtaacaatgccactagagcttgctgggagggtgggtgcggagaaggcgagcacgagacgccgggccgggcagttggggaccccgatcggtgtgagagggcttcctagggctggcatggacttccccaccacaaaatgcccagggccgggggggggaaggggcgcaagaaaatgcggactgggccagagaccagacttcggtcaccacggtgggaagctattggtgcctagatgcctctagcttggagcccagtgacttttatttcgtctagagtctagacagtgcctttagaagctgccagcatttatttatttatttatttatggcagagtcttgctctgtcacccaggctggagtgcagtggcatgatcacggctcactgcagcctcgacttcctgggctcaagcgttcctcctgcctcagcctcctgcatagctgggactacaggcacgggccaccaggcctagctaatttctttttttttttttttttttttttttttgagacggagtgtcgctctgtcgcccaggctggagtgcagtggcgcgatctcagctcactgcaagctccgcctcccgggttcaggccgtcctcctgcctcagcctcccgagtagctgggactacaggcacctgcttctcgagtagctgggactacaggcacctgcaaccaagcccggctaattttttgtatttttagtagagatggagtttcactgtgttagccaggacggtctcgatctcctaacctcgtgatccgcccacctcggcctcccaaagtgctgggattacaggcgtgagccaccgcgcccggccttttttttttttttttttttttttgagacagattctcactctgttgcccaggctggagtgcagtggcacgatctcggctcactgcaacctccgcttcccgggttcaggtgattctcctgcctcaccctcccgagtagctgggactacaggcgtccgccaccacgcccagctaatttttgtatttttagtagagacggggtttcgccatattggccaggctggtctcgaactcctgatcttgtgatccgcccgcctcggcctaccgaagtgctgggaatacaggcctgagtctgtgcgcccgacctaatttctttttttctagagacagtctcactatgttgcctagactacaagcatttttaattgacaacttttacattttttttcaaatgcttacagttgcttctcagaacttagaagacttggccacattgggtttttttgttatttttttttttccatcaaagcatttttcttttctctttttttttttttttttttgagacagttttgctctgttgcccaggctggagtgccatggagcaatcatggctcactctgctccagcaggctccttctttccctagagtgtgacctcggcaggcctcatggactgtaaggtagaaaaatctgaggggctgggttcggtggctcacacctgtgagctactgcagccttgacctcctgggctcagaagatcctgacgccatagcctcccaagtagctaggaccataggcactcgccactatgcccggcgaattttttcactatttatagagacggggcctccctgtgttgccaaggttgcaaagccttttttcttttctttttttttttttttgagacggtgccttgtactgtcacccaggctggagtgcagtggtgcaatctcggctcaccacaacctccgcctcccaggttcacacgattctcctgcctcagcctcctgagtagctgagattacaggtgcacaccaccacgcctggctaatttttttgtatttttagtagagatggggtttcactgtgttggccaggctggtctcgaacttctgaccttgtgatccgcacccctcggcctcccaaagggctggggttacaggcttgagccaccgcacccggcctgcaaagcatttttcacgaggcacaagtacctcacctgttttctctgccatgtaaagtgttcctccctgggcagaagtgagcatgcacccaccctcctgttttctgagatgggagccttcagaagaccatgaactgctgctttggccaagcctctatggaaaatcagaagaggccacagcaaaaggctgggtacagtggctcacacctgtaatcccagacttcaggaggctgaggcgggtggatcacctgaggtcaggagttcaaaaccagcctggccaacatggtgaaaccctgtctctactaaaaatacaaaaattagctgggtgtggtggcgggcacctgtaatcacagttacttgagaggctgaggctggagaattgcttgaacccaggaggtggagattgcagtgagccgagatcacgccattgcactccagcctgggcaacaagagtgaaactgtctcggggtgggggggaagaaaaaaaaaaagaggccagcaaggttctgtttccctgcttgtaggtggagaacattctctcctcatgtgtaagcagatgaggcccacctgagtgacagtgcagagccctggctgccggccaacccccacctacctggggcaagtacctgggatccccttaagaggactaaccaggtgcccccaggtaacagattcaggccagggctgtggcactgcttgaagttttccagaacccgtgcgcagtgcagaggtacaaggaggacagtgttgagagccggtttgtgctgacagcaatgctgactgaagctctgtgcttcacttggtcctcctggcccttccagggtcgggacagttaccccctccttttcacagcttcccaactggtcactgcagaccaggattcaaacccaggcagtcttctcagccaccctccatctgattttttttttccggccatctccaagtggattctggcctgacaccaaagacagctcagccgggtgccgtgggggattcccatggggttgttttatcacatgtgacttccaggccaaagtaagcttctggagataggaaggtggtttctcagcgctagctcaccactaaatgaacattaatgagtctgggatgtaaaactgattttatattctggccgggtacggtggctcacgcctgtaatcccagcactttgggaggccgaggtgggcggatcatggggtcaggagattgagaccatcctggctaacacgatgaaaccccgtctctactaaaaatacagaaaattagctgggtatggtggcatgcgcctatagtcccaactactcgggaggctgaggcaggagaatcgcttgaacccaggaggcggaggttgcagtgagccgagattgcaccactgcactccagcctgggtgacagagcaagactctgtctcaaaaaaaaaaaaaaaaaagattttatattctaacagtgaatccagagcattaaaataacaatcaccaaaaccctcacagaactttgcagacaagtgtggcctccacaaaatcttacagtccacacaacccactggctttaaaattaagcaattttttttaaattggggaggggccttttaaaaaatgtgtctctaaagactttactatttgtattgcactcttctgaatgtgtgtcccatgactactctttccactgaggggctactgtttactggaaggaccctcagcctcagaaatgctcttttgtgggtttttttttttttttagccagagtcttgcttggttgcccgggcaggggtgcagtggcgcgatcataggtcactgtagccttgaattcccaggctcaagggatcctctgcctcagcctcccaagtacctgggactccaggcatgtgccaccacacctggctaatgcagggttggagaggagtccctggcctggttccctggggacctgagggcccacctccctggtcaggctcataactgctgttgcccccacaggccatggatgctccccactccaaagcagccctggacagcattaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctacttcctacggagcctgcataggaacctcctgcgcaacccgtgtgctgaaggtggcatgggggcagggtggaggctgccaccaggctcgttccttctcatccttgggccttggcacttgcaattcccacactacctggaatattctctaaccctaaacacccacctcacttccttggttccttctcattcttcaggtctcagttcagagacctgccctgtgctcccaatctaaaaacagccctctccacctctagcatagcacccccatttcatgccctgtaacacttttcacaaggcgcggtggctcacgcctgtaatcccggcactttgggaggccgagatgggcggatcacctgagctcaggagttagagaccagcctggtcaaaatggcaaagccctgtctctactaaaaacacacaaagttgggcatgctgg

SEQ ID NO: 12435 - DNA, 43623 bp, Homo sapiens
gctgcttctcctcttgttcttgtccaaaccagtctccacagtggctacagtgattttttttttttcaatagatacgaggtctcactatattgcctatgctggtcttgaactcctgggctcaagtagtcttgctgcagcctcccaaagcgctaggattacaggtgtgagccaccgtgcccggccccagtgatcttaaaatacaaatttgaggcccaacctgggcgacagagcgaggctccgtctcaaaaataataataataataatataataataatacaaatttgagtgtcatatttttctcttaggagtttgcatgaagccccaaatcctcaaggcgcatatgccaacgcaggagcccaggcataaactatcctgccgaccttttcacctcatcatcaaccaatcctaactctgcttccagccacgtgggctctttctgggtggtgggggtgacccaagctccacctcttgttcatcttacctcccaggactgtatgtcaatgtccctcctctaggatttccttcgttttctagatcatcacctccccactctcagctctcatcacagccgtagttggtcgtctacctcccctatagactggaagcttcgttcgggccgtgggcttggctgtcctgctcaccacggtgtccatgacttgggctcagatgtttcacaagagtttgttgaatgaatgtggggaaaggatggacaggggatagacgggtgtggagggcaggcagacacggatcctgaaaggtacacacagaccgaacctgcagtgggaggggtcgccaacaggaccgactggccggggcggagggcagggccgcggctggcgcgcggcaggtggtcggagcagtcgggcgagggagagctgggcgctctccaggctgcgcctccgcagggggcgcccgtggcccggggcgtggcctcgcgcagccccgccctcctcgccggcgccagggcaggcgggcggctggcagctgtggcgccgacatggctgcgctggtggagccgctggggctggagcggggtaagcgtgcgccagggggccctgcccacccgggccgcggcctacatacccagcccccggtccccgcccttcccgggtcaggccagtgcgggtgggccagcggacccggagggggtgggcggggcgggcgccggggccgggcggtcgctaggtgtgggaggctccctgggcgcgggccgggacgctgggcgcccgccttacaacccggcctgtggaggggtcccggggccgcagggccgctggtggcagtctctcctgcgccaccctggactctgcggggtgtccgactaggcttcggccgtcctccccggactgtgcgctcggcctcactccgccgctctccttgcttctctgcgtctcggggtctctgacactcggggtttctgcgccccgcccccgccccgcagacgtgtcccgggcggttgagctcctcgagcggctccagcgcagcggggagctgccgccgcagaagctgcaggccctccagcgagttctgcagagccgcttctgctccgctatccgagaggtgaggggcgcgcggcgcaggggcgcgagctggtggccgtcgtcctcctcctcctcctcctgcttgtcccgagcccggagactacgcctcccggcagctcccgaggcggcccgccttggggtgccaacgcttcagctcaggggttcttcgggagttgtagttttctcggccttctgttgcgggggcggggcggatccttgcgtggtagcgggagagggtctagaggcctgaactcctgcgtctagggctggaggagctggcgactccctgatgccgctgcctcctcacccaggtgtatgagcagctttatgacacgctggacatcaccggcagcgccgagatccgagcccatgccacagccaaggtgggccccgcaccccattgctcctggtgtctatttaactgcctagtcgaactcaatatctccttcatgccagtcatttctgtttcctccctcatgatttttgctaaatctatgtgccaccttactattagtaaataatcgcacatttttaacttaaatgtcatactaaggcatctttagcaactgcaaatggaaacagtatggcatggttggtagaagataaccttcaacatctgtacagtgcaaaccaggaaactcatggcgctctgacctctcactgcacaatagttagatgctgctacctcttgctgctgtccggaggctcagatctccctccaggcctggctttcctctgtttaaaagtaagattgaggccaggcacggtggctcacgcctgtaatcccaacactttgggaggccgaggcaggtggatcagttgaggtcaggagttcgagaccagcctggccaacatggtgaaaccccgtctccacagaaatacaaaaaaaaaaaaaaaaaagaaaaagccgagcgtggtggcgagtgcctgtaatcccagctggattacaactccggaggctgagacaggagaatcgcttgaacccaggaggccgaggttgcagtgagccgagatcatgccattgcactccagcctgggcaacagagtgagacttcatctcaaaaaaaaaaaaaaagtaagattggcaagtatggggtattcaagacacacaccaaatggacactttctcttgcaagtgaacagaaagagacgcacagtcattacagggggatcgtgcattgtgccatgacaagtgtcccatgcttggggatagtaacccaggctaaatcgctgtcctcggtccacatcccccaccccagctttcatgcctacctggaaggggccctcatcttcagtcgctttctctctcccaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtggtgagtggagggctgaggcaggactgggggacacagtctgtctaacgtagcatagcccctgcttttgacattcactcaacacacactgagtgttgtctgtatggctagccctgtgctgggcaatgttacagactctgagagatgttggcctcagctccctacactcaaccttctctctctggggagggcagtaggccccggctgaaatagtcctaatccagagacataataatgaggaagtgcaaagtattgtgacagcccagatgtggcaccaggccagcatagatacaggaaggttttgcagagtaaggaacatttgggttgggtgttaaaggatgagtaggagttctccaggcaaacaaggtacagggtgttcctgctgagggtactgtagataaggatactgacttggcatacctctgagctgaaaagaaagggcttagttctgatggaggtctggggcatgcaggtaattaaaatcactgtggttaggctgggtgcggtggctcacacctgtaatcccagcactttgggaggctgaggcacgtggatcacttgaggtcaggagttcaagaccagcctggccaacatggtgaaaccccatctctactaaaaatacaaaaattagccaggtgtggtggcaggcacctgtaatcccagctacttgggagggtgaggcaggagaatcgcttgaacctgggaggcagaggttgcagtgagctgagatagcactactgcactccagcgtgggtgacagagtgagactccctctcaaaaaaaaaaaaaaaaaaaaaactcactgtggttagagttgagggaagcataactggagagatggctggggtcagccatacaggacctgagtgccagcctgagaagctgggactttgtcccatgggtgctggggagctatgggaggggtgagccagggataaactcagcttgcaggtgcagaaggaccactctgggactctatgggagatgaactgaggggagagattagaagccaggccagggaggaggctggggtaagagtccagagaaaagaggacaaggcctgagctggcccagggctgtggggacaaaaaagagggagtcaaggcgggcggacattagtgggctgtgggcagggaggccacaaagatgggtctggacgtttggccagggactgagggaacacggggctgtccctgacatgggaatcctgggaggttttggaggaggacactgaaccaggagttaatgactcccacgaggaggacatgaggcattgacatctcagggctggcaccaggctcactagcagtgggtcccatctcccagtgggggctggacgagggcagcgggccccaggctcagctgtctgtgttgggccctgcagagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtgagcccctgggtcaccacacccctggggcctccacgggctccctttaaccccaggctcccaaaccaggccagtgcttcctggatcttccagccctggcccctcctctgggatcctgacccttgacccttggcccaggctctcaccccaggctagtttggccaaatcccctggggagcccttagcttccttccatcccaagatacggaacctactgtggctgggatccctcagcccacttacctgggcccttgcctctgcaaccccagtcctgcccctcttgtctacccggagcctccctgatcccgggtcccttgtccaccccccttgcaggtccttggagtctcgaggttgaaaccacagatctggacgttcacgtgcactctcttcctgtacagtatttattgttcctggcactttatttaaagatatttgaccctcactgagtgtctgtgtgtctgtcctgcatccctgggttggtgtcttgagatgtggagggaatgcgaggagctgaggtcaggccaagccgttgagaagccttttccagagtctgagaacagaggttaagacctctccctaggtctgaaggcggagacaggccggcttccaagagactagtccgagggcggagggcggaggcagggacccagtctgggtctgagtgctggggcagaactgaggacaacgccgcctacccttaagagcgtctgagggcgaaggccaagtcccttcctccagagtcctgaaacgcagccggagccagtgggcggcctctgtgtgggcggggcggagcgaaccattagcctcgtccgccgggggaaccctgcaggccgcactactgtctgcgtgggagtcgcgggtgggggtgccgcgtgcagttcccgaggcgggcgcaggggtgcagaatgaggtgccctcgcccaccgggcgctcactccaccttccaaacacagcgcgtctttccggaagcagcccccgccttgaaatccaacctttagcctcatcccgctgcccgcccagccctcgtgtcccgtgcggcgcgagggctagtgcgcgccactgccgggagccggggtcgcgactcgcgttccacgccgcgcgctactcgctccaggtgacatcatccccctgccgggctccgcctcccgccccagccgcctcacgccgcgtgcctattggtcgacgcgccttatgccccgcctctcgctctccgcccgcgcgacccctcccggccggtgtggaggcggggtctagtcgccggccggcgccgacgctctctcccattggccgctcttcgccgtctgtcagtctcctgttaaaggggccacgaccgcccgggagccgtggggggggagggggagggaggaggaatttttttggggggaaggtgggatttgggggscgctggtgggcacccctggatctggcggctgcggcctcgcggggggaggctgatcggtgacaggggcagggggctattttgggggtagaaggcagtgagagcgtgagggggaggggggtccccagcgcccaagccggagccagagacgcggagcccgcgcgagcgtcggagacagggctccagggctccgaagcgacagagccgggccccggccgctgccaggggccccgcccggcccccccactccaccccacgtccctcctgcagcccagctccgcccgcagccgccgcggaccaggcaggtaagagcccggcccggccctcctggcagcgcccaccctggggaccccttggcgagcctcccccgcctccccgagatcccggattcccttcctcatcccaggggacccccgagcccagatttcacaccccaaccccggggactcaggcgtgcccctcccggcgcccagagtccccgaccgaaccctagaatcccgggcgcaccgccgcctcgcgcctcctccagggcccaggagcttggatttcccggtccggccccgggacccctcctagagcctagatcccccttcctgaccctgtcctgggagctccagacacccgccgcggcggtgccagactccccagacgcgtccgcatcgtccccgcttcgcgcactccgtctcccgtcgccagcctcgggcttgcacagccggctgcgtcccacggtccaggcaggctcggcggccgccctggacacaggcccgctctggagctgtccatggtcagcgcgctcggcagcctcgcctccccccacctcctgccgccgccaccagggagggggcgcaggcggcgcggggatccccccgccgcgcctttgacccgggaatacccgggccctccccgaccagggcgccccagcctctgggttctgccggccaggctcgtggccccgtcctcggcaccccaggttcctgggactccagctgctccctgaggatccagggcttctgaattttcctattctggtcgccgtggggaccatggcacccggggatgcagctcccaccccgttcgggaagcctgtccgtgtctacacctctgctggccccaggtggtagccctcaccccgtcagcacctaggaatcctgttccccagcgtttgctctgcttagaaccccgctgtgccctgcagacacacagacttagcctcctggcacccagcatctgctccccgagggactcaggcgccatgactccyttcctttgggggacccggaatgtgattctcaatgcagttctctgacttctgttcacactcccacttggggacctaaatgtcttggtcccagtctcctatcccctcagggacccaggagttcagaccccagcttccgtactgcccaccagcttttactgaggctgtctgcctcaaccctctctccaaacaagacctcaggctctcaccttccaatcccccatcatttacctccacaaggattcaggagtccaggctcccagctctgtccactgccctccccagcaggtatctagtttctcaggtctcacttttaggaaccaggtcttcacagcctcatcactctgccccatcaacttcacatctcctgtggccctaccaaacccctgtctcatcctcatgtcaccccaggtggcgggcttcaggactctctactctttcccctaagatgcagcttgttgagatgtttctagcactccattgcccyctgaggctcagatgagttccccttctccaagtacactctcccaggccaatgagccgaacacacatcacctcctccagatgtattctgtggcctgggctcataaggagatctagaagctacctgctgccatacaaatttctttctttctatttatttatttatttattttgagacaaggtctctgttgcccaggctggagtgcactggcacaatcacagctcactgcagcctccacctcctaggctcaggtcatcttcccaccttagcckcctgagtagctgggaccacaagcactcaccaccaggcctggctaattaaaaaaaaatttttttggccaggcgcggtggctcatgccggtaatcccagcactttgggaggctgaagcgggcggatcacctgaggtcaggattttgagaccagcctggccaacatggagaaaccctgtctctactaaaaatacaaaattagccaggcgtggtggcacatgcctgtaatcccagctactcaggaggctgaggcaggagagtcgtttgaaccccggaggcggaggttgcattgagctgagatcgtgccactgcactccagcctgaacgacaagagcgaaactctgtctcaaaaaaaaattttatttatttatttatttatttattttttgtagagatgggggtttcgccatgttgcccagactggtctgaaactcctaggctcaagggatccttctctgttggctcccaaaagtgctgggattacaggcatggccatcgcgcctggccgggccacatttcttgtcgcacatgtgctcttgcattgctccatgttctagattccttctaaacaccagaacactcccagctgatgtctgttctgtgttccattttcattccaggcatggtctgagttctaggccagatgccaatttttttttttttttttttgagacggagtttcactcttgttgcycaggctggagtgcaatgctgcgatcttggctcaccacaacctctgcctcccgcgttcaagcgattctcctgcctcagcctcctgagtagctgggattacaggcrcctaccaccatgcccggctaattttttgtatttttagtagagatgggggtttctccatgttggtcagactagtctcgagttcccgacctcaggtgatcacctgcctcggcctcccaaagtgctgggattataggcgtgagccactgtgcacagcctttgtttttttcatatatttagataagacccctgagccagattctgatcccaccatatcctcagacatgttccaaagttctaacaacaagtccttccttctttgctaaatgttcatttcaagtgtgttccaggtttcagccacgttgttctagattccattctcttcccaggagcaatctaacttctaagatgtgtgtgttccaagtatgtgctctaggcttcctaattcgtgccattgattctagaatgcccttccctgtttccctgttttaggttctaaggaagttctatctaattgcacattcttttttgttgttgttgttgtttagttggtttttttttttttttttttggcgggggatggagtctcactctgtctcccaggctggagtgcagtggcgcaatctcagctcactgcaagctccgccttctgggttcacaccattttcctgcctcagcctcccaagtagctgggacaacaggcgcccaccaccacgcccggctaatwttttgtatttttggtagagacggggtatcaccgtgttagccaggatggtctctatctgttaacctcgtgatccacctgcctctgcctcccaaagtgttgggattacaggcaggagccaccacgcccggcctgttgtttagtttttattttatttttgagacggagtctcactctgtcacccaggctggagtgcagtggtatgatctcagctcactgcaacctctgcctcccgggttcaarcaattctcctgcctcagcctcccaaatagctgggactacaggcacatgccaccacgcctggctaattttttttgtatttttaatagagacagggttttgccatgttggccaggctggtctcgaactcctgacctcaagtgatccccctcctgcctcccaaagtgctgggattacaggtgtgagccaccacgcccggcctgttatcgttgtttagacattggatctcattatgttactgaggcgatcctctcaccttggccttccaaagtgctggaattacaagcatgagccactgtgcctggccctaatttcacattcttttttttttgagatcgagtctcactctgttgcccaggccagagtgcagtgacgcaatcccggctcactgcaacctccgcctcccgtgttcaagcaaattctcctgcctcagcccctcgaggagctgggattacaggtgtgtaccaccatgcctggctaatttttgtgtttttagtagagatggggtttcaccatgttggctaggctggtctcgaaatcctgacctcaaatgatcccccgggctcagcctcccaaaatgctgggattacaggcgtgaaccaccgcacctggcctcatgttcttaaatgtaaaagattcccagtgaagtgttctacataatgttttccttcccccggttctaggttctaggcccattcattttctgtcattttttccccagtgcagccttagtttagaacttgtcccctggtggatcgtgggttttctcctccatctgccactttggcattctaagcttgttctaggctctctcttcttctggagccttcagcctagaaatgtccttatttccagaacagcccccctcctttgccagcctcagtctttattccaggaaatgctcaattctcaacatgcatccttttgatccctccccctccccgccctatagacacttgtaagttccaagcaaactcttagacacatgataaaaccaaggatgtgactcctgctatattcttttttaaaaatgtaattaaatttttaaaaaatctatttatttatttattttgagaccaggttatgagactggttaatttttgtatttttttgtagagacagggtttcaccatgtttcccaggctggtctcaaacccctgggctcgagtgatcctcccaccttggcctcccatagtgctgggattacaggcatgagccaccgcgcctggccccctgctatattctgtgttataccttcatccctagcaggctctgagttctagattttatctgctgactatgtttgttatgtgttgcattaggtatattaatgggtgtcattatgtatgtggggttctggggtgacctggacactaagttattgggttgctcttggctggttctagattataggcttcagaacttagttctagattacttaggcctatgagcggttcttaccccaagccattgaaagcgtggaagcatacgtctattccccaccctgtactgtgtgtagtaaccttctaggttctatgtccagccttgctgtgttttttatttccttctcggtcaatttaaggctctggaacagsctccccaaaacatctgtgttgcatcgtcagagtgggttgctggttttagatatcatgttggggctgggcgcggtggctcatgcctataatctcagcactttgggaggccgaggcgggtggatcacgaggtcaggagattgagctcatcctggctaacatggtgaaacccgtctctactaaacatacaaaaaataattagccgggcgtggcggcacgagcctgtagtcgcagttacttgggaagctgaggcaggagaatcgcttgaacccgggaggcagaggttgcagtgagccgagatcacgccagcgcactccagcctgggcgatagagtgagactccgtctcaaaaaaaaaaaatagagatcatgttggttttttgcctatggctggcttgccctcttagaatcgttttcctgaatctttcctctgagtgctgggattcgcctgcctagattctcagatgcaccacttcaaacacccaaggggacaggaacccagctgcctcctctcccagggcccacggccctcaggccctcctctcctcacagaagtccaaggccccattcccaggctttggacacagtccgcatattgggcggggctgggaattatccacgctcagaccggttatgcgttgcccgcagggagagaaggaaaagaaggaactgagtgaaagtccctcctgctttccgccgggccagctggacccgtcggacctgatgtgtgtggagggagcggttcagggggcctggcttcatctccgccctgcccctggctctagggacccaagtccaggcttcccgccccagaaaccccgccccttccttgtcccccgcccttgggtatagcttcaagagggctggggctggggttggtgggagcgtcccagaactcctgggtcctggaggaggagctgtgcacccaggggcctgggggaggaggagcctgaagcctgggacttctgggtctaagcgaggaagctgagagcccagactgttgtctcttaggggaggagaggggtgcggtctccgactcctgggaatggggaggtgggggctggaggcgcaggctcctggggtctgagagacgaaagggactgggtcttagactcctgtgacctgagggaggcgggagctagttcttggacttctgggtcgtgaagagggtgaagaagtgacaagcatggtcctggccatactggtattttttttgttttttttttgtttgtttgtttgttttgtttttttttgagactgggtctctctatatcgccaagctggagtgcagtggcacgatcttggctcaccgcaacctctgcctcccgggttcaagcgattctcctgcctcagcctcccgagtagctgggactacaggtgcgtgccaccacgcaagctaatttttgtatttttagtagagatggggtttcaccatgttggccaggctgggctcaatctcttgacctcgtgatccaacagcctcagcctcccaaagtgctgggattacatgagygggccaccttgcccggccgttactgtgttttttttttgaaatggaatctcacactgttgcccaggctggagttcagtggtgctatctcggctcactctaacctccacctcccgggttcaagcgattcttgtgcctcagcctccccagtggctgggactacaggcgcatgccaccatgcccggctaattttttttgtatttttagtagagacgggggtcaccatgttgcacagcctggtcttgaactcctgacctcaagtgatctgcccatctcggcctcccaaagtgctgggattacaggcatgagccactgcgcccagtcctggccttgcttttttttttttttttttttcttttcccgaatggagtaggtctttagattcttagggagccggggtccagatttctgggaaattgaaggaggcaggagttgggctggctagtaggtgagaccaaccctgtgacattatacaggtaaccacatcctagtgacctaatcctgggtcccttggccctgtggccttcttaaggcatggttctggtctgggcctcagttttcctacccatgcagtgggttgagggggattctcagtagagccagaataggtagacactgattttctccacattcactcatacgataccagggtcggccagctttggttcctttgagtgggctaggcttaggtttgctgccactgtctgttggagtctgacctcagttttcccaaatcctctcacccaggtagccaggactgttttcctaagagcaatggcacaggcacagtggcatactttgggatgctgaggcaggaggatcccttgagtccaggagtgagacctcatctccacaaaaaaaaaaaaaaaaaaaaaggtcaggcgcggtggctcacgtctgtaatcccagcactttgggaggccgaggcgggcagatcacgaggtcaggagttcgagaccagcctggccaacatggtgaaaccttgtctctactaaaaatacaaaaattagctgggcatggtggcgggttcctgtaatcccagctactcgggaggctgagggaggagaattgcttgaaccgggacccgggaggtggaggctgcagtgagccgagatcgcatcactgcactccagcctgggtgacagatcactccagctaaaaaaaaaaaaaaaaaaaaaaaagaaagtagggaaaggaaaagaaaagaaaagaaaagaaaaaaattagccaggtatgctggtgtgtgcctgtagtcgcagctactcaggaggctgagttgggaggactgctcgagtctgggtcgttcaggctgcagtgggccgtgatcgcgccactgaactccagcctgggtgacagagtgagaccctgttaaaaaaaaaaaataataataataggcctcagtttcccctggcagcacctggtggccaatctttggtttccccggtggagtgacagggtggcggtgcctgtttccctgtgtcatgatcacagtgcctgggcctcagtttcttctgtgcagtgcttggtttgcccccaactatttcccctacgtggtatccgagtggctgtgcctcagtttctctgttgtgccttgacaaggccggtctgttccttgccctccccgccccgcaggcccgcaccgccgccatgatgtgcgaggtgatgcccaccatcagcgaggatggccggcggggctcggcgctgggcccggacgaggcgggcggggagctggagcgcctcatggtcacgatgctcacggagcgcgagcgcctgctggagacgctgcgcgaggcacaggacgggttggctacagcgcagctgcggctgcgcgagctcggccacgagaaggactcgctgcagcgccagctcagcatcgcgctgccccaggtctgggcgggacaggggcggggcatgagggggcggggcctcggggggaagaaggcggtccggaaggggccgggcttggcgcctggaagggaggagtctgggcgaggcttgccgttaatgggcggggcctgagtggcaagggacagcgggacttagcagggagggcgggaccttcaaacttccagtcccagtgaatgaaggagacagggaaaggattgagccgaatgtccagatcctgccaatgtctggacaggagtttgcagctctgacgaaggagctgaacttatgtcgggagcagctgctggagagggaggaagagattgcagagctgaaggcggaacggaacaacacgcgggtgaggggtgttgagggcggggcctaagtgggggcggggcctcgtggtgttgaagtggggggcggggcctctcagtgttgcagcgtgacctatttttttcccccatctcgcctttctgtcttctcctcttccctgctcccacttcctggctggtctcccactctggtgccactccttcctccctgtctccataacttttctcttttctgtaccaccggttccttgaccccgacctcctctcttttcctgacctgtctcggtgctcctttatatggctccatcttttcctccatgtgtccgccctacctgtcaccctttttctcacatctgccccttttcccttgcctcttttcmttgaccccatgccgtgtgcttgcagctgctcctggaacacctggagtgcctggtgtccaggcacgagaggtcactgcgcatgaccgtggtgaagcgccaggcccagtccccgggtggggtctcctcggaggtagaagtgctcaaagctctraagtctctcttcgagcaccacaaggccctggatgagaaggtatgagaattagaagagcaggggtggagaatggaaaccyatagttgactggggctgttctgagtgggagagattctggccgtgattggttggggatgttctgagttggaagaatgttgactgtgattgattgggacaggatacatagactgggacctgactggttgatagyagaaaaataaacyaggatgggggctaacagtggatggggcagattggatagctggttgyggctgcatacccgttatggagacaggagccccaacgctgccctatcggatccgtcccaggggtgttctggaccaggggcaactgtcctaaactggatcttgtctccagctgactgttgccctgccccgatccccaggtccgggagcggctgcggatggcgctggagcgcgtggcagtgctcgaggaggagctggaactgagcaatcaggaggtgtgggtgtggccaagacagggaatttgaatccaaggggaggggctaaggggctgcccayggggcggagccggttgggtgggttccagagagaatctattggggcaggactagggcagacaagctatggggttggactatggagagaaaccagtggggttcctaagtgggcacgcattgcgcagggctacggggagaatctcccagtgagagtgagattaagggtagaaccaggggctggggctcaggctgggactaaggaggaagtgattgaatggggaaaagcggggctaaagcggaaactttgtccaggaggctaaggggaagagtaagggtagacgccctccgtggtggcagctaaggagggatataaggagggagggagcctaagggtaaaccgtggggtaggcatggccccagcacgaccggaggcatctcatatggggccgcctatccccttagagggccaatgccagtgagaactagagctgggggttcagggagcccctgtgctctgattcccctttcacacttccagactctgaaccttcgagaacagctgtctaggcggcggtcagggctggaagagccgggcaaggatggggatgggcaggtgagacatggaagtcccctctccgtgagctccattcaactccctgactttgtgatagtgtttgtaacgtttggtatcatcctcactggccctaagacggctgcacctgtaagagtgtcacagagcttggacctctgattcaggtcacctagcgaacttctgtgacctccttcactgacccccgtggactctgaccagcatgatccttattgatctttgatctactttcagctgattgactttctccttggatttcctctgtgtctccggagacactctgggatcttgtcccctccttccctcactccagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggtgaggcccccagggaggcgggctgccctgggtccctcgcctttccgtagagctctccctcgcgcattgctcatgaatggcggaacctcgattcagtccacaggctgggtgactcctctttgagattcagttttcccacctgtgaaaggaaatgtatgattctcatcagagggtgagcctgtggcgcagagtaggcgctccataactgctcgtaattactttgttacctaactttgggttcttctctggtgcctctaaatggattttttttttcttttgtgaggcagagtctggctgtgtcgcccaggctggagtgcagtggcgtgatcttggcttactgccacctctgcctcccgggttcaagagattctcctgcctcagcctcccaagtagctagaactacaggcacctgccaccatgcaccgctaattttttttttttttttttgtatttttagtagagatggggtttcactatgttggccaggctagtcttgaactcttgatccgcccacctcggcctcccaaagtgttgggattacagtagtgagccaccgcacccagcctctttttttttttttttttttttgagatggagtctagctgtgtcgcccaggctggagtgcagtgtcgggatcttggctcactgcaacctctgcctcccaggttcaagcgattctcctgcctcagcctccctagtagctgggactacaggtgtgcaccaccacacctggctaattttttttttttttttttgtatcttcagtagaaatggggtttcactatattggccaggctggtctcgaactcctgacctcaagtgatcagctcgcctcggcccaaagtgctgggattacaggtgtgagccactgcgtccagcctctaaatggaatgttttgtgggtatttcacccctttctggcttaggccgctttatcctaatcccagtgaccccagggagctgctgggaaatgtggacctggattcttgaaggcagtggatgagaaagaagagtgagcactaggactagcctgggcaacatagcgagaccccgtcactacttaaaaaaaaaattagccgggcgtggtggtgggtgcctttagtcccagccactagagaggctgaggcatgccaggtgcggtggttcacgcctgtaatcccagcactttgggaggccgaggcgggcggatcacgaggtcaggagatcaagaccatcctggctaactcagtgaaaccccgtctccactaaaaatacaaaaaattagccgggcgtgatgtcgggcgcccgtagtcccagctactcgggaggctgaggcaggagaatggcgtgaacccgggaggcagagcttgcagtgagccgagatagtgccactgcactccagcccgggcaacagagcgagactccgtctcaaaaaaaaaaaaaaaaaaaaagttgaggcataagaatcacttgagcttgggaggtggaagttgcagtaagccgagatccgtaccactgcactccagccagagtgctggttgctcatgcctgtaatcccagcacyttgggagaccaaggcaggcacatcacctgaggtcaggagttcaagactagcctggccaacatcgtgaaacccccgtctctactgaaaatacaaaaattagccaggcatggcagcgggtgcctgtaatcccagctacttgagaggttgaggcaggagaatcgtttgaacccaggaggtggaggttgcagtgagccgagatcgcaccactgcactctagcctgggtgacrgagcaagactctytctctcaaaaaaaaaaaaaaaaaaaaaaaaaaaaagaaagagagagagagaaccttcatctgggattttaagcctggatagccgcaggggctattgggaaatgtagccccaccacgtgggctaccagatgagggtccatctcccataagaagttgaagcacttcttttggggttctaggcctctggtaccctggtagctcttgagaggtgttgccttctaggtagaagggatccttatttcccatgagaccccaggacacttgctgtttgattctaagtctgctctatgccagaaattagtgagaaatccaaggcctgggttttgaggagagggctggagtggagacttcacatcccacaggcctcagatcctctgaacctggaggatctgagcctgcagtgtcctagaagctcatgggaggtgtagcatcaccattttaactcgcaggtaggtggcagggacttaagatgggctagtcctgggagctcttagcgggtgtgacaccaccattctgactcccatgtcagggcactttgtttcccagggaacaagggggttccccgtcctctcccccaggggctcgcagtccacggggccctttgctacctccgcaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcaggtgggggcgcggccgggaggggcgatgggggcggtgccggggcccaagtgacccagcccgtcccctccccctgcctctccctcccccagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggtgcsgggaggactcgggtcggggccttgcgtggggaaggggtggggcctagaggaggcggggccgtgaatctggaggggtaggagcgaggtcagaaccccggatttgggggaaagggtggggcctaggggctgggaaagggacaggacttggaatggggagggcctggaggtttgcgcgggggacggatgggagcggggttctctagcctggactgaaaggaccggtggcctggaacctgagagggaaggaacaggtcctgaaaaagtggactaggcgcaggggcggggcctgactcaaaggtgcaggggaggagcctggcgctgtgggggcggagcctggcgctcagccttggaggaggtggggctgggagcctgactgatcctggaagggtaagtcacacgccatgggttccatctcctaggccgaggaacgtcatgggaattttgaggagcggcttcggcagctggaggcccagctggaagagaagaatcaagagctgcagcgggtgagggggcggaagactgcacagagggtggggcttcgaggctggggcggagcttaataaggaggctgggctgggcccgggggtggggcttagaggaagggccgtggtctgggcagggtgggcttaacaacccgccccgctctgctttgcgcaggcccggcagcgggagaagatgaacgatgaccacaataagcggctgtccgagacggtggacaagctgctgagcgagtccaacgagcgcttacagcttcacctcaaggagcgcatgggggcgctggaggagaaggtgcgccccccatacaggactgcgggacgcggaattccgggactacctcttgctggaatcctggggccccaggcctttccctcagatctgttatcggaggcctccctaaaccccggcatcctgagttgggcagccttctctgctctattgcccagaccgctttttcacctattctagacgttccaagagccgaattctggggcacccatgcctcgagtccttgacttttcccaaagcctccaaccccatgggtctccaaaccctgaaccctctgagattgcacaggacgtcgcatcccggggcttctctccccagaaacatcgttgcccctgctcccccgaaactcaccacttgtgtccatctcattcctcctgggtcccctcaggcctgtctgtgtgcactgggagctgcctgcagccccacgggcgtggcccctcaggcctcactccctcacttcacctctgtctccacagaactccctgagcgaggagatagccaacatgaagaagcttcaggatgagttgctgctaaacaaggtagggggccctgaggggacaggaggaggatgttggggcagtggttgctgaggctagggtctgcaagtctggcaggggctgttcctcctgggcggagcagattctaacccgacacctccaacaccggcccccaggagcagctcttggccgaaatggagcggatgcagatggagatcgaccagctgcgggggaggccaccatcctcctactccaggtgacagcagcccttctgccctgcccccaccatggagccccgttggccaagcgccaagctcctcccttctgatccccacttcctgtcctcctgagacttctgacccctctgtttttgttttttgtttgtttgtttgtttgtttgttttgagacagagtctcactctgtcgcccaggctggaatgcagtggcacgattccggctcactgcaacctccacctcctgagttcaagcgattctcgtgcctcagcctcccaagtagctgggactacaggcgtgcaccaccacagccggctaatttttgtagttttagtagacacggggttttgccatgttggccaggctggtctggaaccccaggcctcaagtgatcctcccccctcggcctcccaaagtgctgggattacaggtgtgagccactgtgctcagcccactctggttttttaccctgactttatttatttattttttctttcttttgagacagagtctcactctgctgcctgggctagagtgcagtggcatgatctcagctcactgcaacctccgcctccccggttcaagtgattctcctgcctcagcctctagagtggcagggattacaggagcccaccaccacatccagctaattttttttatttttagtagagacagggcttcaccaggttggcctggtctcaaactcctgacctcaagttatctgcccacctcagcctcccaaagtgctgggattgcaggcttgagccaccaggcctggccccttgaccttgacttcaggacccctggccstaggtctgtctctgtgacccttacctctgtgctcttttcctgaccccttggtctctgactgctttcctcatgcccacaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggtcagcagctgcctctgggtcctggactgagcagggcttgggcgggcagctgtaggaagtggaactaaatctgtggggctccgggaggaagctgggttgagaggcaggatctcttggactcatccactcaccctttcttctctccttccctgcaaccctcttgcctggatgtctcctcctgtggatgtcctgccacctggtgagaacctgagagtaatsatgggacagggaggggtgtgtagaatcccagagtaggtggggttaggtgaggaacaggagccagctgagtcatgggaatcaggggcgggggtggagtcatgggtgtgggcgtggcttggagaggatttggggagggatcaagaacagggacctgtcaagagaggaagttggaggccgggcagggtggcccatgcctgtaatcccaacacttgctggcgccgaggcaggcagatcacttgaggtcaggagttcgacagcagccttgccaaaatggcatcgctactaaaaatgcaaaaattagccgggcgtggtagcgggcgcctgtaatcccagctactcaggagactgaggcagaagaatcgttcgaacctgggaggcgtaacccgagattgcgccactgcactccagcctgggcgacagaatgagactctgtctcaagaaaaaataaataaaataaaaaaaataaagctgggctgggaaaagcatcagtgaggtcgggcaagtcaggatcatgagccaagacccagcgccaacctcggcccccagccrcctaatgtccctctgtcccsacacagggataggattgggagcggtctgcccctkcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagtgagccctggccccgccccggcctgccctgccctgccggagctgactccacagcccttctggctctggaggcctgaaagcctgagtccgtctcctcttacaccatccacaaggaattcttccagyccaacactcactccgctgtccaggcatcccctaggatacactcagaagtcttctatgtgctacctacacatataccccccagccagtactcaccattccccaacacaccaaagcctgcatccccaaatagcccagttcctcttgatgcatcaagaatcttccattacgccatcgattttgtggtttcacataaccagtgcccagagtctcccactaccctaggaatctcaagacaacacaaggttcccaacctcaaacaccaagaatctcatcctaacatgctaatcaaaaacttcaactccaggctgggcacagtggctcaygcctgtaatcccagcactttgggaggctgaggccagcggatcatgaggtcatgaggtcaggagatagagaccatcctggctaacatggtgaaaacctgtctctactaaaaatgcaaaaaattagccaggcatggtggcaggcgcccgtagtcccagctactcaggaggctgaggcaggagaatggcatgaacccgggaggcggagcttgcagtgagcygagatagtgccatgcactccagcctgggctacagagcgagactccgtgtcaaaaaaaaaaaaaaaaaaaaaaaaaagtccccaacttattaaraagcccccagtgatgtaaagtctaccctgattcaccagcaatggccatattcagcaattctcttataatgtactccccatgagccttcggcaaatataccatgaccaccactttccataccaaatgagtccatgcccttcccagatcctagattggcctgagtccctgatctcacaatgctcctattatgaccttgctcttacaggccaccttgaacttgaccttttgtccatagtaatcccttcatgattttccaaaccccttgactatcatcagggccaccctgatacaaaccccratcaccttgatagccctaatcctgcaatgacttcctgagactctcaggaccccttgactctccttgagcctggaaggccttcagaaacccaccaaagtcctctgacgtcattgcaccgtccccagaattcccattgccccaccaggcctttctggcccattgtgctcccagattccctctcccgctgtctgctgcggcccctcacccagtttcccctatttccctcctcaggctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctgtgagtgctctgaagtctccccagcctagtagggggatggggagaggtcagaggcagggctccccagtgtacagcaacaataacccctcacaccagtggttttccaaagcaacctcagctttccctaaaggttcaaactcagggcaaaggggaggctgagtcactgggatcttgaaccctaactttcactttagtcagatctggtctacttttatttctcatgcgtcaagtttctgcataggattttaaaaagtttctggctgggtgyggtggctcacgcctgtaatcccagcacttcgggaggccaaggtgggcagatcacttgaggtcaggagttcgagacccacctggccaacatggtgaaacccccacctctactaaaaatacaaaaattagcctggcctggtggcacgtgcctgtaattccagttactcgggaggctgatgcaggagaatcaattgaacccaagaggcagagtttgcagtgagttgaaattgtgccactgcactccaacctgggagacagagtgaaactgtgtctcaaaaaaaaaaaaagtttctgtgacaacatgcattggagaactacaaattagatcctcagaattgacctttgagggagacaaagagatattggccctattttactcccttaaattcagctttcctgcttccagaacctgtaactcattagctttctttgaggcctgaccaacatggtgaaaccccatctctactaaaaatacaaaattatccgtgtatggtggtgtgggcctgtagtcccagcttcttgggaggctgaggctaaagaatcacttaaacccgggaggcagaggttgcagtgagctgagatcatgccactgcactccagcctggcgacagagctagactctgtctcaaaaaaaaaaaaaaaattacccgggcatggtggcacatgcctttaatctcagctacttgggaggctgaggcaggagaatctcttgaacctgggaggcagaggttgcagtgagccgagattgtgccattgcactccagcctgggccacaagagtgaaactccatctcaaaaaaaaaaaaaaaaaaaagtttctgcaactcaccctgacttgagctagactaccttcgtatactgtgttctaaaccagggtcaccccacacacaccttagtagacatctcagttaataaggagcccccgacatgactctttgaactcaatccagcatctrtgccctctgtcctcagaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaaggtcagcakggacaagggatagggacagggagaagctggcttgggaagatgagaagggggtggacaaggacttgggaggagagggggcatctcagcaagcatatgctctcattctctcctgctttcccagtgagggcaccccagattctctgcacaaagcccccaagaagaagagcatcaagtcatccataggccgtctctttggcaagaaagagaagggacgaatgggacccccaggccgggacagctcttctctgggtgagtacctcactctaacccttccctcctttgttccttcctcccttcctccctccctytctttcttctttgtatgttcatttgacatccattcatgtcttcattcatttggtgatttatttagaatttggaaggaacacagcytgccaaggtaggcgggaggaggagggaaaaggaaagggcactctgggrcctgcttgggtgactgggtaggtaaaggaatttatttcctttacttatttttttgttgttttttggtttttgttgttgttgttttgagatggagtttcactctgtcacccaggctggagtgcagtggcaacgatcttggctcactggaacctctacctcctgggttcaagcgattctcctgcctcggcctcttgagcagctgggactataggcgcccgccactatgcctggctaatttttttgtatttttagtagagatagggtttcctcatgttggccaggctggtcttgaactcctgacctcagatgatccacccacctcggcctcccaaagtgctgggattacagactcatttacctttttttttttttttttttttttttttgtttggagacggagtcttgctctgtcgcccaggctggagtgcagtggtgctatctcggctcactgcaagctccgcctcccaggttcaygccattctcctgcctcagcctccccagtagctgggactacaggcgcccaccaccacgcccggctaactttttgtattttcagtagagatggggtttcaccgtgttagccaggatggtcttgatctcctgaccttgtgatctgcctgcctcagcctcccaaagtgctgggattacaggtgtgagccaccgtgcccagccacctattttttaaacagaggaagagggtggggcatcctcaaagcagggcaccttcctgtggtgtgctggagcccgctggcactggctcaggagatccgctatttcaggaattggctgacatcacactggtagcttgaaattggccatggtgggattatttacaccatggaaatgggcaaatgctacaaatcagggattcccttctgcctccccaaggagccggttgttaggcatttaccagcatacaactgccaccttaccaagggcatmccagtgcatccagccgtattttggggatgactccaattcatgggcgcttgtctgcctttatcacttcctcgatgtgccctcactcactactccctcagggcctctgcctttcyggcattttcctcatcacctccagcatgaaagattctgcctcccccttgagattttccaaatttcgacccctccctgcctccagctggaacaccctcagatgagacactggccactgaccctctggggctagccaagctgacaggcccaggagacaaggaccgaaggaacaagaggaagtgagtgtgtgtgagtgtgagcgtgtgtgtgtgtatgtgaatgtgagagtgtgtgagggtgtgtgtgtgcgtgtgtgtatgtgtgtgtatgagtgtgtgtgtgtgtgtgagagggtgtgtgagtgtgtgtgtgcagcggtggtggtggtgaacagaaatgggaattcaatgctgggaggaggtgtccgtgatcctgaacttgcttgcctggaaacccaggagctcctagagtttttattttttctttctttttttaaawtttttttttgtattttttacatttatattatattttttgtttcttttgtttttcttattttgttctctcttttgataggggttggggggagaggatttacagattcacatgtattttttgaccttctgccgtgttttgtacattcataaaagstgcgtgtgcgtatgtgcatrtgtgtgtgtgtgtgtatgtgtgctgatrggggccatccacagagcagggggtctccatccctgacagcttctatcctggccccttcacccttacaggcatgaactcctggaggaggcctgccgccagggcctaccttttgctgcctgggacgggcccaccgtggtgtcctggctggaggtactggggcccagaaatgccctgactgttggtccccaacccctctgacagccccactggtaggggctgcctggtcctcctggcgcaccctgcttctagcccagaggtgggggtggccatgggcctggcaggtgaggacccaggagggctcgggcttcctgttcacctaaacagtttctttctccttctccttctgcccctgccactctggccttgcccacctgggtcatggtctcctgtcgttctctctactctctctttctggattctctgtctctatttttcggcaccattcccatctctgaccacgcttttgtcattccccatatttctcctcatgtctccgatcgccctgccgatgtctccctgtctccggcttcctgtctctccccaccctctatttctctctctctatttctttctctctctctctctttctctctccctctccctcttcccccacccgccccccgccccccgtttctctccctatttgtctccctcggactctccctcatctcgtccacgtctcttttccytgtcctgtttcttctccttgcgaactttcccacgtctctgtttcgctccccacccccttgcctttccccacctccctgttcccccatctctccgrttttctcctcctctgtccctctgtcccctctgtccctctgtccctccgctgcagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcactgtgagtgtccggcggccaattccagccttcgyttcctcagagccccgcctcttgccctcagtctagccaatcctgggcctgctcactcccctgtcccacgaccctgcttctcattggcttttacccccctcagcctcccctccactcctaacttggcctgtggtccgtccctgtggtactccaggaggggcccaggccacctccttccctgactstctccctctcctcggcatttgctgtcccactcaaatgtcaccacctctaagaagctttctttgtcagctaaacgagtttccccatcattccggcatatcagcaccttctaattttccccatagcatttattgccttctaattattttatcttttctttcctttttttttggagacagagtttcgctcttgttgtccaggctggagtgcaatggcgctatctccgctcactgcaacccctgcctcccgggttcaagccattctcctgtctcagcctcctgagtagctgggattacaggcgcccgccaccacgcccagttaatttttgtatttttagtagagacagggttttgacatgttggccagactggtcttgaactcccgacctcaggtgatccgcccgcctcggcctcccaaagtgttgagattacaggcgtgagcccctacgcctggccctcgttccaacttttgattacgagacatttcaaacatacagaaaatcatgtgtacccagttcagcgattctcaaacttttgctgtacttgctctgttgtgtgtgtggggtggaggcggggagtggggaatacaggttgagtgtcccttacttgaaatacgtgggaccagaagtgtttagaatttctgattttaaaaagttttttttgaatatttgcatataaatgaaatatcttggggatgggagccaagcctaaacatgaaattcatttatgtttcatatgcatctcatacacatgcctaaaaagaattttatacaatattttattttttatttttattttattttttcgagatggagtcttgctttgtcgccaaggctggagtgcaatggtgcgacctcgactcactgcaacctctgcctcctgggtgcaagcaattccaatcctctgcctcaaccttccgagtagctgggattataggcgcccaccaccacgccctgctaatttttgtattcttagtagagatggggtttcaccatcttggccaggctggtcttgaactcctgacctcgtgatccacctgcctcagcctcccaaagtgctgggattacaggcgtgagccaccgtgcccggcctacaatattttaaatagctttgtgcatgaaacaaagttttgactgcattttgwttgtgacttgtcacatgaggtcaggtgggggattttcctcttgtggcttcgtgtcagcacgtaagtttagggccaagcactgtggctcacacctgtaattccagcattttgggaggctttggatggccgatctcttgaacccgggagttcgagaccagcctgggcaacatggcaaaaccccatctctactaaaaatacaaaaattagtcgggtgtggtggcgtatacctgtagtcctagctactcaggaggctgaggtgggaggatcctttgagcccaggaggtcgaggctgcagtgagctgtgattgtcccactgtactgcagcctgggtgacagagaaagagtgcatccaaaaaaaaaaaagtttagaattttggagcattttggattttggattttcaggttggggatgctcagagacctgtacttgaatgtaattggagaargtcataacatcttagcccccaaaattactttagtgggtctttttcttccttgtaaacaccacatcctttatcacacctaagggcattcacattgttgttaatttctttttcttttcttttctttcttttttttttttttttgagatggagtttcactctgtcgcccaggctggagtgcagtggtgcgatcttggctcactgcaacctccgtctccctggttcaagtgattctcctgcctcagcctcctgagtagctgggattaaaggcacacgccaccatgcccagctaatttttgtatttttagtagagatagggtttcaccaacgttggccaggctggtcttgaactcctgacctcaggtgatccacccgcctctgcctcccgaagtgctagaccactctcagcctaatttttgtatttttagtagagatggggtttctccaggttggccaggctagtcttcartctccaaaagtgatgtgcccgcctcagcctcccaaagtgctggcactacaggtgtgagccaccacgcctggccacagttgttaatttcatttactattcactctgtattcaaatttccccaacatacttaaaatatgttyattgtttctcccccactaggacgaaaagtgtctgtcgtgtcccttgccatatcccacaccctatgacggtgactggtgcctgacactcaccagaagtacataaatgtttttatccttgtatggattcctaactcgtgaggttgttgggagcagaagctcaataaatgtgaaccccccccgccatactccctaaacatttgcaccatggctgtgtctgtcccccacttctgaatcctcattctgtacctctgtgtgaggtcagcgaggtgacgtcatttgcacagggccacacagcaaaatgcatggcagggtcccaattccaacctgaatttgttcaactccaaagtcacattgcctggtacatggcaggtgccctataakaagaatcattccttttctctgttactgcttgccccagaaagcaggagggacataaacgtgtggcccagggccttcaggaggacaccctccttcctctcccccacgcgaagccctctcccaccatccattaacactccctgcccctcagtccacaggaaacgtgtggatgacacacgaggagatggagtcccttacggccacgaccaagcccgtgagtgccccctgccggccgccttgggggtggcactaaccttctttgggggtgggggcggggaccgagtctgtggccatccctaagtccgctccttgcgtcctcctctgcctgccccttaactcaccccttctctcccctcttcctactaacgggtcaggagaccaaggagatcagctgggagcaggtagggggcgcggggcggggcgtgagcgcatgaacaggctgtgcacgaygcatggatgcccctcctccgagccctgcccctgccttcaccagaacatgccatcatccccatgggggggcgctgcgccaagcttggctctggactgttccattatggcttggcggtggggagggtagaggggatgcgatgtggaagcccagactgttgcatagtcagccttatgcatggaccatttcatcatcgtgggttgtgggggctctaaggggcttcaattctgtagctcaggagagactgagcagccggtgtccctatagtggagggggcgggggctacagtggactgctcagtgtaccagggccaaggaggacacactggctgtggtggtggtgaggcagccaggctgaatgagaagttggggaggaggagctacactttgttctcaagaaacaagaggcggccgggcgcagtggctcacgcctgtaattccagcactttaggaggctgaggtgggcagatcacctgaggtcaggagtttgagaccagtctggccaacatggtgaaaccctgtgtctactaaaaatacaaaaattagccgggtgcagtggctagcgtatgtaatcccagctacttgggaggctgaggcaggagaatcgcttgaacccaggaggtagaggttgcactgagccgagattgcaccattgtactccagcctgggtgayagagccagattccatctcataaaaaccaaacaaataaactaacaaaaaaacccaagaggcatgaactcactgtccacggaggaattatgtttgactgtggtcatagatcacatatttccagccagggggaggcgtggattttgtgctgatrctgaaaggagtgagggacttgggactcatctggaatattgtcctgggccagatataacattagacaagtattttcaggacattgcaagagtgatggccctttcttagtgggagagctgccttgaaagagtccattgtcctgacttgggggtktagtgacgttggactgcagtgagacagagttaaagcagtgcttccccaaatttaatgtgtagtggggtggcacrcacctgtagtctcagctacttggaagactgaggcaggaggaccgcttgagcccacgaagctgaggtcaacctgggcaacatagtaagaccctgtctctaaaaaataaacaaatacagccaggcgcggtggctcatgcctgtaatcccakcacgttgggaggctgaggtgggcggatcccttgaggtcaggagtttgagaccagcctggccaacatggtgaaacgccgtctctactaaaaaatacaaaaattagccgggcgtggtggctcgtacctgtaatcccagctactcgaaggctgaggcaagagaattgcttgaacctgggaykgggaggttgcagtgagacgagatcgtgccaccgcgctccagcctgggtgacatagcagactctttcagaaagrgagagagagagagagagagagagaaagagagaaagaaagaaatttaaaaataaatataatgtatatttcgaatcacctgagggtcttgtgaaaatgcmgataccgacttcagtaggtctggagtaaggtctgagattctgcaattccagcaagtccacaggtgatggtgacgctctaggtctcaggacaactgtttgagtagccaagagtatatgctgtcatgaagggctaggagacaactctggattggtccattatcctgagcagagattggtcattgtcctaccatggggtgggaaaaaaccttggattgggaggttggactgtacccctctcatgcacagtgggaaggggccagagggcctgactcttccctcacctgcccatggccccagatcctggcatatggcgacatgaaccacgagtgggtggggaacgactggctgcccagcctggggctgccccartaccgcagctacttcatggagtcgctggtggacgctcgaatgttagatcaccttaacaagaaggagctccggggccaactcaagatggtggacagctttcacaggtgggggctgcctggccagtggggacagtccaaagggaagccccaccccagagagtctttggccaataggattggccatgggagattcccaggcttatcttggcccttttagcctgagttctcaggaaatcctgactctgtgctcctttcaccaatgagatggtccacaggaaaagttcagatcctgaaatggcttggctagttaaccctggaccccttccaggctggccagtaggaagtgcctattattgaaaatgcctcacctcctgaggggrtcaacagtcaatagaacttatcagctccccaccctttccaagaagagcgcagccagtggggagggacccgtaggagcagcagtctaggggactggaaagctcatccgtgactccacttcccctgctgctcagggtgagtctacattatgggattatgtgcctgaaacggctcaactatgaccggaaggacctggagcggaggcgggaagaaagtcagacccagatccgaggtgagtagagcctaagggtccctttgggagccaggtggagggcgtggagctggatggggaggagagggggtagggggagaccggagaagcaaattggcaccataaccgwrggggtggagccagcgtggggggcgtggcccgaagagaccaaatggaggtggaggtatgggctaaactgaactctccaggccacgggaggggcacggctgagggtcccttccgtccccagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggtgagctgccgctgggcccggagcatgctgggcgtccccacctcgcagactgcacgctccaaccgccccctccacctcctctttccaggcccggcagcttctggagaaggaattcagcaaccttatctccttaggcacagacaggcggctggacgaggtgggcgcggcaacagctcagagggctctgctcccagcggctcctcgagaggctgagctgagggggcggggcctgactattaatggtcacggttggaggcggggccagragaggggcggggttaaaggagargtgagacccggagaggggtggagtcaaaggaaggggcggagtcagacaaggcaggagtccctcaccggctgtccggctcctatacctaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggtggggggctcccaaatgcgacagcccttcctcgcttccctagggtggggcatggaccacctcagtagtccgggttctggaatggcctagtcctttctcgcccacccctgaggaatggactgctccaacgttccggactcccccgtcaggatgaaatggataaatcccactcccccttcccagggcgggagtgaactcgcccaatgcgagtttgagtccttggctgyggggaagggagggaaacccatgtggagcccggcgatcgttgtgacatcgggaagggaagtccaaagggaggaatcctggagaggaacagggaggagkgtgctccaggctgaaccgctgctcgctctccctccaggccagacttctgggagttcccgggcagacggcgtttcggtccggacctattcctgctagtgcaggcctccaggtgaggaccgtgctgggcgaccttgggggtgcggggcggcacggtggatcttcactgctccacgcgctgcccggcgtcatgcaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcscagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcgggktcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatkccgctgggcgacgtggcgtgggggcagggggacggtgggggagccctcgcccccgactctcggtcggcctccccgccccaggcgtcactcagtgatcacgggtaaagagaactgtttcaaaaagcttccttgttgactgattttttttttgcggggggggggggggctgttcaaccaaccacctcgagccaggagtccaggcccctcatccctcaagtctaggtccaggtctctagaccctacccgcattccccgatgccctgagattcccagaccccacgtctgacaatgaggtttcggggagcacgtttattcggagaaataaatatagctcgtggaaaggggttggaaggcagggggaggtacacctgcgtcgcagtcgagcgactgggtcagggttccggcgtttccagcatgtctgccagggccctggagacgagaacgccagaagttagacagctggtgttcaaagcccaccccaggacgcttagagatcattaacctgcccatttcatggacggggaaatggagtcccagagtcatctgataactcatagcgagacaagcacttctctaaacggggcttttacacgctccccttttacacacttactgataaagggacgaggagaaatagtcaacgtagcttcctgtgggacagcagagaaaagaggcttgaggggtactgcacgagcaaaattaggcagccactcagtatagcgtgcgagattagtgctagctccacctccttttccctaattccttcttccaactgaatcccttctaccggacccctttttcgttctgggtgattccgttctccagtagccccgccccttcgattcctacttgagttggcctcgcccattaggctctaagcccgcatctcaaccctccactcatttctgtcccttggctccagcaactccacctggtgttcctcgagccaggccccggcccacgtgctcagagccttggccacgcctcccctcttagccccgccccaccagccttccgggccaggctccgcccccaccaggattcaccacgctgggcccggcaccttcctcaggtttttccagggccccgcccatgctcacctggagcgcagaccgtttcgcagaccagcgggcagagatagcagaactgacagtgctggaggcggggacggggagagagagtgagcgtggggcgtggccgggggcggagttaggatggggccgggaccagacccggaccagaggctaggtctaggttaaggttggagtcaggatcgcttgtggagtcaaggttgcatcaggggtaaggggttgggtcagaggccaggatttagggctgggggtcctcagagggtcccggtgcatcctgaggcccagtggagccttgagtgtgaggtgaggtctcacctggcactggtcgcagtgctcacccatgttctcctcatcacagtgacagctctcacattcagtgcatcgctggggaccgggggagcctggttagatggaaactctaacgccacttgggaggtacccgcccctggcccacccctgcaccctggacgcttccccagactctaccctctttatctctaacactgagctctgtatctgccccccaaaccagcctcccctcccctcccctgcccctggtttccttcctttccctttttttccttttttttcttgaggcggagtctctctctgtcgcccaggctggagtgcagtggcgcaacctcagctcactgcaacctccgtctcccgggttcaagcgattctcctgcctcggcctcctgagtagctgggattacaggtgcgtgccaccatgcccggctaatttttttgtattttttagtagaaatggggtttcaccgtgttagccaggatggtctcgatctcctgacctcgtgttccgcccaccctggcctcttaaagtgctgagattacaggcgtgagccaccacacccggccctgcccctggttttctatctcagggcgaccccatgtctccctgtcagggtgggctcaggtgctctctccacccgctctctgcctattctccccctagcctatcagcccctgtgccatccctccttcccccgactctctttgccacagacccctgtctctgtccccacaccccaagatgcagcttgggtcttgtcctctccttcctggaccactgccccagcctcccagccttcatcagtctgtcctcacctcacatgcctgcagaaggatctcttttctttcagaactgaccctggcctgcccttgctctgagccctcccacagcaccaccccagggcccctgggacagattctggggacaccttggtgggtggatctgggctggggacatacattgcagaaggagcagtagccacacagggaccctggctggtagttcccatactcctgagcatcctgtggacctgcggggacaggagggcagcagtgacccaggctgactcggttccttcccacccacaccagcccaggccacttacctgtgtcctcaccgctttcctcctcgctggaggcacctccagcctcctctctcctgtccagtgggttggggatgatggtgaagcggggctcatcttcctccagcccctcctcctcctcctcttcctcctcgctgtggtctgggctcagtggggccccaacctcagccctctcttccctcctctcctcgtcttcttcctcctcctcctcctccttgtcttcctcttcttcctcctcctggttcaggctgaggccatgaccttcctcctcatcctcctcatcttcctggtcccggctgccatgatgggtgcctttctctccctgctctgaactttcatcgtcttcctcatgggagccggggtcctcttccttctccttttcctcctcagaatcatccttcctcaaatggcttctatccttgaccactgtgtgtcctggggggtgatggctcatctctttgatggaccctctttgaccatggccagtttcttcatcttggtggctttgcctgtggctgggggcctggtggccaagctcagcagagacctcctcatcttcctccctggggactctgtggtggtgatggtgagggacttctgttttatactcatcttggaagtcctcttcatcactcttgtggcctcgaggttggtggcttgcaacatagtggccgaactggactgtgatctcctcttcttcctcttcctcatctacaaggccatggtggacatgttggggaccctggtgccaacgttcagtggacacatcctcatcttcttcctcgtctctgtggccttggtgcctgtggtcagggacatgatggtggtgttcacctgagacagcctcaacctcttcctttctgtggtcttggtgcctgtgggcctggtgtccatactcagtggagacatcatcatcatcattgtcatcttcttcatggcttcggtgcctgtggctggggtcgcgatgatggtgtccatctgagacatcttcatcctcttcaatcccgtggccttggtgcctgtgagcctggtgtctatattcaatggagacatcatcatcatcatcatcatcatcatcatcatcatcatcgtcatcttcttcatggccttggtgcctgtggctggggccatgatgatggtgtccatctgagacatcctcatcctcttcactcccatggcctcggtgcctgtgggcctggtgtccatactcagtggaggcctcctcttcctcctcctcctcctcctcctcctcctcttctccttcatcatcttccccatcatggcctcggtgtccatgcctgaggatatgatggtgatgctcactggacacaacttcatcctcatcctcgtcttgatggctgtggctcctgtggctggggaggtggtgcctgtgctcagctgagtcttccgtgtcttcactcccgtggcctctgtgcccacgggcctgcccaccatgctctgcaaagacctcctcacctgagacaccctcatctccgactttgtggtcttgggacctgtggcctgggagtaggtgcccatattccttggcgacatcttcatcctccttttcacggtctgggtggctccagaaatgatgcccattctctgtggaaacatccttgttctcatctggatggtctctagggctgtggaggtggtggcgaagctctgctgatgcctcctcggagagcccggcgactccagtgttgttgttccggtttctgaagcccagcccatcccctctgagctgctgggtcatggccggggggaggagcaggctggccaccccagcccagaggacagaagcgtgcagccatggcctatggtggcccatggggacggacaggcagcactggctccagctgcctctgcggcaatgtggacaaacgttggggtctttgtccctttggggttggtctctttttttctctgtgtctctcctttgtcctttcggtctctgtccaccttcctctggtccttgctgcctggctctggacacccctctgaggctgtctccggagccccctgacccccctctggggccctccctccccattccccagccaatagggtccttcccctcccctctctccagctaaatttactctcagccctgagttattctgggtcagtccccgcctgcctgcctcctgctcctcctcctcccagctggggaggggaccagtgaggggtctctccctggccaggagacggtggccaagggacttgactttgaactaccaacaagctcacgtttggcagctgcaaagacaaaggctagacttttagcaggtttttgggggagcctggggcacctgggggaggcagaagagacttatcagaggggagagactcctgggacggaaggactgggggttcgattgcggggtgtttccagctggaatgatacgtgctggtgagagagtgatgtcagtattgaggccctagaatggggggaaaggaacatggcccccaacacacgtgcccatgacctcctgtccctggaactcagatctgggggcagggactgggctaggccagggctataaatacagctgggaggggtagggggactcaggttacggaggccacagctgtccccatcacagagggctggcaggagacaagtggccttgcccgtctctgtgtgtcagtatttcctactcctcacccttcatgactgcccccactagggtctcctttcctgttcacgggtcctcctctctcttcaattctgtcatctgctctctcagggtccctgtccctcctccatgggattgcctctccctctcactctgggcttctgtcccactcttatcttagtgtcagtcctcccccaagtctgtgtccctctctctcccctaaatctctggcccctcctttctgagttcctgcccttcccccaattctttggtttttgcatccccctctgccccttgcctcagtcaaggtgtctcctccccatctctggcatccacctctctgggtctctgtccccactctctctcagagtctctgtccccctctgtctcagagtctctgtccacctctccctgggtctctgtccccctctctctgggtctctgtccccctctccctgggtctctgtccccctctctctgggatctctgtccccctctctctgggtctctgtcccctctctctgtgggtctctgtccccctctctctctgggtctctgttcccctctctctgggtctctgtccccctctctctgggtctctgtccccgtctctctgggtctctgtccccctctctctgggtctctgtcctcctctctctctgggtctctgttcccctctctctgggtctctgtccccctctctctgggtctctgtccccgtctctctgggtctctgtccccctctctctgggtctctgtccccctctctctgggtctctgtcccctctccctgggtctctgtccccctctccgtgggtctctgtcccctctccctgggtctctgtccccccctccctgggtctctgtccccccctctctgggtctctgtccccccctctctgggtctctgtcctcctctccctgggtctctgtccccctctctctgtgggtctctgtcccactctctctgggtctctgt

SEQ ID NO: 12436 - DNA, 16711 bp, Homo sapiens
ttagaaaatcccaccatctcagcccaaaatctccttaagctgataagcaacttcagcaaagtctcaggatacaaaatcaatgtgcaaaaatcacaagcattcctatacaccaataacagacagagagacaaatcatgagtgaactcccattcacaattgctacaaagagaataaaatatataggaatacagcttacaagggatgtgaaggacctcttcaaggagaactacaaaccactgctcaaggaaataaaagaagacacaaacaaatggaaaagcattccatgctcatggataggaagaatcaatatcatgaaaatagccatactgcccaaagtaatttgtagattcaatgctatccccatcaagctatcattgactttcttcacagaattgcgaaaaactactttaaatttcatatggaatcaaaaaagagcccacatagccaagacaatcctaagcaaaaagaacaaagctggaggcatcatgctacctgacttcaaactatactacaaggctacagtaaccaaaacagtatagtactggtaccaaaacagatatatagaccaacgcaacagaacagaggcctcagaaataacaccacacatctacagccatctgatctttgacaaacctgataaaaacaagaaagggagaaaggattccctatttaataaatggtgctgggaaaactggctagccatatgcagaacactgaaactggaccccttccttacaccttatacaaaaattaactcaagatggattaaagacctaaacgtaagacctaaaacaagaaaaatcctagaagaaaacctaggcaataccattcaggacatagtcatgggcaaatgcttcatgtctaaaacaccaaaagcaatggcaacaaaagccaaaattgacaaatgggatctaattaaactaaagagcttctgcatagcaaaagaaactatcatcagagtgaacaggcaacctatataaggggagaaaaattttgcaatctatgcatctgacaaagggttaatatccagaatctataaagaacttaaacaaatttacaagaaaaaaccaaacaaccctatcaaaaagtgggcaaaggatatgaacagacacttctcaaaagacaacattcatgcagccaacaaacatatgaaaaaacctcataatcactggtcattagagaaatgcaaatcaaaaccgcaatgagataccatctcatgccagttagaatggtgatcattaaaaagtcaggaaacaacagatgctgaagaggatgtggagaaataggaacgcttttacactgttggtgggagtataaattagttcaacattgtggaagacagtgtggcgattcctcaaggatctagaactagaaataccatttgacccagcaattcccttactgggtatatacccaaaggattataaatcattctactataaagacacatgcacacatatgtttattgtggcactattcacaatagcaaagacttggaaccaacccaaatgtccaccaatgatggactggaaaaggaaactgtggcacatatacaccatggaatactatgcaggcataataaaggatgagttcatgtcctttgcagggacatggatgaagctggaaatcatcattctcagcaaactaacacaacaacagaaaaccaaacactgcatgttctcactcataagtgggtattgaacaatgagaacacatggacacagggaggggaacatcacacactggagcctgttgggggtggggggctaggggagagatagcattaggagaaatacctaatgtaggtgacggattgacgggtgcagcaaaccaccatggcacgtgtatacctatgtaacaaacctgcacattctgcacatgtgccccagaacttaaagtaaaataataataataataataataataataataaaagatggaggtggtggatgggtgaagcattttctctgtagtgtagggaattctcacaggtatgtagctccttaatcctcacaatgaaagaggcaaatatcattatttcattttacagatgaggacactgaggttcaaggaagttaaaagaacttgcctaaagtcacatagcttagaactggcaatatcaaggctgaacctaagtgtctgttccaaggctcagtcatgttccactaattttgaatgttggcaaacgaggagagagagatattgggacctaggatgaagggaagaaagagtttttggtagagaaaacacataaacatttatgtaagttgaaagtaaagagtcctcagaagctaagaactgaaagtacaagggagaataagaataattgagccaagtctcagaaagtttggaggaagcagcatgctgacctgggcaagagtttgccttggaaaggagtaaagttgcttttatttctgaaacaggtgggaaggaggtaagggtgggtaaagttgctattaagctggagcttggagaggagggaaattgagatggtcatactatttcctccttgaaataagaggctagttattctcctgtgaatagacaagtaagggaaagcctggatttttaccagtgactgggtcaggggagggaagaggggagaaaagggagttggaaagtgactggagcaattaggaaagagagtaaggctcaggcttgtaatcccagcactttgagagtccaaggtgggaggactgcttgagcgcaggagttcaagatcaccctgggcaacaaagtgagactcctgtctatacaaaaaataaaaataataattatcaggacatggtgactggtgcctgtagtcccagctgcttgggaggctgaagtaggcggatcctttgagggcgggagatcaaggctgcagtgagctatgatttcgccactgcactccagcctggatgacagagcagagccagaccctgtctcagttgaaaaaaagaaaaaaaaaaaggaaagggaaaagagtagagttgcaatatttagcagataaaaaatatagctcatggctgggctcggtggctcatgcttgtaatcccagcaccttgggaggccaaggcaggtggatcgcctgaagtcaggagttcgagaccagcctggacaacatggtgaaaccccatctctactaaaaatacaaaactagctgggtgtggtggtgcatgcctgtaatcccagctattcaggaggctgaggtaggagaattgcttgaacctgggaggcggaggttgcggtgagctgagatcacgccactggactccagcctgggcaatagagtgagattctgtctcaaaaaaaaaaaaaaaaaaaaaagatagctcacacagttacatttgaatggcacatttatgacaaatttttgtttagtgtatgctccaaagattgtgtggtattttatctgtaaacttttaaagagaaacactaaagcatgtgtaaagaacaacaaagccactttgaaatcaaaaattggaaatggagcaaacttaaggtaggaatgttgggcttgacttctaggcagcagcagacagggagttgtactggcagtcaggagatagcttgagaatgcaatttttagggcctccttggagagcaatgggaagagacttatatgggaactagagacttggaattggccaggacgccattgctggaaacatttgcctactatctaattttacctaagttgatcatctacaattacatctcataggtgtgtactaaagatgaatattattaaataacaatctgaaaggtttttggactctgtaaaacactttatcaatattgaatgttaaaaaccagtggtattcacaagaaaacaactgatatccccaaggaaattcttgaacctgtttgaggtttatcatggtggtctggagtagtggttaagagtctgcagcctgtcccacattaagcaagctgcttaatatgtctgggagtcaatttccttgtttgtaaaattagaataattatagtgcctaacttgtcagattaaatggattaatatgtgtaacactatgtgcaaatactaaaagtacaatgttacatgagatatcataggcagacaatgagaagtttcagaaaacattcattaatatgcatatgtatacactttgtatgcttacgtagaaaatgagtggttttaaaaggacattcattagcatacttttatatgcattttgtagacttgtacagtcagaaatgcagcaaatgtaaaactttaaatctagaagtctgtttccctctaggaacatatatttcaattccttaactatttattgactgatagcgtttgagccacaaggcaaggcatttgcaatatttaggttttggaacccagctctgccactcactagctgggaaatctacaagtcaccttagttgtctgaatgacacttctctcaacaataaaatggccagcaatgcttacttacttcacagagcagtaaggttaaattaacctagcacatgcttgatacagactaggtgtgaaatttcactttgattcctttggctttaaagaatgcataaattagtgtgggtggaggcgggagaagggggggaatgccaagtcccccgttttgttgtgctgggtagacacaatatacctcttcccctttaagtgaaataagtcttcaaatccaattaggatctactctggagtcttagaggaccgttatcttggtttccacattatatgcactgtactgttgttgaagctgtgggtatgtattgggtgcgtcgctgtcgatgaatgctttaaaacagctgtgaattaactgtcacttcttttttttttttttttggcaaactcacaaaatcccagaagtcaggggtctgttgtttgttcattctgcctccttctgagtcattcaggtacagggtgtgtctgccaattgaaactgcacagcggaggaagtttttgagttcacatctgccgggatgggaacgcagtgcgaccagggactgggtggaaacttttacaacagtaatgcaagggcagaagcgtcctgtcctgagcttgtcacgcaggcagatctgaccaagtccgcctctcagcctcacgttcttaagtagcatctaagcaaaagaaaagggtgggcaaagtgctagtaatgagatttgaggcctctgagtcgactcccaagcagaatgtgagagaagggtgccggctcctgctgggcagctgcagttgctccgcagctcctggccgagaatctccccctttggaaattcctgagctgcccaggcgttttgaatctctcaggactcagcagcagcccaccccctcaacgacctctccattggccagaatctgggacacacagcctgactttgtgctcagctgagggaaacccctcgcccaacaccaaaaccggcgctggttcatttctctgtgcactctgggaaagccactgcccctcagaccgcagttgcgagtagcacgaggatctggggtggcggggggagtacaggaacctcccggttcattctccctcccgggctgcttgtctcctccgtacctctcgcagccccttcccagcctctcctccccagagcgccgccgacactcgccgggccgcggctcaggttttctgctgctcgcgcgaaagtggctcggggagctcctggccacaagctcagcacaccgatcctcctagggctgcggggggtgtgggaccagggcggtgcgctacgagactccgggccgtcctctgcctcctcagacttttcgagagaaaagttttcaaagtctctccaccttttttttttttcaggggctcgggagaatcctctccacagccagggatcagcgtctatctgggcgagggcagtgatttatacagtagaatccaggggttaccgggctccgccccttctctctctctctttttttctttcatttgttgtttggggaggaggggttcttttttttttttttttttttttttttgcttctgccccagatctttcctggacagtgcgtctcagcagttcagatccgggggcccccagctgacagagggcgtggggggttaaggcattaacccctcccagcctcttcctgaagaaaccacccagccttggcgcggcgctgggtgacttcgcgtagcaggcagggaactggccgcggcgagcgggactggccattggagtgctccgctgcggagggaggggaccccgactcsagtaagtttgcgagagcactacgcagtcagtcgggggcagcrgcaagatgcgaagcgagccgtacagatcccgggctctccgaacgcaacttcgccctgcttgagcgaggtagggggcggcgaatggcgggggtcgcgggcgcggggagcccggttgtggtarggcttaggtgtcagaaacgaatttttaagtcgaacgaggcaaacaaaaacttagaaaacatgcatctccgggcgctgaaaatttgcatctctgggctactaaggagcccatctcgrtcagattgttcttgggcacttgtgatttatggagttcagaaaaaaggttaattcccaactgtggaacctacgggtgtaggggcagtgaaaattgcagttggtcggaggaataggagggaaggcgttaaattttggaaatcctatagacaaagaatatggtgggtggtgtggagcgtgggtaatggcttaaattagtactgcccaggagcagggtataamattagttgggggaaaatgcggagcttcttggcttgagcagcctctgctgttcgcggagttgctgggattgttctcatctctattacctcattttattgcattgctgcattaccttgaaatatttaagcaacttagaagtagacttctgctgaccagtgccgtcttagaaagtttctttgtaactttctagtcctaggagaggagycaacgtgttgggggactgcagtaaataaaactgcccacgcaaatttagcaatgcaccagggagcagtttaatgtgagtttctgaagagtagttttgcaatcgaaattagaaatgtggtagcatgtattatggctgtcatgagtagtttgatttctctcttttgtgtatgttttggctaaactaaacaaagcaaaaaatatttatgcaatcaactaatgtacgaaacttctgggatttgctgcaatctgttatgaatggttttaactgaatacctttaaatttacttgccctggcttggggtggggggtggggtgggggggcgcggggggaggcggggagaataagaagaagaaagaaaaggcagtcgcttcacggaggcgctaagctttcctgtttacagcaaggcggggcgggcctggctgcccacacctcactgcgccctcggaccctaagcacacctgctcctagagagttattaatagagcccccaaatggcttacgctttcaaatgattttcctgcaaatctgatttcttgcatggcacatggcaattaggaggtggtgctagtatctttgaactggggggctgggggtgggcatgggggacagaggtgtgtgtcttcgccctcagactggcagttgagtcttttccgaggagagacgtgggctggtattgagcgtgcagctaagctggtgactgcttcagagaatctcatggctggaaatccgggggtgagggggtgtggggtggtgagagggcaggagtggagttaaaatggggtgtagttctctaggtttcccattcctcccactccttgttttccttttcatcatctttttttttttgtcaacccacagccaacatcgtaattcccatttccctttgagtgaatgtggccatagagtttctccctctctttttcttccccctcttccttttttgaaaaaagaaaaaaaaggaagaaaaaagataatttgattttwaaaaaaaatctctctccctgagctctccccaagtttctttaaaacaaatcaacaacaacacaattggagcagtgccttagctagaatgaattatgccagtatgctgtggctctttccctgactctctcctctgacttgtttaaggctgcggtttccgaggccctctccagccaaggaaaagctacacaaaaagcctggatcactcatcgaaccacccctgaagccagtgaaggctctctcgcctcgccctctagcgttcgtcyggagtagcgccaccccggcttcctggggacacaggkttggcaccatggggcccaccagcgtcccgctggtcaaggmccacsgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagrgggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttsgcacttttgttgatgtttatttcagaatsttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagatccctttgtgaagagcattcttaaaaataattattgagtcatctactggattgtgtagctctttggaatcaaagtgaaggacaaatttctattattctttaaaggatttttaccttaactagggtgtgaaaaaagtgtggtttgtttagaaaccactctatctttttcaggaagagaaacttcaataagttaacactgaagagtagtaaagaatgagataaaaaccaccaaccttctgaataccacattggctagtaagtagaattgtttgagttttaaactgcatttaagccaaataaattaaatgcaataattctgtcatcaaatatgggcttttaaagaaattatacacaaaaatgtggttgtaaatctagtttaaatgatgagactcaatcatcattcaaaacccatcaaaaaagcatacattcttggcctttcaccaacatgttggggaagtggggatatggatatgggtattaaatcatgtgttttttttttttttttttcaggacactgtcttggcttctcccagcctatcttctgaaccacatagaagtatacagtatcagtgaagcagctagctgtaaaatgtgggctgagtagcataacacttttatctgaaaaccttcaattcatagtatctgaaagcattaatattctcagtcattaatttttccaactacaaaatgaaggcactttgcaagcatcacagacttattgtaatagttaattcttgtttttgattattgtcatcttttgggggattaaagtgttttggcatgttgggctctctaatcttttcgctactttcagaatttgtgctttcaagtgtcattgtatatgcacaggacacagttgggacatgaagataaacctcacctaatagagtagatgtcatttctgggtaaggttaactgtgggaaacagaaatgtgttcactaaggaaaccttaggtcacaacctccagtttcctgaaggaaatgccaaaaatgctccaaagacaaaaggctggaaacaaactggaatgtctctctccatctgtctgctaaggcggaaggaatgatttcatgttacattcacttcctagactttcattacagagtcaagcataatggaaaagtatgtccattttgtgtttctgtggaagataaaatgttcatattctccgacttatcttcataagcacagtagtgattcatgatatggggaaagatgggataaggtggctggctttgggagatggggagctctttggtgacacttttccccctgtgaccacattatccagtgattagatgtactttcttcctggaaactccagactgtgcatttcattccaagaaagctgggtagtcatggactgtggttttcctgggcacatgtgtggtagagccccagatcagaccaagaagcaaagacataagaagaaggaatccttggttgtctcccaacatgaatatctggttttaattcagtgtattctcagaagtaagaatgagaaaaaaatcttagtaattatatgtttgtactaaaaaatacacatataaggctttgattttaaaattgtagtgtttttcaagaggagtgaaacagatcctggacaatacttgacatattcttgtaaaaagttcaattgactcaaaatagtcaggaaagttatgaagtaacatcatataatactttatccccaacaatattaaatgtgattacaattttacagaatattcaaatcaaaatgttatataagacaaattattattcttgcttttacaactccttagaaggagaaacattcaattgttttaaaaatgttctatttatttttcagaaatgaggtgttgccttcttgcccaggctagtatgcagtggcacaatcatagctcactgcagccttgaattcttgggctcaagtgatcttcctgccccaagcctcccaagtagctgggaccacaggcacgtgccaccatgcctggctgatttttttttttttttaatgttttgtagagacaggatctcagtatgttgcgcaggctggtctttaattcctgggctcaagtgatcctcccatagatttgtctgtgttttctctaaataggttataaataccttgagggaggaatcacaaataactaaaagaaacttttgtagagactatcagagtattatttccttgtggacacagtaaatgtatgatgatgagaaatcataataaactacaacattttctccaaccttccttcctgctcttttgatgtgtacttcacgtggtccaagaaaagggactcaaaatactttttaacatacaccattgccttcactgcaatactaagtggaactagagttgtctctcagaacattcaagcaagcaaggtttacttgaataactaaaggccttatatggattatctataaagaggattttaaaccggtggtttaaaaagctgggagagataggaggaagagcatagtgaggggttagacctgcatttatttcagtctttcacaatctttgacaagaaccaggacccagagtagtttgggttcatgttgaatatatctctcctaatacatccgatctcttgttccctacactttcttcttggattcagactctcaagtaatttctgtttttcccgtgctctcttttttatccctttgaggactaaaggattaaaaaattagacttagctctggttatagtcattagcaagagccaagtgtggactgtggacttgagtgaacaggaattgctacattttatgtaatccaaccttgatatatgaagtatcttcatatatccaaccagaagcttccatatcagtaatggataaatacaccatggtaaattaatacaatggaatattattcagcaacaaaaaaggacctactactaatcttgcaaccgttttcatgaattttaaacctcttatgcaaccacaaaagagaacatacgtcatgatttcctttatgtaaaagttccagaataggcaaaactaatatatggaggtataaatctgcacagtggttgcctggggtaagaggataaactggaaaggaacacgagggaactttctaggttgttagcaaagctctttatcttaatttttaggaccttgttcactcagatgtgtatatttgtctaaacttatgtaatcatattcttaagaccagtgaaatttaaaaatatcaatatgctagactttcacttctgagtataaggactatatgagactttctctgtgaaattgtgggaaggttccatgaagttcagtagaaagtggcagccgtgcacagtggctcacgcctgtagtcccagcactttgggaggccgaagcaggaggatagctttgagctcaggagttcaagatcagcctgggcaacatggcaacacccgtttctacaaaaaatacaaaaaaaattagctgagcatgatggctcacacctgtagccccagctatttggatggctaagtctggagaatcacttgagtccaggaagtggaggttgcagtgagccgagatccggccactgcattccaactccagcctgggtgacagagtgagatcctgtctcaaaaaaaaaaaaaaaaaaaaaaaaaaagaatgtggaaaaggttccaaagtgtttcataaaagggaaatacgctttttaagtattatcccatgacccagaaataaaactttagaatgctaaataattgtgacatgatgatactctttgcttccataggatgagaatttggcttagtattggtatttgtaatccctgaagaatttctgtgtcttgaaagagtctagagatgtaatgaaactgtcacaataaaagtttattgacatttggatttcagttttaggaatatatgatgggttgtaaatagccttatgaagaatggaccttgtatacattgcaaggatatgtaaacatattagtactggagacatacaaattggagtgtgccaatttcttatcatggccacctgaccaaacctataaaaggcattcattcagataataacactcgccctgggtgtaagcactgcattgttagaagagatagcagagcacaaaggatatggaagacaagcttatgttcctgtggatctattttttaataatttcagcttttatattagattcaaggggaacatgtgcaggtttgttacataggcatattgctgtgatgttgaggtttggggtgtgaatgatcccatcactgtggtagtgagcatagtacccaacaactagtttattagccattgtccccctccctctctctcccttctagtagacaccggtgtctattgttcccttatttatttattttggagggtctcactctgttgcccatgctggaggggagtggtgtgaccatagctcactgcaacctggaacttctaggctcaagcaatcctcccgtctcagcttccagagtagctgggactataggtgtgtgccaccacacctggctaattatttatttttgtagagacagggtctcactttattgcctaggctgttgccacactccttacctcaagcaatctttccaccttggttttccaaagtgctagaattacaggcgtgagccatcatgaccagcctgtttccatctctatgtccacgtgtacccatcctgtgagttttataagcttgcagccagacacattgttacctgcattcccctgtctgaggggtctttctttcagccatctctgggagtaactggacagagaagaaatgcctcaggtgctgcactgctccttggacagactgattagatacaaagcagaaatagaaacagggaagagggggcatggttacctcagctaacaaggagcagggagacgtaggaaattgtttatccatttccccagagctctactactattattactccacttttctgctgctttgttgataccagggcagaaagaaaaaccttggaaaaagttactggtgtgggtcatgcttcctactcccattcctcttgataggtcggcaaacttacccactcatccactcaacaagaatgcttgccctgtgctctgtgctgtggatctaggggcaaatataaacagaggttctgccttcctagagctcacaggattcattccttcagctctggcactcctgtggctccctctctttggggtccagggaccttgatatggcaagacaaaattctttcttttttttccttttttgagacggagtctcactctgtcgctcaggctggagtgcagtgatgcgatctcggctcactgcaacttctgcctctcaggttcaagcgattttcctgcctcagcctcatgagtagctgagattacaggcgtgtgccactacgccaggctaatttttctgtttttagtagagacggggtttcaccacgttggccaggctggtctcgaactcctgggctcaagcgacccacctgcctcggcctctcaaagtgctgggattatagacgtgcatcacggcacccagccaagaaacagttctttttttcccatgagtttgttcattgttgtacacttcctctaatatattgagttctttagcagtctaaaataatttcatttaacaaatacaattaatattggcagcttttcatcattggcttttatttaatttatatctctaaattacttaaaattaaataatgaagaataaactcatatttggaatggagagaagttccttgtgttattgggtggtgttgtaaatatcagtatttgtattctatttttcagcatctagtccccatgtgatcaagaagcaactccgtaaaataaaagcattcaacattgtcttcagtttctatctctccttagtttgtgtttttcttcctagatccctattgtgaactgtgctaggtggagctgcttggtttataatgtgcagatgaagtgtacgtttgaataagtcataggtggtgtccttattcaacttggatgaaaaggaaaggagagaaaaattcacaactcaagaggataagcag
